United States Patent 7,862,827 (COMBINATION NEISSERIAL COMPOSITIONS) - sequence listing, part 2

SEQ ID NO: 3591 - DNA, 2112 bp, Neisseria meningitidis
atgaaaatatcatttcatttagctttattacccacgctgattattgcttccttccctgttgctgccgccgatacgcaggacaatggtgaacattacaccgccactctgcccaccgtttccgtggtcggacagtccgacaccagcgtactcaaaggctacatcaactacgacgaagccgccgttacccgcaacggacagctcatcaaagaaacgccgcaaaccatcgatacgctcaatatccagaaaaacaaaaattacggcacgaacgatttgagttccatcctcgaaggcaatgccggcatcgacgccgcctacgatatgcgcggcgaaagcattttcctgcgcggctttcaagccgacgcatctgatatttaccgcgacggcgtacgcgaaagcgggcaggtgcgccgtagcaccgccaacatcgagcgcgtggaaatcctgaaaggtccgtcctccgtgctttatgggcgtaccaacggcggcggtgtcatcaacatggtcagcaaatacgccaacttcaaacaaagccgtaatatcggtacggtttatggttcgtgggcaaaccgcagcctgaatatggacatcaacgaagtgctgaacaaaaacgtcgccatccgtctcaccggcgaagtcgggcgcgccaattcgttccgcagcggcatagacagcaaaaatgtcatggtttcgcccagcattaccgtcaaactcgacaacggcttgaagtggacggggcaatacacctacgacaatgtggagcgcacgcccgaccgcagtccgaccaagtccgtgtacgaccgcttcggactgccttaccgcatggggttcgcccaccggaacgattttgtcaaagacaagctgcaagtttggcgttccgaccttgaatacgccttcaacgacaaatggcgtgcccaatggcagctcgcccaccgcacggcggcgcaggattttgatcatttctatgcaggcagcgaaaatggcaacttaatcaaacgtaactacgcctggcagcagaccgacaacaaaaccctgtcgtccaacttaacgctcaacggcgactacaccatcggccgttttgaaaaccacctgaccgtaggcatggattacagccgcgaacaccgcaacccgacattgggtttcagcagcgccttttccgcctccatcaacccctacgaccgcgcaagctggccggcttcgggcagattgcagcctattctgacccaaaaccgccacaaagccgactcctacggcatctttgtgcaaaacatcttctccgccacgcccgatttgaaattcgtcctcggcggccgttacgacaaatacacctttaattccgaaaacaaactcaccggcagcagccgccaatacagcggacactcgttcagccccaacatcggcgcagtgtggaacatcaatcccgtccacacactttacgcctcgtataacaaaggcttcgcgccttatggcggacgcggcggctatttgagcatcgatacgttgtcttccgccgtgttcaacgccgaccccgagtacacccgccaatacgaaaccggcgtgaaaagcagttggctggacgaccgcctcagcactacgttgtctgcctaccaaatcgaacgcttcaatatccgctaccgccccgatccaaaaaacaacccttatatttatgcggttagcggcaaacaccgttcgcgcggcgtggaattgtccgccatcgggcaaatcatccccaaaaaactctatctgcgcggttcgttgggcgtgatgcaggcgaaagtcgttgaagacaaagaaaatcccgaccgagtgggcatccatttgaataacaccagcaacgttaccggcaacctgtttttccgttataccccgaccgaaaacctctacggcgaaatcggcgtaaccggtacaggcaaacgctacggttacgactcaagaaataaagaagtgactacgcttccaggctttgcccgagttgatgccatgcttggctggaaccataaaaatgttaacgttacctttgccgcagccaatctgttcaatcaaaaatattggcgttcggactctatgccgggtaatccgcgcggctatactgcccgggtaaattaccgtttctga

SEQ ID NO: 3592 - protein, 703 aa, Neisseria meningitidis
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGTVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSIDTLSSAVFNADPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYDSRNKEVTTLPGFARVDAMLGWNHKNVNVTFAAANLFNQKYWRSDSMPGNPRGYTARVNYRF

SEQ ID NO: 3593 - DNA, 444 bp, Neisseria meningitidis
atgaagtggttattaaatatgataatgagacctattaaatttagtatggtaaatacgttattatttattgttatatgtagttcattttttgatctgctcgttcaattatgtacaattttatttcatagccaaaaaatatactttattacattatttttattatttatttttaattttgttacaaaatctatctatatggcaattatttatcctattttatatttttttacgataaaaaaatattatccttactctaggaaagtgataattctattatcattagcattatctatatattttagttttatggacttttactttttttccatatattcagataaccttagctatgaaacggagcctttacatttatacatccctattattattaattttttctcacttttagtttctaattttattttatcttttatcaacaagtaa

SEQ ID NO: 3594 - protein, 147 aa, Neisseria meningitidis
MKWLLNMIMRPIKFSMVNTLLFIVICSSFFDLLVQLCTILFHSQKIYFITLFLLFIFNFVTKSIYMAIIYPILYFFTIKKYYPYSRKVIILLSLALSIYFSFMDFYFFSIYSDNLSYETEPLHLYIPIIINFFSLLVSNFILSFINK

SEQ ID NO: 3595 - DNA, 444 bp, Neisseria meningitidis; identical to SEQ ID NO: 3593

SEQ ID NO: 3596 - protein, 147 aa, Neisseria meningitidis; identical to SEQ ID NO: 3594

SEQ ID NO: 3597 - DNA, 1404 bp, Neisseria meningitidis
atgacattgctcaatctaatgataatgcaagattacggtatttccgtttgcctgacactgacgccctatttgcaacatgaactattttcggctatgaaatcctatttttccaaatatatcctacccgtttcactttttaccttgccactatccctttccccatccgtttcggcttttacgctgcctgaagcatggcgggcggcgcagcaacattcggctgattttcaagcgtcccattaccagcgtgatgcagtgcgcgcacggcaacaacaagccaaggccgcattccttccccatgtatccgccaatgccagctaccagcgccagccgccatcgatttcttccacccgcgaaacacagggatggagcgtgcaggtgggacaaaccttatttgacgctgccaaatttgcacaataccgccaaagcaggttcgatacgcaggctgcagaacagcgtttcgatgcggcacgcgaagaattgctgttgaaagttgccgaaagttatttcaacgttttactcagccgagacaccgttgccgcccatgcggcggaaaaagaggcttatgcccagcaggtaaggcaggcgcaggctttattcaataaaggtgctgccaccgcgctggatattcacgaagccaaagccggttacgacaatgccctggcccaagaaatcgccgtattggctgagaaacaaacctatgaaaaccagttgaacgactacaccgacctggatagcaaacaaatcgaggccatagataccgccaacctgttggcacgctatctgcccaagctggaacgttacagtctggatgaatggcagcgcattgccttatccaacaatcatgaataccggatgcagcagcttgccctgcaaagcagcggacaggcgcttcgggcagcacagaacagccgctatcccaccgtttctgcccatgtcggctatcagaataacctctacacttcatctgcgcagaataatgactaccactatcggggcaaagggatgagcgtcggcgtacagttgaatttgccgctttataccggcggagaattgtcgggcaaaatccatgaagccgaagcgcaatacggggccgccgaagcacagctgaccgcaaccgagcggcacatcaaactcgccgtacgccaggcttataccgaaagcggtgcggcgcgttaccaaatcatggcgcaagaacgggttttggaaagcagccgtttgaaactgaaatcgaccgaaaccggccaacaatacggcatccgcaaccggctggaagtaatacgggcgcggcaggaagtcgcccaagcagaacagaaactggctcaagcacggtataaattcatgctggcttatttgcgcttggtgaaagagagcgggttagggttggaaacggtatttgcggaataa

SEQ ID NO: 3598 - protein, 467 aa, Neisseria meningitidis
MTLLNLMIMQDYGISVCLTLTPYLQHELFSAMKSYFSKYILPVSLFTLPLSLSPSVSAFTLPEAWRAAQQHSADFQASHYQRDAVRARQQQAKAAFLPHVSANASYQRQPPSISSTRETQGWSVQVGQTLFDAAKFAQYRQSRFDTQAAEQRFDAAREELLLKVAESYFNVLLSRDTVAAHAAEKEAYAQQVRQAQALFNKGAATALDIHEAKAGYDNALAQEIAVLAEKQTYENQLNDYTDLDSKQIEAIDTANLLARYLPKLERYSLDEWQRIALSNNHEYRMQQLALQSSGQALRAAQNSRYPTVSAHVGYQNNLYTSSAQNNDYHYRGKGMSVGVQLNLPLYTGGELSGKIHEAEAQYGAAEAQLTATERHIKLAVRQAYTESGAARYQIMAQERVLESSRLKLKSTETGQQYGIRNRLEVIRARQEVAQAEQKLAQARYKFMLAYLRLVKESGLGLETVFAE

SEQ ID NO: 3599 - DNA, 1404 bp, Neisseria meningitidis
atgacattgctcaatctaatgataatgcaagattacggtatttccgtttgcctgacactgacgccctatttgcaacatgaactattttcggctatgaaatcctatttttccaaatatatcctacccgtttcactttttaccttgccactatccctttccccatccgtttcggcttttacgctgcctgaagcatggcgggcggcgcagcaacattcggctgattttcaagcgtcccattaccagcgtgatgcagtgcgcgcacggcaacaacaagccaaggccgcattccttccccatgtatccgccaatgccagctaccagcgccagccgccatcgatttcttccacccgcgaaacacagggatggagcgtgcaggtgggacaaaccttatttgacgctgccaaatttgcacaataccgccaaagcaggttcgatacgcaggctgcagaacagcgtttcgatgcggcacgcgaagaattgctgttgaaagttgccgaaagttatttcaacgttttactcagccgagacaccgttgccgcccatgcggcggaaaaagaggcttatgcccagcaggtaaggcaggcgcaggctttattcaataaaggtgctgccaccgcgctggatattcacgaagccaaagccggttacgacaatgccctggcccaagaaatcgccgtattggctgagaaacaaacctatgaaaaccagttgaacgactacaccggcctggacagcaaacaaatcgaggccatagataccgccaacctgttggcacgctatctgcccaagctggaacgttacagtctggatgaatggcagcgcattgccttatccaacaatcatgaataccggatgcagcagcttgccctgcaaagcagcggacaggcgcttcgggcagcacagaacagccgctatcccaccgtttctgcccatgtcggctatcagaataacctctacacttcatctgcgcagaataatgactaccactatcggggcaaagggatgagcgtcggcgtacagttgaatttgccgctttataccggcggagaattgtcgggcaaaatccatgaagccgaagcgcaatacggggctgccgaagcacagctgaccgcaaccgagcggcacatcaaactcgccgtacgccaggcttataccgaaagcggtgcggcgcgttaccaaatcatggcgcaagaacgggttttggaaagcagccgtttgaaactgaaatcgaccgaaaccggccaacaatacggcatccgcaaccggctggaagtaatacgggcgcggcaggaagtcgcccaagcagaacagaaactggctcaagcacggtataaattcatgctggcttatttgcgcttggtgaaagagagcgggttagggttggaaacggtatttgcggaataa

SEQ ID NO: 3600 - protein, 467 aa, Neisseria meningitidis
MTLLNLMIMQDYGISVCLTLTPYLQHELFSAMKSYFSKYILPVSLFTLPLSLSPSVSAFTLPEAWRAAQQHSADFQASHYQRDAVRARQQQAKAAFLPHVSANASYQRQPPSISSTRETQGWSVQVGQTLFDAAKFAQYRQSRFDTQAAEQRFDAAREELLLKVAESYFNVLLSRDTVAAHAAEKEAYAQQVRQAQALFNKGAATALDIHEAKAGYDNALAQEIAVLAEKQTYENQLNDYTGLDSKQIEAIDTANLLARYLPKLERYSLDEWQRIALSNNHEYRMQQLALQSSGQALRAAQNSRYPTVSAHVGYQNNLYTSSAQNNDYHYRGKGMSVGVQLNLPLYTGGELSGKIHEAEAQYGAAEAQLTATERHIKLAVRQAYTESGAARYQIMAQERVLESSRLKLKSTETGQQYGIRNRLEVIRARQEVAQAEQKLAQARYKFMLAYLRLVKESGLGLETVFAE

SEQ ID NO: 3601 - DNA, 1428 bp, Neisseria meningitidis
atgtttttctccgccctgaaatcctttctttctcgatacattactgtatggcgcaatgtttgggcggtgcgcgaccagttgaaaccgcccaaacgcacggcggaagaacaggcgtttttgcccgcgcatttggaactgaccgatacgccggtctctgccgctccgaaatgggcggcgcgttttattatggcgtttgcgcttttggctttgttgtggtcctggttcggcaaaatcgatattgtggcggcggcttcgggcaaaacggtgtcgggcgggcgcagcaaaaccatccagccgctggaaacggcggtggttaaggcggtacatgtgcgcgacgggcagcatgtgaaacagggagaaacgctggcggaactggaggctgtgggaacagacagcgatgtggtgcagtcggagcaggctttgcaggctgcccaattgtccaaactgcgttatgaagcggtattggcggcattggaaagccgtaccgtgccgcatatcgatatggcgcaagcacggtctttaggtctctccgatgccgatgtgcaatcggcgcaggtgttggcgcagcaccagtatcaggcatgggcggcgcaggatgcgcaattgcagtcggctttgcgcggccatcaggcggaattgcagtcggccaaggcgcaggagcagaagctggtttcggtgggggcgatcgagcagcagaaaacagcagactaccgccgtttgcgggccgacaattttatttcggaacatgcgtttttggagcagcagagcaaatcggtcagcaattggaacgatttggaaagtacgcgcggtcagatgaggcagattcaggcggccattgcacaggcggagcagaatcgggtgctgaatacgcagaacctgaaacgcgatacgctggatgcgctgcgccaggcaaacgaacagattgaccaataccgcggccaaacggataaggcaaagcagcggcagcagctgatgacaatacagtcgcctgcggacggcacggtgcaggaattggctacctatacggtgggcggtgtggtgcaggctgcccaaaaaatgatggtgattgcgcccgatgacgacaaaatggacgtggaagttttggtattgaacaaagacatcggttttgtggaacagggacaggatgcggtggtgaagattgagagctttccctatacgcgctacggttatctgacgggcaaggtgaaaagtgtcagccatgatgcggtaagccacgaacagttgggcttggtttatacggcggtggtgtcgctggacaaacataccttgaatattgacggcaaagcagtgaatctgacggcgggcatgaatgtcacggcggagattaaaacgggtaaacggcgggtgctggattatctgttaagcccgctgcaaaccaaattggacgaaagctttagggagcgatag

SEQ ID NO: 3602 - protein, 475 aa, Neisseria meningitidis
MFFSALKSFLSRYITVWRNVWAVRDQLKPPKRTAEEQAFLPAHLELTDTPVSAAPKWAARFIMAFALLALLWSWFGKIDIVAAASGKTVSGGRSKTIQPLETAVVKAVHVRDGQHVKQGETLAELEAVGTDSDVVQSEQALQAAQLSKLRYEAVLAALESRTVPHIDMAQARSLGLSDADVQSAQVLAQHQYQAWAAQDAQLQSALRGHQAELQSAKAQEQKLVSVGAIEQQKTADYRRLRADNFISEHAFLEQQSKSVSNWNDLESTRGQMRQIQAAIAQAEQNRVLNTQNLKRDTLDALRQANEQIDQYRGQTDKAKQRQQLMTIQSPADGTVQELATYTVGGVVQAAQKMMVIAPDDDKMDVEVLVLNKDIGFVEQGQDAVVKIESFPYTRYGYLTGKVKSVSHDAVSHEQLGLVYTAVVSLDKHTLNIDGKAVNLTAGMNVTAEIKTGKRRVLDYLLSPLQTKLDESFRER

SEQ ID NO: 3603 - DNA, 1305 bp, Neisseria meningitidis
atgtttttctccgccctgaaatcctttctttcccgctacattaccgtatggcgcaatgtttgggcggtgcgcgaccagttggaaccgcccaaacgcacggcggaagaacaggcgtttttgcccgcgcatttggaactgaccgatacgccggtctctgccgctccgaaatgggcggcgcgttttattatggcgtttgcgcttttggctttgttgtggtcctggttcggcaaaatcgatattgtggcggcggcttcgggcaaaacggtgtcgggcgggcgcagcaaaaccatccagccgctggaaacggtggtggttaaggcggtacatgtgcgcgacgggcagcatgtgaaacagggagaaacgctggcggaactggaggctgtgggaacagacagcgatgtggtgcagtcggagcaggctttgcaggctgcccaattgtccaaactgcgttatgaagcggtattggcggcattggaaagccgtaccgtgccgcatatcgatatggcgcaagcacggtctttaggtctctccgatgccgatgtgcaatcggcgcaggtgttggcgcagcaccagtatcaggcatgggcggcgcaggatgcgcaattgcagtcggctttgcgcggccatcaggcggaattgcagtcggccaaggcgcaggagcagaagctggtttcggtgggggcgatcgagcagcagaaaacagcagactaccgccgtttgcgggccgacaattttatttcggaacatgcgtttttggagcagcagagcaaatcggtcagcaattggaacgatttggaaagtacgcgcggtcagatgaggcagattcaggcggccattgcacaggcggagcagaatcgggtgctgaatacgcagaacctgaaacgcgatacgctggatgcgctgcgccaggcaaacgaacagattgaccaataccgcggccaaacggataaggcaaagcagcggcagcagctgatgacaatacagtcgcctgcggacggcacggtgcaggaattggccacctatacggtgggcggtgtggtgcaggctgcccaaaaaatgatggtggttgcgcccgatgacgacaaaatggacgtggaagttttggtattgaacaaagacatcggttttgtggaacagggacaggatgcggtggtgaagattgagagttttccctatacgcgctacggttatctgacgggcaaggtgaaaagtgtcagccatgatgcggtaagccacgaacagttgggcttggtttatacggcggtggtgtcgctggacaaacataccttgaatattgacggcaaa

SEQ ID NO: 3604 - protein, 435 aa, Neisseria meningitidis
MFFSALKSFLSRYITVWRNVWAVRDQLEPPKRTAEEQAFLPAHLELTDTPVSAAPKWAARFIMAFALLALLWSWFGKIDIVAAASGKTVSGGRSKTIQPLETVVVKAVHVRDGQHVKQGETLAELEAVGTDSDVVQSEQALQAAQLSKLRYEAVLAALESRTVPHIDMAQARSLGLSDADVQSAQVLAQHQYQAWAAQDAQLQSALRGHQAELQSAKAQEQKLVSVGAIEQQKTADYRRLRADNFISEHAFLEQQSKSVSNWNDLESTRGQMRQIQAAIAQAEQNRVLNTQNLKRDTLDALRQANEQIDQYRGQTDKAKQRQQLMTIQSPADGTVQELATYTVGGVVQAAQKMMVVAPDDDKMDVEVLVLNKDIGFVEQGQDAVVKIESFPYTRYGYLTGKVKSVSHDAVSHEQLGLVYTAVVSLDKHTLNIDGK

SEQ ID NO: 3605 - DNA, 930 bp, Neisseria meningitidis
atgttaagatgccgtccgaaatccgttttggattcagacggcatttttttgaaatttaattttttaaggagtaaacctaaatatgaaatttccttccttccttcctttaaacggatactctgcctgtcggcagtaatctcggtattgggggcttgtgcggtcgttgctgatgtttacggtcatgattccgccacaatgaacgctgcggctgccaaagattatatgaaaacggttgagttaaacaagtctgccggcaatgtcgataccacatccagaacagcccgcagggtgcaggcagtatttcgacgtatgctgccttatgccgatgcggcaaataataccagccataagtttgactggaaaatgacggttttcaaaaacgatgagctgaacgcgtgggcaatgcccggtggaaaaatggcgttttatacggggatagtcgacaaactcaagctgaccgatgacgaaattgccgccattatggggcatgaaatgacgcacgccctgcatgaacacggtaaaaataaggtcgggcagcaaatcttgaccaatacggcggcgcagataggcacgcagattatattagacaaaaaaccggatactaatccggaattggtcggattgggtatggatattttggggacgtacggtcttaccttgccttatagccgcagcttggaagaagaagccgatgaggggggaatgatgttgatggcgcaggcaggctatcatccggcggccgctgtcagggtttgggaaaaaatgaatcaggaaaacgaccaaaacggctttatttatgctattacctctactcatccgacaaacaatgcccgtatagaaaatctaaaacggttgttgccgaccgttatgccggtttatgagcaaagtgtcagaaataaggggcgcgttaataaaaaacgtcggcgttaa

SEQ ID NO: 3606 - protein, 309 aa, Neisseria meningitidis
MLRCRPKSVLDSDGIFLKFNFLRSKPKYEISFLPSFKRILCLSAVISVLGACAVVADVYGHDSATMNAAAAKDYMKTVELNKSAGNVDTTSRTARRVQAVFRRMLPYADAANNTSHKFDWKMTVFKNDELNAWAMPGGKMAFYTGIVDKLKLTDDEIAAIMGHEMTHALHEHGKNKVGQQILTNTAAQIGTQIILDKKPDTNPELVGLGMDILGTYGLTLPYSRSLEEEADEGGMMLMAQAGYHPAAAVRVWEKMNQENDQNGFIYAITSTHPTNNARIENLKRLLPTVMPVYEQSVRNKGRVNKKRRR

SEQ ID NO: 3607 - DNA, 930 bp, Neisseria meningitidis
atgttaagatgccgtccgaaatccgttttggattcagacggcatttttttgaaatttaattttttaaggagtaaacctaaatatgaaatttccttccttccttcctttaaacggatactctgcctgtcggcagtaatctcggtattgggggcttgtacggtcgttgctgatgtttacggtcaggattccgccacaatgaatgctgcggctgccgaagattatatgaaaacggttgagttgaacaagtctgccggcaatgtcgatactacatccaaaacagcccgtagggtgcaggcagtatttcgacgtatgttgccttatgccgatgcggcaaataataccggccataagtttgactggaaaatgacggttttcaaaaacgatgagctgaacgcgtgggcaatgcccggcgggaaaatggcgttttatacggggatagtcgataaacttaagctgaccgatggcgaaattgccgccattatggggcatgaaatgacgcatgccctgcatgaacacggtaaaaataaggtcgggcagaaaatcttgactaatatggcggcgcagataggcacgcagattatattagacaaaaaaccggacactaatccggaattggtcggattgggtatggatattttggggatgtacggcattaccttgccttatagccgcagcttggaagaagaagccgatgaggggggaatgatgttgatggcgcaggcaggctatcatccggcagccgctgtcagggtttgggaaaaaatgaatcaggaaaacgaccaaaacggctttatttatgctattacctctactcatccgacaaacaatgcccgtatagaaaatctaaaacggttgttgccgaccgttatgccggtttatgagcacagtgttagaaataaggggcgcgttaataaaaaccgtcggcgttaa

SEQ ID NO: 3608 - protein, 309 aa, Neisseria meningitidis
MLRCRPKSVLDSDGIFLKFNFLRSKPKYEISFLPSFKRILCLSAVISVLGACTVVADVYGQDSATMNAAAAEDYMKTVELNKSAGNVDTTSKTARRVQAVFRRMLPYADAANNTGHKFDWKMTVFKNDELNAWAMPGGKMAFYTGIVDKLKLTDGEIAAIMGHEMTHALHEHGKNKVGQKILTNMAAQIGTQIILDKKPDTNPELVGLGMDILGMYGITLPYSRSLEEEADEGGMMLMAQAGYHPAAAVRVWEKMNQENDQNGFIYAITSTHPTNNARIENLKRLLPTVMPVYEHSVRNKGRVNKNRRR

SEQ ID NO: 3609 - DNA, 645 bp, Neisseria meningitidis
atgaagtttaaacatctgttgccgctgctgctgtcggcagtgttgtccgcgcaggcatatgccctgacggaaggggaagactatcttgtgttggataaacccattcctcaagaacagccgggaaaaattgaggttttggaatttttcggctatttttgcgtacattgccatcatttcgatcctttgttattgaaactgggcaaggcattgccgtctgatacttatctgcggacggagcacgtggtctggcggcctgaaatgctcggtctggcaagaatggctgctgcggtcaagctgtcgggtttgaaatatcaggcaaactctgctgtgtttaaagcagtttacgaacaaaaaatccgtttggaaaacagggctgttgccgggaaatgggctttatctcaaaaaggttttgacggcaaaaaactgatgcgcgcctatgattcccccgaagctgccgccgtcgcattaaaaatgcagaaactgacggaacaatacggtattgacagcacgccgaccgttattgtcggcggaaaataccgcgttatcttcaataatggctttgatggcggcgttcatacgattaaagaattggttgccaaagtcagggaagaacgcaagcgtcagacccctgctgtacagaaatag

SEQ ID NO: 3610 - protein, 214 aa, Neisseria meningitidis
MKFKHLLPLLLSAVLSAQAYALTEGEDYLVLDKPIPQEQPGKIEVLEFFGYFCVHCHHFDPLLLKLGKALPSDTYLRTEHVVWRPEMLGLARMAAAVKLSGLKYQANSAVFKAVYEQKIRLENRAVAGKWALSQKGFDGKKLMRAYDSPEAAAVALKMQKLTEQYGIDSTPTVIVGGKYRVIFNNGFDGGVHTIKELVAKVREERKRQTPAVQK

SEQ ID NO: 3611 - DNA, 645 bp, Neisseria meningitidis
atgaagctcaaacatctgttgccgctgctgctgtcggcagtgttgtccgcgcaggcatatgccctgacggaaggggaagactatcttgtgttggataaacccattcctcaagaacagtcgggtaaaattgaggttttggaatttttcggctatttctgcgtacattgccatcatttcgatcctttgttattgaaactgggcaaggcattgccgtctgatgcctatttgaggacggagcacgtggtctggcagcctgaaatgctcggtttggctaggatggcggctgccgtcaatttgtcgggtttgaaatatcaggcaaaccctgctgtgtttaaagcagtttacgaacaaaaaatccgcttggaaaacaggtcggttgccggaaaatgggctttgtctcaaaaaggctttgacggcaaaaaactgatgcgcgcctatgattcccccgaagctgccgccgccgcattaaaaatgcagaaactgacggaacaataccgcatcgacagcacgccgaccgttattgtcggcggaaaataccgcgttatcttcaataacggctttgacggcggcgttcatacgattaaagaattggttgccaaagtcagggaagaacgcaagcgtcagacccctgctgtacagaaatag

SEQ ID NO: 3612 - protein, 214 aa, Neisseria meningitidis
MKLKHLLPLLLSAVLSAQAYALTEGEDYLVLDKPIPQEQSGKIEVLEFFGYFCVHCHHFDPLLLKLGKALPSDAYLRTEHVVWQPEMLGLARMAAAVNLSGLKYQANPAVFKAVYEQKIRLENRSVAGKWALSQKGFDGKKLMRAYDSPEAAAAALKMQKLTEQYRIDSTPTVIVGGKYRVIFNNGFDGGVHTIKELVAKVREERKRQTPAVQK

SEQ ID NO: 3613 - DNA, 645 bp, Neisseria meningitidis
atgaagctcaaacatctgttgccgctgctgctgtcggcagtgttgtccgcgcaggcatatgccctgacggaaggggaagactatcttgtgttggataaacccattcctcaaaaacagtcgggcaaaattgaggttttggaatttttcggctatttctgcgtacattgccatcatttcgatcctttgttattgaaattgggcaaggcattgccgtctgatgcctatttaaggacggagcacgtggtctggcagcctgaaatgctcggtctggcaagaatggctgctgcggtcaagctgtcaggtttgaaatatcaggcaaaccctgccgtgtttaaagcagtttacgaacaaaaaatccgcttggaaaacaggtcggttgccgaaaaatgggctttgtctcaaaaaggctttgacggcaaaaaactgatgcgcgcctacgactctcctgcggcagcggctgctgcatcaaaaatgcagcaattgacggaacagtaccgcatcgacagtacgccgaccgttgtcgtcggcggaaaataccgcgttatcttcaataatggctttgacggcggtgttcatacgattaaagaattggttgccaaagtcagggaagaacgcaagcgtcagacccctgctgtacagaaatag

SEQ ID NO: 3614 - protein, 214 aa, Neisseria meningitidis
MKLKHLLPLLLSAVLSAQAYALTEGEDYLVLDKPIPQKQSGKIEVLEFFGYFCVHCHHFDPLLLKLGKALPSDAYLRTEHVVWQPEMLGLARMAAAVKLSGLKYQANPAVFKAVYEQKIRLENRSVAEKWALSQKGFDGKKLMRAYDSPAAAAAASKMQQLTEQYRIDSTPTVVVGGKYRVIFNNGFDGGVHTIKELVAKVREERKRQTPAVQK

SEQ ID NO: 3615 - DNA, 360 bp, Neisseria meningitidis
atgaatatcaaacaattgattaccgccgcactcattgcctcagccgcctttgccacgcaggcagccccgcaaaaacccgtatccgccgcccaaaccgcgcaacattcagccgtttggatcgatgtccgttccgaacaggaatttagcgaaggtcatttgcacaacgcggtcaacatccccgtcgaccaaatcgtccgccgcatatacgaagccgcgcccgacaaagacacgccggtcaacctctactgccgcagcggacggcgtgccgaagccgcccttcaagagctgaaaaaagcaggttatacaaatgttgccaatcacggcggttatgaagacctgctcaaaaaagggatgaaatga

SEQ ID NO: 3616 - protein, 119 aa, Neisseria meningitidis
MNIKQLITAALIASAAFATQAAPQKPVSAAQTAQHSAVWIDVRSEQEFSEGHLHNAVNIPVDQIVRRIYEAAPDKDTPVNLYCRSGRRAEAALQELKKAGYTNVANHGGYEDLLKKGMK

SEQ ID NO: 3617 - DNA, 360 bp, Neisseria meningitidis
atgaatatcaaacacctgattaccgccgcactcattgcctcagccgcctttgccgcgcaggcagccccgcaaaaacccgtatccgccgcccaaaccgcgcaacatccggccgtttggatcgatgtccgttccgaacaggaatttagcgaagggcatttgcacaacgcggtcaacatccccgtcgaccaaatcgtccgccgcatacacgaagccgcgcccgacaaagacacgccggtcaacctctactgccgcagcggacggcgtgccgaagccgcccttcaagagctgaaaaaagcaggttatacaaatgttgccaatcacggcggttatgaagacctgctcaaaaaagggatgaaatga

SEQ ID NO: 3618 - protein, 119 aa, Neisseria meningitidis
MNIKHLITAALIASAAFAAQAAPQKPVSAAQTAQHPAVWIDVRSEQEFSEGHLHNAVNIPVDQIVRRIHEAAPDKDTPVNLYCRSGRRAEAALQELKKAGYTNVANHGGYEDLLKKGMK

SEQ ID NO: 3619 - DNA, 360 bp, Neisseria meningitidis
atgaatatcaaacacctgattaccgccgcactcattgcctcagccgcctttgccgcgcaggcagccccgcaaaaacccgtatccgccgcccaaaccgcgcaacattcagccgtttggatcgatgtccgcagcgaacaggaatttagcgaaggtcatttgcacaacgcggtcaacatccccgtcgaccaaatcgtccgccgcatacacgaagccgcgcccgacaaagacacgccggtcaacctctactgccgcagcggacggcgtgccgaagccgcccttcaagaactgaaaaaagcaggctatacgaatgttgccaatcacggcggttatgaagacctgctcaaaaaagggatgaaatga

SEQ ID NO: 3620 - protein, 119 aa, Neisseria meningitidis
MNIKHLITAALIASAAFAAQAAPQKPVSAAQTAQHSAVWIDVRSEQEFSEGHLHNAVNIPVDQIVRRIHEAAPDKDTPVNLYCRSGRRAEAALQELKKAGYTNVANHGGYEDLLKKGMK

SEQ ID NO: 3621 - DNA, 1476 bp, Neisseria meningitidis
ttgataatggttattttttatttttatttttgtgggaagacatttatgcctgcacgaaacagatggatgctgctgcctttattggcaagcgcggcatacgccgaagaaacaccgtgcgaaccggatttgagaagccgtcccgagttcaggcttcatgaagcggaggtcaaaccgatcgacagggagaaggtaccggggcaggtgcgggaaaaaggaaaagttttgcaggttgacggcgaaaccctgctgaaaaatcccgaattgttgtcgcgtgccatgtattccgcagtggtctcaaacaatattgccggtatccgcgtgattttgccgatttacctacaacaggcgcggcaggataagatgttggcactttatgcacaagggattttggcgcaggcagagggcagggtgaaggaggcggtttcccattaccgggaattgattgccgcccaacccgacgcgcccgccgtccgtatgcgtttggcggcggcattgtttgaagacaggcagaacgaggcggcggcagaccagttcgaccgcctgaaaacagaagatctgccgccgcagcttatggagcaggtcgagctgtaccgcaaggcattgcgcgaacgcgatgcgtggaaggtaaacggcggtttcagcgttacccgcgaacacaatatcaaccaagccccgaaacagcagcagtacggcaattggactttcccgaaacaggtggacggcacggcagtcaattaccggttcggcgcggagaaaaaatggtcgctgaaaaacggctggtacacgacggcgggcggcgacgtgtccggcagggtttatccggggaataagaaattcaacgatatgacggcaggtgtttccggcggcatcggttttgccgaccggcgtaaagatgtcgggctggcagtgttccacgaacgccgcacctacggcaacgacgcttattcttacgccaacggcgcacgcctttatttcaaccgttggcaaaccccgagatggcaaacgctgtcttcggcggagtgggggcgtttgaagaatacgcgccgggcgcgttccgacaatacccatttgcaaatttccaattcgctggtgttttaccggaatgcgcgccaatattggacgggcggtttggatttttaccgcgagcgcaaccccgccgaccgtggcgacaatttcaaccgttacggcctgcgctttgcctgggggcaggaatggggcggcagcggcctgtcttcgctgttccgcctcggcgtggcgaaacggcattatgaaaaacccggcttcttcagcagttttaaaggggaaaggcgcagggataaagaatcggacacatccttgagcctttggcaccgggcattgcatttcaaaggcatcacgccgcgcctgacgctgtcgcaccgcgaaacgtggagcaacgatgtgtttaacgaatacgagaaaaacagggcgtttgtcgagtttaacaaaacgttctga

SEQ ID NO: 3622 - protein, 491 aa, Neisseria meningitidis
LIMVIFYFYFCGKTFMPARNRWMLLPLLASAAYAEETPCEPDLRSRPEFRLHEAEVKPIDREKVPGQVREKGKVLQVDGETLLKNPELLSRAMYSAVVSNNIAGIRVILPIYLQQARQDKMLALYAQGILAQAEGRVKEAVSHYRELIAAQPDAPAVRMRLAAALFEDRQNEAAADQFDRLKTEDLPPQLMEQVELYRKALRERDAWKVNGGFSVTREHNINQAPKQQQYGNWTFPKQVDGTAVNYRFGAEKKWSLKNGWYTTAGGDVSGRVYPGNKKFNDMTAGVSGGIGFADRRKDVGLAVFHERRTYGNDAYSYANGARLYFNRWQTPRWQTLSSAEWGRLKNTRRARSDNTHLQISNSLVFYRNARQYWTGGLDFYRERNPADRGDNFNRYGLRFAWGQEWGGSGLSSLFRLGVAKRHYEKPGFFSSFKGERRRDKESDTSLSLWHRALHFKGITPRLTLSHRETWSNDVFNEYEKNRAFVEFNKTF

SEQ ID NO: 3623 - DNA, 1473 bp, Neisseria meningitidis
ttgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcagcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 3624 - protein, 490 aa, Neisseria meningitidis
LIMVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIAAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 3625 - DNA, 1473 bp, Neisseria meningitidis
ttgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccaatcgacagggagaaggtaccggggcaggtgcgggaaaaaggaaaagttttgcagattgacggcgaaaccctgctgaaaaatcccgaattgctgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgtcgcccaacccgacgcgcccgccgtccgtatgcgtttggcggcggcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgttacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 3626 - protein, 490 aa, Neisseria meningitidis
LIMVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIVAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 3627 - DNA, 561 bp, Neisseria meningitidis
atgaacagactgctactgctgtctgccgccgtcctgccgactgcctgcggcagcggcgaaaccgataaaatcggacgggcaagtaccgttttcaacatgttgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaagcgcggtacgggcttcgcgttcaagagccggcagattgtccgttattacgaccccaaacgcaaagccttcgcctatttggtttacagcgataaaatcgtccaaggatcgccgaaaaattccttaagcgcggtttcctgtttcggcagcggcataccgcaaaccgacggggtgcaagccgatacttccggcaaactgcttgccggcgcctgcattatttccaacccgataaaaaatcccgacaaacgctga

SEQ ID NO: 3628 - protein, 186 aa, Neisseria meningitidis
MNRLLLLSAAVLPTACGSGETDKIGRASTVFNMLGKNDRIEVEGFDDPDVQGVACYISYAKKGGLKEMVNLEEDASDASVSCVQTASSISFDETAVRKPKEVFKRGTGFAFKSRQIVRYYDPKRKAFAYLVYSDKIVQGSPKNSLSAVSCFGSGIPQTDGVQADTSGKLLAGACIISNPIKNPDKR

SEQ ID NO: 3629 - DNA, 561 bp, Neisseria meningitidis
atgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatctcgacaaacgctga

SEQ ID NO: 3630 - protein, 186 aa, Neisseria meningitidis
MNRLLLLSAAVLLTACGSGETDKIGRASTVFNILGKNDRIEVEGFDDPDVQGVACYISYAKKGGLKEMVNLEEDASDASVSCVQTASSISFDETAVRKPKEVFKHGASFAFKSRQIVRYYDPKRKTFAYLVYSDKIIQGSPKNSLSAVSCFGGGIPQTDGVQADTSGNLLAGACMISNPIENLDKR

SEQ ID NO: 3631 - DNA, 561 bp, Neisseria meningitidis
atgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatcccgacaaacgctga

SEQ ID NO: 3632 - protein, 186 aa, Neisseria meningitidis
MNRLLLLSAAVLLTACGSGETDKIGRASTVFNILGKNDRIEVEGFDDPDVQGVACYISYAKKGGLKEMVNLEEDASDASVSCVQTASSISFDETAVRKPKEVFKHGASFAFKSRQIVRYYDPKRKTFAYLVYSDKIIQGSPKNSLSAVSCFGGGIPQTDGVQADTSGNLLAGACMISNPIENPDKR

SEQ ID NO: 3633 - DNA, 2103 bp, Neisseria meningitidis
atggatttattatcggttttccacaaataccgtctgaaatatgcggtggcggtgctgacgatgctgcttttggcggcagtcgggctgcacgcttccgtatatcgcaccttcacgcccgaaaacatccgcagccgcctccaacaaagcattgcccatacccaccggaaaatctcgtttgatgcggatatacggcgcaggcttctgccccgcccgaccgtcatcctgaaaaacctgaccattaccgaacccgacggcggccgggtcgccgtttccgtcaaagaaaccaaaatcggattgagctggaaaaacctgtggtcggatcggatacaggttgaaaaatgggtggtttcgggtgcggatcttgccctgacgcgcgacagaaacggcgcttggaacatccaagacctgttcgacggcgcgaaacactccgcctcagtcaaccgcattatcgtcgaaaacagcaccgtccgcctcaatttcctgcagcaacagcttatcctgaaggaaatcagcctcaacctgcaatcccccgattcgtcggggcagcagtttgaaagttcgggcatactggtttggagaaagctgtccgtcccgtggaaaagcagggggctgttcctttcagacggcatcggcacgcccgaaatctcaccgttccattttgaagcttccacttcgctggacggacacggcatcaccatttccaccaccggcagcccttctgtccgcttcaacgccggcggagcggatgccgccggcctcggcctgcgtgcagacacttccttccgcaacctccacctgaccgcgcaaatccccgcactggcactcaaaaacaacagcatcaaaaccggcacggtcaacggcacgtttaccgccggcggcgaatatgcccgatgggacggttcgttcaaactcgacaaagccaacctgcactccggcatcgccaacatcggcaacgccgaaatctccggcagcttcaaaacaccgcgccttcaaaccaatttctccctcggctcgccgttggtttggagtcgggacaacgggctggacgccccgcgcctgcacatatcgacccttcaggataccgtcgaccgcctgccgcaaccccgtttcatcagccggctcgacggttcgctgtccataccgaatctgcaaaattggaatgccgaattaaacggcacattcgaccgccaacccgttgccgcaaaattcaaatatacgcgggaaggcgcaccgcacctggaagccgccgccgcgctgcaaaaattaaacctcgccccctatcttgacgaatttcggcaacaaaacggcaaaatattccccgacatcctcggcaggctgtccggcaacgtcgaggcacacctcaaaatcggcagcatccaactccccggcttgcaactggacgatatggaaacctacctccacgccgacaaagaccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgatgcggtcatcgacctgaccgcaagcggcgaaaaccgcaaacagcttatccgctcgctgcaaggcagcctgtcgctgaatatttccaacggcgcgtggcacggcatcgatatggacagcattttaaaaaacggcctttccgggaaaatctcgggcagcacacccttctaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggtacggtggacaagccgtccattaccgtcgattacggcaggctgaccggcggcatcaattcgcgcaaagagaaacagaaaatcctcgaagacaccctgctggaacaatggcagtggctcaaacctaaagaaccgtaa

SEQ ID NO: 3634 - protein, 700 aa, Neisseria meningitidis
MDLLSVFHKYRLKYAVAVLTMLLLAAVGLHASVYRTFTPENIRSRLQQSIAHTHRKISFDADIRRRLLPRPTVILKNLTITEPDGGRVAVSVKETKIGLSWKNLWSDRIQVEKWVVSGADLALTRDRNGAWNIQDLFDGAKHSASVNRIIVENSTVRLNFLQQQLILKEISLNLQSPDSSGQQFESSGILVWRKLSVPWKSRGLFLSDGIGTPEISPFHFEASTSLDGHGITISTTGSPSVRFNAGGADAAGLGLRADTSFRNLHLTAQIPALALKNNSIKTGTVNGTFTAGGEYARWDGSFKLDKANLHSGIANIGNAEISGSFKTPRLQTNFSLGSPLVWSRDNGLDAPRLHISTLQDTVDRLPQPRFISRLDGSLSIPNLQNWNAELNGTFDRQPVAAKFKYTREGAPHLEAAAALQKLNLAPYLDEFRQQNGKIFPDILGRLSGNVEAHLKIGSIQLPGLQLDDMETYLHADKDHIALSRFKSGLYGGHTEGGISIANTRPATYRLQQNASNIQIQPLLQDLFGFHSFSGNGDAVIDLTASGENRKQLIRSLQGSLSLNISNGAWHGIDMDSILKNGLSGKISGSTPFYRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 3635 - DNA, 2114 bp, Neisseria meningitidis
atggatttattatcggttttccacaaataccgtctgaaatatgcggtggccgtgctgacgatactgcttttggcggcagtcgggctgcacgcttccgtatatcgcaccttcacgcctgaaaacatccgcagccgcctacaacaaagcattgcacacacacaccggaaaatctcgtttgatgcggacattcagcgcaggctcctgccccggccgaccgtcatcctgaaaaacctgaccattaccgaacccggcggcgaccagactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcaaacggcatcggcccgcccgaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccccgcgctggcactcaggaacaacagcattaaaattgaaaccgtcaacggcgcatttaccgccggcggcgaatatgcccgatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggcacggtggacaaaccgtccattaccgtcgattacggcaggctgaccggcggcatcaattcgcgcaaagagaaacagaaaatcctcgaagacaccctgctggaacaatggcagtggctcaaacctaaagaaccgta

SEQ ID NO: 3636 - protein, 704 aa, Neisseria meningitidis
MDLLSVFHKYRLKYAVAVLTILLLAAVGLHASVYRTFTPENIRSRLQQSIAHTHRKISFDADIQRRLLPRPTVILKNLTITEPGGDQTAVSVQETKIGLSWKNLWSDQIQIEKWVVSSAELALTRDGKGVWNIQDLIDSQKRQASVNRIIVENSTVRLNFLQEQLILKEINLNLQSPDSSGQPFESSGILVWGKLSVPWKSRGLFLSNGIGPPEISPFHFEASTSLDGHGITISTTGSPSVRFNAGGADAAGLGLRADTSFRNLHLTAQIPALALRNNSIKIETVNGAFTAGGEYARWDGSFKLDKANLHSGIANIGNAEISGSFKTPRHQTNFSLNSPLVWTENKGLDAPRLYVSTLQDTVNRLPQPRFISRLDGSLSVPNLQNWNAELNGTFDRQTVAAKFRYTHEDAPHLEAAVALQKLNLTPYLDDVRQQNGKIFPDTLAKLSGDIEAHLKIGKVQLPGLQLDDMETYLHADKGHIALSRFKSGLYGGHTEGGISIANTRPATYRLQQNASNIQIQPLLQDLFGFHSFSGNGDAVIDLTAGGETRKELIRSLQGSLSLNISNGAWHGIDMDNILKNGISGKTADNAAPSTPFHRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 3637 - DNA, 2115 bp, Neisseria meningitidis
atggatttattatcggtcttccacaaataccgtctgaaatatgcggtagccgtgctgacgatactgcttttggcggcaatcgggctgcacgcttccgtatatcgcatcttcacacctgaaaacatccgaagccgcctccaacaaagcattgcccatacgcaccggaaaatctcgtttgatgcggatatacagcgcaggcttctgccccggccgaccgtcatcctgaaaaacctgaccattaccgaacccggcggcgaccggactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcagacggcatcggcacgcccaaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccctacgctggcactcaggaacaacagcattaaaattgaaaccgtcaacggcgcatttaccgccggcggcgaatatgcccaatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggtacggtggacaaaccgtccattaccgtcgattacggcaggctgaccggcggcatcaattcgcgcaaagagaaacagaaaatcctcgaagacaccctgctggaacaatggcagtggctcaaacctaaagaaccgtaa

SEQ ID NO: 3638 - protein, 704 aa, Neisseria meningitidis
MDLLSVFHKYRLKYAVAVLTILLLAAIGLHASVYRIFTPENIRSRLQQSIAHTHRKISFDADIQRRLLPRPTVILKNLTITEPGGDRTAVSVQETKIGLSWKNLWSDQIQIEKWVVSSAELALTRDGKGVWNIQDLIDSQKRQASVNRIIVENSTVRLNFLQEQLILKEINLNLQSPDSSGQPFESSGILVWGKLSVPWKSRGLFLSDGIGTPKISPFHFEASTSLDGHGITISTTGSPSVRFNAGGADAAGLGLRADTSFRNLHLTAQIPTLALRNNSIKIETVNGAFTAGGEYAQWDGSFKLDKANLHSGIANIGNAEISGSFKTPRHQTNFSLNSPLVWTENKGLDAPRLYVSTLQDTVNRLPQPRFISRLDGSLSVPNLQNWNAELNGTFDRQTVAAKFRYTHEDAPHLEAAVALQKLNLTPYLDDVRQQNGKIFPDTLAKLSGDIEAHLKIGKVQLPGLQLDDMETYLHADKGHIALSRFKSGLYGGHTEGGISIANTRPATYRLQQNASNIQIQPLLQDLFGFHSFSGNGDAVIDLTAGGETRKELIRSLQGSLSLNISNGAWHGIDMDNILKNGISGKTADNAAPSTPFHRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 3639 - DNA, 897 bp, Neisseria meningitidis
gtgttcggcacggtcttgcggactgatgccgactgcctgcaaatcatcgtcgtcggcaagttctttcaggttgttgcgtatggttttgcggcgttggcggaaggcgagtttcaccagtttggcgaaatgatcgaaatcgtccgccttgccgatacggtgtttcaccggaatcatgcgcaccactgcggaatcgattttcggcgcgggatcgaacgattcgggcggcacgtcaatcagcagctccatatcgaaaaaatattgcagcatcacacccaagcgaccgtagtcgttgcttttcggcgcggcaaccatgcgctcgaccacttctttttgcaacataaagtgcatatcggcgacatcgtccgccacctccgccagtttgaacaaaagcggcgtggagatgttatacggcaggttgccgacgattttctttttgcctgagatgccgttgaaatcaaactgcaacacgtcgccttcgtgaatcaccagtttatccgcaaacggcagcgttttcagacggcatacgatgtcgcggtcgatttcgacaacgtgcaggcggttcagctttttcgccaaaggttcggtaattgccgccaaacccgggccgatttcaatcacgacatcatccgcctgcgggcgcacggcgttgacaatatcgccgataatccgcgtgtcctgcaaaaaattctgcccgaaacgcttgcgggctttgtgttctttcatcgtgtttcctcttcggttgaaaccccgccctttagggcggcaggatcagactctgtttgggcggggcgtaaccccttccaaatcaggacgacacatagggcggtgctttatgtgtcgtcctgtgtgttggaacataaatgtgtttacagtatccgtttgatgtcggcattgtaa

SEQ ID NO: 3640 - protein, 297 aa, Neisseria meningitidis
VFGTVLRTDADCLQIIVVGKFFQVVAYGFAALAEGEFHQFGEMIEIVRLADTVFHRNHAHHCGIDFRRGIERFGRHVNQQLHIEKILQHHTQATVVVAFRRGNHALDHFFLQHKVHIGDIVRHLRQFEQKRRGDVIRQVADDFLFADAVEIKLQHVAFVNHQFIRKRQRFQTAYDVAVDFDNVQAVQLFRQRFGNCRQTRADFNHDIIRLRAHGVDNIADNPRVLQKILPETLAGFVFFHRVSSSVETPPFRAAGSDSVWAGRNPFQIRTTHRAVLYVSSCVLEHKCVYSIRLMSAL

SEQ ID NO: 3641 - DNA, 897 bp, Neisseria meningitidis
atgttcggcgcggtcttgcggattgatgccgactgcctgcaaatcatcgtcgcctgcaagctctttcagattgttgcgtatggttttgcggcgttggtggaaggcgagtttcacgagtttggcaaaatgctcgaaatcgtccgccttgccgatgcggtgtttcaccggaatcatacggacgacggcggaatccactttcggcgcagggtcgaacgattcgggcggtacgtcaatcagcatttccatatcgaaaaaatattgcagcatcacgcccaagcggccgtagtcgttgcttttcggcgcggcaaccatacgctcgaccacttctttttgcagcataaagtgcatatcgacgacatcgtccgccacctccgccagcttgaacaaaagcggtgtggaaatgttgtacgggaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccgggccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactctttccaaatcaggatggcacatagggcggtgctttatgtgtcgtcctgtgtgttgaaacataaatgtgtttacagtatccgtttgatgtcggcattgtaa

SEQ ID NO: 3642 - protein, 298 aa, Neisseria meningitidis
MFGAVLRIDADCLQIIVACKLFQIVAYGFAALVEGEFHEFGKMLEIVRLADAVFHRNHTDDGGIHFRRRVERFGRYVNQHFHIEKILQHHAQAAVVVAFRRGNHTLDHFFLQHKVHIDDIVRHLRQLEQKRCGNVVREVADDFLFACDAVEIKLQYIAFVNHQFIRKRQRFQTAYDVAVDFDNVQAVQLFRQRFGNRRQTRADFNHDIIRLRAHGVDNIADNPRVLQKILPETLAGFVFFHRVSFSVETPPFRAVESDSIWEGRNSFQIRMAHRAVLYVSSCVLKHKCVYSIRLMSAL

SEQ ID NO: 3643 - DNA, 897 bp, Neisseria meningitidis
atgttcggcgcggtcttgcggattgatgccgactgcctgcaaatcatcgtcgcctgcaagctctttcagattgttgcgtatggttttgcggcgttggtggaaggcgagtttcacgagtttggcgaaatgctcgaaatcgtccgccttgccgatacggtgtttcaccggaatcatgcggacgacggccgaatccactttcggcgcggggtcgaacgattcgggcggcacgtcaatcagcatttccatatcgaagaaatattgcagcatcacgcccaagcggccgtagtcgttgcttttcggcgcggcaaccatacgatcgaccacttctttttgcagcataaagtgcatatcgacgacatcgtccgccacctccgccagcttgaacaaaagcggcgtggaaatgttgtagggcaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccggaccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactccttccaaatcaggacggcacatagggcggtgctttatgtgtcgtcctgtgtgttgaaacataaatgtgtttacagtatccgtttgatgtcggcattgtaa

SEQ ID NO: 3644 - protein, 298 aa, Neisseria meningitidis
MFGAVLRIDADCLQIIVACKLFQIVAYGFAALVEGEFHEFGEMLEIVRLADTVFHRNHADDGRIHFRRGVERFGRHVNQHFHIEEILQHHAQAAVVVAFRRGNHTIDHFFLQHKVHIDDIVRHLRQLEQKRRGNVVGQVADDFLFACDAVEIKLQYIAFVNHQFIRKRQRFQTAYDVAVDFDNVQAVQLFRQRFGNRRQTRTDFNHDIIRLRAHGVDNIADNPRVLQKILPETLAGFVFFHRVSFSVETPPFRAVESDSIWEGRNSFQIRTAHRAVLYVSSCVLKHKCVYSIRLMSAL

SEQ ID NO: 3645 - DNA, 783 bp, Neisseria meningitidis
atgggattgggtgcaacgacttttgtcggttcgggtgctataggcggaggtctgtgcagtaccgggattggctgtgcggccggtggacttattgcaacggcaggtatgaccggtggttatacacaggcctcagaaggaagccggcaattgtttggcacttaccagtccgattttggtaaaaaagttgtcctatctttgggtacaccaatagaatacgaatcgccgttagtatctgatgcgaaaaatctagccgtatggggattggaaacgctgattacgcgcaaattgggaaacttggcaacgggtgtgaaaacttccttgactccgaaaactgctgacgtacagcgaaatatcctgtcccaatccgaagtcggtatcaagtggggcaaggggattgaaggacagggaatgccttgggaggattatgtcggtaagggcttgtctgccaatgcaaggttacctaaaaattttaaaacatttgattattttgatcgtggtacaggcacggcaatcagtgccaaaactctggatacgcaaactacggcacgcctgtccaaacccgaacagctttacagtaccatgaaagggtacatcgataagacggcaaatttcaaaagttatgaattatcagaagtaccgttaagggcagacatgatcaaacagcgcgaaatccatctggccatacccgcacaaactaataaggagcaaagattgcagttgcaacgtgtggtagagtatggcaaaagtcaaaacattacagtcaaaattacggagatcgaataa

SEQ ID NO: 3646 - protein, 260 aa, Neisseria meningitidis
MGLGATTFVGSGAIGGGLCSTGIGCAAGGLIATAGMTGGYTQASEGSRQLFGTYQSDFGKKVVLSLGTPIEYESPLVSDAKNLAVWGLETLITRKLGNLATGVKTSLTPKTADVQRNILSQSEVGIKWGKGIEGQGMPWEDYVGKGLSANARLPKNFKTFDYFDRGTGTAISAKTLDTQTTARLSKPEQLYSTMKGYIDKTANFKSYELSEVPLRADMIKQREIHLAIPAQTNKEQRLQLQRVVEYGKSQNITVKITEIE

SEQ ID NO: 3647 - DNA, 714 bp, Neisseria meningitidis
atgaagaccaaattaccgctttttatcatttggctgtctgtgtctgcctcctgtgcttccgttttacccgttccggagggcagccgaaccgaaatgccgacacaggaaaatgcttcagacggcattccctatcccgttcccactctgcaagaccgtttggactatctggaaggcaaaatcgtccggctgtcgaacgaagtggaaatgttaaacgggaaagtcaaagcattggagcatacgaaaatacacccttccggcaggacatacgtccaaaaactcgacgaccgcaaattgaaagagcattacctcaataccgaaggcggcagcgcatccgcacataccgtcgaaaccgcacaaaacctctacaatcaggcactcaaacactatcaaaacggcaggttttctgccgcagccgccttgttgaagggggcggacggcggagacggcggcagcatcgcgcaacgcagtatgtacctgttgctgcaaagcagggcgcgtatggggaactgtgaatctgtcatcgaaatcggagggcgttacgccaaccgtttcaaagacagcccaaccgcgcccgaagtcatattcaaaatcggcgaatgccaatacaggcttcagcaaaaagacattgcaagggcgacttggcgcagcctgatacagacctatcccggcagcccggcggcaaaacgcgccgccgcagccgtacgcaaacgatag

SEQ ID NO: 3648 - protein, 237 aa, Neisseria meningitidis
MKTKLPLFIIWLSVSASCASVLPVPEGSRTEMPTQENASDGIPYPVPTLQDRLDYLEGKIVRLSNEVEMLNGKVKALEHTKIHPSGRTYVQKLDDRKLKEHYLNTEGGSASAHTVETAQNLYNQALKHYQNGRFSAAAALLKGADGGDGGSIAQRSMYLLLQSRARMGNCESVIEIGGRYANRFKDSPTAPEVIFKIGECQYRLQQKDIARATWRSLIQTYPGSPAAKRAAAAVRKR

SEQ ID NO: 3649 - DNA, 714 bp, Neisseria meningitidis
atgaagatcaaattaccgctttttatcatttggctgtctgtgtccgcctcctgtgcttccgtttcacccgttccggcaggcagccaaaccgaaatgtcgacacgggaaaatgcttcagacggcattccctatcccgttccgaccttgcaagaccgtttggactatctggaaggcaaaatcgtccggctgtcgaacgaagtggaaaccttaaacggcaaagtcaaagcactggaacacgcaaaaacacattcttccggcagggcatacgtccaaaaactcgacgaccgcaagttgaaagagcattacctcaataccgaaggcggcagcgcatccgcacatactgtcgaaaccgcacaaaacctctacaatcaggcactcaaacactataaaagcggcaagttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 3650 - protein, 237 aa, Neisseria meningitidis
MKIKLPLFIIWLSVSASCASVSPVPAGSQTEMSTRENASDGIPYPVPTLQDRLDYLEGKIVRLSNEVETLNGKVKALEHAKTHSSGRAYVQKLDDRKLKEHYLNTEGGSASAHTVETAQNLYNQALKHYKSGKFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 3651 - DNA, 717 bp, Neisseria meningitidis
atgaagaccaaattaccgctttttatcatttggctgtccgtatccgccgcctgttcttcccctgtttcccgcaatattcaggatatgcggctcgaaccgcaggcagaggcaggtagttcggacgctattccctatcccgttcccactctgcaagaccgtttggattatctggaaggcacactcgtccgcctgtcgaacgaagtggaaaccttaaacggcaaagtcaaagcactggagcatgcgaaaacacacccttccagcagggcatacgtccaaaaactcgacgaccgcaagttgaaagagcattacctcaataccgaaggcggcagcgcatccgcacataccgtcgaaaccgcacaaaacctctacaatcaggcactcaaacactataaaagcggcaggttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 3652 - protein, 238 aa, Neisseria meningitidis
MKTKLPLFIIWLSVSAACSSPVSRNIQDMRLEPQAEAGSSDAIPYPVPTLQDRLDYLEGTLVRLSNEVETLNGKVKALEHAKTHPSSRAYVQKLDDRKLKEHYLNTEGGSASAHTVETAQNLYNQALKHYKSGRFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 3653 - DNA, 1029 bp, Neisseria meningitidis
atggcaagaaggtcaaaaacatttgaagaagctgctgctgaggttgaggaacgtttcggtcatcgtggcattaagttggtcgagtttgagggtacagccaagccgtgtgtaatcaactgccctaaacatggaaaccaaacctgttcgaggtactccaatatgttcataggaagtagctggggttgcccctcttgtggtaatgagcaagctgcaaaagccggtatagcgacccttaggaagaatcacatagcgttagaaatgctgaaacaggctgtaacaggtatgaccaagcaagagcgcatcacgacgcaagcctacaatgagatgaccaaatccgtggcaggttcaaacagcatagtccttaacgatgtccaaggcgatacgaccatcaacaaccatcatacgcatacgcacaaccacagcgatgccgatggcaaagcactgtcgatgaggctcacaccccgtcctttgttgtcagaccgtcaggcggcggctttcgcccgtacaggcaaactcacgggcagtttcgacctgtttgcttcggtggtcgccccctcgcagtacacgtttgccgttgccatgcccgacacgtccatgtcgccggttatcgaaaagggagacttgctggtggtcgagccgcgtatgtgccctgcggacgaagacatcgcgctgattgaactgtccgacaagcggctggtcgtcgcgcaccttgttatcgatattgcgggcaggatgctgatttatcagacgggcaggccgtctgaagcctttgacctgcccgaaggcagcacgattttaggtgtggtgctggagtcaaaaaacggtttatgtccgccgcacaggcaagaaggcgtgttgattcggattaccgcccctgatgtgtggacggttggtatgatttccgcttccaaaacgtcgtgtacgcgcccgaccgcagcccggaaatcagccgtatgctttcttcgattttggcaggctacgcgtgggataccgaaaacccgttcgtggcgaaatccgaacaacgcctga

SEQ ID NO: 3654 - protein, 342 aa, Neisseria meningitidis
MARRSKTFEEAAAEVEERFGHRGIKLVEFEGTAKPCVINCPKHGNQTCSRYSNMFIGSSWGCPSCGNEQAAKAGIATLRKNHIALEMLKQAVTGMTKQERITTQAYNEMTKSVAGSNSIVLNDVQGDTTINNHHTHTHNHSDADGKALSMRLTPRPLLSDRQAAAFARTGKLTGSFDLFASVVAPSQYTFAVAMPDTSMSPVIEKGDLLVVEPRMCPADEDIALIELSDKRLVVAHLVIDIAGRMLIYQTGRPSEAFDLPEGSTILGVVLESKNGLCPPHRQEGVLIRITAPDVWTVGMISASKTSCTRPTAARKSAVCFLRFWQATRGIPKTRSWRNPNNA

SEQ ID NO: 3655 - DNA, 1029 bp, Neisseria meningitidis
atggcaagaaggtcaaaaacatttgaagaagctgctgctgaggttgaggaacgtttcggtcatcgtggcattaagttggtcgagtttgagggtacagccaagccgtgtgtaatcaactgccctaaacatggaaaccaaacctgttcgaggtactccaatatgttcataggaagtagctggggttgcccctcttgtggtaatgagcaagctgcaaaagccggtatagcgacccttaggaagaatcacatagcgttagaaatgctgaaacaggctgtaacaggtatgaccaagcaagagcgcatcacgacgcaagcctacaatgagatgaccaaatccgtggcaggttcaaacagcataatccttaacgatgtccaaggcgatacgaccatcaacaaccatcatacgcatacgcacaaccacagcgatgccgacggcaaagcactgtcgatgaggctcacaccccgtcctttgttgtcagaccgtcaggcggcggctttcgcccgtacaggcaaactcacgggcagtttcgacctgtttgcttcggtggtcgccccttcacaatatacgtttgccgttgccatgcccgacacgtccatgtcgccggttatcgaaaagggggatttgctggtggtcgagccgcgtatgcgccctgcggacgaagacatcgtactgattgaactgtccgacaagcggctggtcgtcgcgcaccttgttatcgatattgcgggcaggatgctgatttatcagacgggcaggccgtctgaagccctcgacctgcccgaaggcagcgtgattttaggtgtggtgctggagtcaaaaaacggtttatgtccgccgcacaggcaagaaggcgtgttgattcggattaccgcccctgatgtgtggacggttggtacgatttccgcttccaaaacgtcgtgtacgcgcccgaccgcagcccggaaatcagccgtatgctttcttcgattttggcaggctacgcgtgggataccgaaaacccgttcgtggcgaaatccgaacaacgcctgt

SEQ ID NO: 3656 - protein, 343 aa, Neisseria meningitidis
MARRSKTFEEAAAEVEERFGHRGIKLVEFEGTAKPCVINCPKHGNQTCSRYSNMFIGSSWGCPSCGNEQAAKAGIATLRKNHIALEMLKQAVTGMTKQERITTQAYNEMTKSVAGSNSIILNDVQGDTTINNHHTHTHNHSDADGKALSMRLTPRPLLSDRQAAAFARTGKLTGSFDLFASVVAPSQYTFAVAMPDTSMSPVIEKGDLLVVEPRMRPADEDIVLIELSDKRLVVAHLVIDIAGRMLIYQTGRPSEALDLPEGSVILGVVLESKNGLCPPHRQEGVLIRITAPDVWTVGTISASKTSCTRPTAARKSAVCFLRFWQATRGIPKTRSWRNPNNAC

SEQ ID NO: 3657 - DNA, 2418 bp, Neisseria meningitidis
atggtaaattattattcagctatgattaaaaagattttaactacttgttttggtttgttttttggtttttgtgtatttggagtgggtctggttgccattgctattttggtaacgtatccgaaactgccgtctttggattctttgcagcattaccagcctaaaatgccgttgactatttattcggcggatggagaagtcatcggtatgtatggggagcagcggcgcgaatttacaaaaatcggcgatttccccgaggtgttgcggaatgcggttattgccgccgaggataaacgcttttaccggcattggggggtggatgtttggggtgttgcccgcgctgccgtcggcaatgtcgtgtccggcagcgtgcagtcgggtgcgagtacgattacacagcaggtggcgaaaaatttttatttgagcagtgaaaaaacgttcacacgcaaattcaatgaggtgttgcttgcctataaaatcgagcagtctttaagcaaagacaaaatccttgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccggagcgtgccaagttgcgccagaagtatattttgaacaatatgctcgaggagaagatgattaccgtgcaacagcgcgatcaggcattgaatgaggaactgcattatgagcggtttgttcggaaaatcgatcagagtgctttatatgtggcggaaatggtgcgtcgggaactgtatgagaaatatggtgaagatgcctatacgcagggttttaaggtttataccacggtccgcaccgatcatcagaaggcggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgttactaaaaagaaaaatgtcgtcatacagctgcccggcggcaggcgggttgcgcttgacaggcgcgccttgggttttgcggcccgagcggtcgataatgagaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggccgtccgagctgccggcaagcctgtctatggctttaggtacgggcgagacgacgccgttgaaagtggcggaggcatatagtgtatttgcgaacggcggatatagggtttcttcgcacgtgatcgataagatttatgacagagacggcaggttgcgcgcccaaatgcaacctttggtggcagggcaaaatgcgcctcaggcaatcgatccgcgcaatgcctatattatgtataagattatgcaggatgtggtccgtgtcggtacggcaaggggggcagctgcgttgggaagaacggatattgccggtaaaacgggtacgaccaacgacaataaagatgcgtggtttgtcggttttaaccctgatgtggttactgccgtatatatcggcttcgacaaacctaagagtatggggcgtgccggctacggcggtacgattgcggtgccggtttgggtggactatatgcgttttgcgttgaaaggaaagcagggcaaagggatgaaaatgcctgaaggtgtggtcagcagcaatggcgaatactatatgaaggaacgtatggtaaccgatccgggcttgatgctggacaacagcggtattgcgccgcaaccttcccgacgggcaaaagaagatgatgaagcggcagtagaaaacgaacagcagggaaggtctgacgaaacgcgtcaggacgtacaggaaacgccggtgcttccgagcaatacggattccaaacagcagcagttggattccctgttttaa

SEQ ID NO: 3658 - protein, 805 aa, Neisseria meningitidis
MVNYYSAMIKKILTTCFGLFFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRRELYEKYGEDAYTQGFKVYTTVRTDHQKAATEALRKALRNFDRGSSYRGAENYIDLSKSEDVEETVSQYLSGLYTVDKMVPAVVLDVTKKKNVVIQLPGGRRVALDRRALGFAARAVDNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRPSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRAGYGGTIAVPVWVDYMRFALKGKQGKGMKMPEGVVSSNGEYYMKERMVTDPGLMLDNSGIAPQPSRRAKEDDEAAVENEQQGRSDETRQDVQETPVLPSNTDSKQQQLDSLF

SEQ ID NO: 3659 - DNA, 2418 bp, Neisseria meningitidis
atggtaaattattattcagctatgattaaaaagattttaacgacttgttttggtttggtttttgggttttgtgtatttggagtgggtttggttgccattgctattttggtaacgtatccgaaactgccgtctttggattctttgcagcattaccagcctaaaatgccgttgactatttattcggcggatggggaagtcatcggtatgtatggggagcagcggcgcgaatttacaaaaatcggcgatttcccagaggtgttgcggaatgcggttatcgccgccgaggataaacgcttttaccggcattggggggtggatgtttggggtgttgcccgcgctgccgtcggcaatgtcgtgtccggcagcgtgcagtcgggtgcgagtacgattacgcagcaggtggcgaaaaatttttatttgagcagtgaaaaaacgttcacacgcaaattcaatgaggtgttgcttgcctataaaatcgagcagtctttaagcaaagacaaaatcctcgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccagaacgtgccaagttgcgccagaagtatattttgaacaatatgctcgaggagaagatgattaccgtgcaacagcgcgatcaggcgttgaatgaggaactgcattacgagcggtttgttcggaaaatcgatcagagtgcgttatatgtggcggaaatggtgcgtcaggaactgtatgagaaatacggtgaagatgcctatacgcagggttttaaggtttataccacggtccgcgccgatcatcagaaggtggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgtgactaaaaagaaaaatgtcgtcatacagctgcccggcggcaggcgggttacgcttgacaggcgcgccttgggttttgcggcccgcgcggtcaataatgaaaaaatgggggaggaccgtatccgcaggggcgcggtcatccgtgtcaaaaacaacggcgggcgttgggcggtggttcaagagccgttgctgcagggggctttgggttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggtcgtccgagctgccggcaagcctgtctatggctttaggtacgggcgagacaacgccgttgaaagtggcggaggcatatagcgtatttgcgaacggcggatatagggtttcttcgcacgtaatcgataagatttatgacagagacggcaggttgcgcgcccaaatgcaacctttggtggctgggcaaaatgcgcctcaggcaatcgatccgcgcaatgcctatattatgtataagattatgcaggatgtggtccgtgttggtacggcaaggggggcagctgcgttgggaagaacggatattgccggtaaaacgggtacgaccaatgacaataaggatgcgtggtttgtcggttttaaccctgatgtggttactgccgtatatatcggcttcgacaaacctaagagtatggggcgtgtcggctacggcggtacgattgcggtgccggtttgggtggactatatgcgttttgcgttgaaaggaaagcagggcaaggggatgaaaatgcctgaaggtgtggtcagcagcaatggcgaatactatatgaaggaacgtatggtaaccgatccgggcttgacgctggacaacagcggtattgcgccgcaaccttcccgacgggcaaaagaagatgacgggggcgcggcagaaggcggacggcaggcggcggatgacgaagtccgccaagatatgcaggaaacgccggtgcttccgagtaatactggttccaaacagcagcagttggattctctgttttaa

SEQ ID NO: 3660 - protein, 805 aa, Neisseria meningitidis
MVNYYSAMIKKILTTCFGLVFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRQELYEKYGEDAYTQGFKVYTTVRADHQKVATEALRKALRNFDRGSSYRGAENYIDLSKSEDVEETVSQYLSGLYTVDKMVPAVVLDVTKKKNVVIQLPGGRRVTLDRRALGFAARAVNNEKMGEDRIRRGAVIRVKNNGGRWAVVQEPLLQGALGSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRSSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRVGYGGTIAVPVWVDYMRFALKGKQGKGMKMPEGVVSSNGEYYMKERMVTDPGLTLDNSGIAPQPSRRAKEDDGGAAEGGRQAADDEVRQDMQETPVLPSNTGSKQQQLDSLF

SEQ ID NO: 3661 - DNA, 2418 bp, Neisseria meningitidis
atggtaaattattattcagctatgattaaaaagattttaacgacttgttttggtttggtttttgggttttgtgtatttggagtgggtttggttgccattgctattttggtaacgtatccgaaactgccgtctttggattctttgcagcattaccagcctaaaatgccgttgactatttattcggcggatggggaagtcatcggtatgtatggggagcagcggcgcgaatttacaaaaatcggcgatttcccagaggtgttgcggaatgcggttatcgccgccgaggataaacgcttttaccggcattggggggtggatgtttggggtgttgcccgcgctgccgtcggcaatgtcgtgtccggcagcgtgcagtcgggtgcgagtacgattacgcagcaggtggcgaaaaatttttatttgagcagtgaaaaaacgttcacacgcaaattcaatgaggtgttgcttgcctataaaatcgagcagtctttaagcaaagacaaaatcctcgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccagaacgtgccaagttgcgccagaagtatattttgaacaatatgctcgaggagaagatgattaccgtgcaacagcgcgatcaggcgttgaatgaggaactgcattacgagcggtttgttcggaaaatcgatcagagtgctttatatgtggcggaaatggtgcgtcaggaactgtatgagaaatacggtgaagatgcctatacgcagggttttaaggtttataccacggtccgcgccgatcatcagaaggtggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgtgactaaaaagaaaaatgtcgtcatacagctgcccggcggcaggcgggttacgcttgacaggcgcgccttgggttttgcggcccgcgcggtcaataatgaaaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggtcgtccgagctgccggcaagcctgtctatggctttaggtacgggcgagacaacgccgttgaaagtggcggaggcatatagcgtatttgcgaacggcggatatagggtttcttcgcacgtaatcgataagatttatgacagagacggcaggttgcgcgcccaaatgcaacctttggtggccgggcaaaatgcgcctcaggcaatcgatccgcgcaatgcctatattatgtataagattatgcaggatgtggtccgtgttggtacggcaaggggggcagctgcgttgggaagaacggatattgccggtaaaacgggtacgaccaatgacaataaggatgcgtggtttgtcggttttaaccctgatgtggttactgccgtatatatcggcttcgacaaacctaagagtatggggcgtgtcggctacggcggtacgattgcggtgccggtttgggtggactatatgcgttttgcgttgaaaggaaagcagggcaaggggatgaaaatgcctgaaggtgtggtcagcagcaatggcgaatactatatgaaggaacgtatggtaaccgatccgggcttgacgctggacaacagcggtattgcgccgcaaccttcccgacgggcaaaagaagatgacgggggcgcggcagaaggcggacggcaggcggcggatgacgaagtccgccaagatatgcaggaaacgccggtgcttccgagtaatactggttccaaacagcagcagttggattctctgttttaa

SEQ ID NO: 3662 - protein, 805 aa, Neisseria meningitidis
MVNYYSAMIKKILTTCFGLVFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRQELYEKYGEDAYTQGFKVYTTVRADHQKVATEALRKALRNFDRGSSYRGAENYIDLSKSEDVEETVSQYLSGLYTVDKMVPAVVLDVTKKKNVVIQLPGGRRVTLDRRALGFAARAVNNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRSSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRVGYGGTIAVPVWVDYMRFALKGKQGKGMKMPEGVVSSNGEYYMKERMVTDPGLTLDNSGIAPQPSRRAKEDDGGAAEGGRQAADDEVRQDMQETPVLPSNTGSKQQQLDSLF

SEQ ID NO: 3663 - DNA, 768 bp, Neisseria meningitidis
atgttccgcatcgtcaaatggctgattgccctgcccgtcggcatctttatctttttcaatgcctatgtgtacggcaacatcatcacctaccgcgccgtcgcgccccatcggactgcctttatgtcgatgcggatgaagcagtttgaacaagaaggtcgcgatgtcgcactggattaccgctgggtgccctacaaccgcatttccaccaacctgaaaaaagccctgattgcttccgaagatgtccgttttgccggacacgggggcttcgatggggacggcattcaaaacgccatcaggcgcaaccggaacagcggcgaagtgaaggcgggcggatcgaccatcagccagcagcttgccaaaaacctcttcctcaacgaaagccgcaactatctgcgcaaaggggaagaggcggccattacggcaatgatggaagctgttaccgacaaaaacaggattttcgaactgtatttaaactcaatcgaatggcactacggcgttttcggcgcggaagctgcgtcccggtatttttataaaaaaccggccgcagacctgaccaaacagcaggcggcgaaactgacggtactcgtccccgccccgttttactactctgaccatccaaaaagcaaacggctgcgcaacaaaaccaatatcgtgctcagacgcatgggttcggcaaattaccccaaagcgaaacggactgattgttccagatatggaaatgccgcctgaactggggttcgaacggcatatgttttctgggacttataa

SEQ ID NO: 3664 - protein, 254 aa, Neisseria meningitidis
MFRIVKWLIALPVGIFIFFNAYVYGNIITYRAVAPHRTAFMSMRMKQFEQEGRDVALDYRWVPYNRISTNLKKALIASEDVRFAGHGGFDGDGIQNAIRRNRNSGEVKAGGSTISQQLAKNLFLNESRNYLRKGEEAAITAMMEAVTDKNRIFELYLNSIEWHYGVFGAEAASRYFYKKPAADLTKQQAAKLTVLVPAPFYYSDHPKSKRLRNKTNIVLRRMGSANYPKAKRTDCSRYGNAATGVRTAYVFWDL

SEQ ID NO: 3665 - DNA, 702 bp, Neisseria meningitidis
atgttccgcatcatcaaatggctgattgccctgcccgtcggcatctttatctttttcaatgcctatgtgtacggcaacatcattacctaccgcgccgtcgcgccccatcggactgcctttatgtcgatgcggatgaagcagtttgaacaggaaggtcgcgatgtcgcactggattaccgctggatgccctacaaacgcatttccaccaacctgaaaaaagccctgattgcttccgaagatgcccgtttcgccgggcacggcggcttcgattggggcggcattcaaaacgccatcaggcgcaaccggaacagcggcaaagtgaaggcgggcggctcgaccatcagccagcagcttgccaaaaacctgtttttaaacgaaagccgcagctatatccgcaaaggcgaagaagcggcgattaccgcgatgatggaagccgttaccgacaaagacaggatttttgaactgtatttaaactcaatcgaatggcactacggcgttttcggcgcggaagccgcgtcccggtatttttatcaaatacccgccgccaagctgaccaaacagcaggcggcaaaactgacggcgcgcgtccccgccccgctctactacgccgaccatccgaaaagcaaacggctccgcaacaaaaccaatatcgtgctcaaacgcatgggttcggcagagttgcctgaaagcgacacggactga

SEQ ID NO: 3666 - protein, 233 aa, Neisseria meningitidis
MFRIIKWLIALPVGIFIFFNAYVYGNIITYRAVAPHRTAFMSMRMKQFEQEGRDVALDYRWMPYKRISTNLKKALIASEDARFAGHGGFDWGGIQNAIRRNRNSGKVKAGGSTISQQLAKNLFLNESRSYIRKGEEAAITAMMEAVTDKDRIFELYLNSIEWHYGVFGAEAASRYFYQIPAAKLTKQQAAKLTARVPAPLYYADHPKSKRLRNKTNIVLKRMGSAELPESDTD

SEQ ID NO: 3667 - DNA, 702 bp, Neisseria meningitidis
atgttccgcatcatcaaatggctgattgccctgcccgtcggcatctttatctttttcaatgcctatgtgtacggcaacatcattacctaccgcgccgtcgcgccccatcggactgcctttatgtcgatgcggatgaagcagtttgaacaggaaggtcgcgatgtcgcactggattaccgctggatgccctacaaacgcatttccaccaacctgaaaaaagccctgattgcttccgaagatgcccgtttcgccgggcacggcggcttcgattggggcggcattcaaaacgccatcaggcgcaaccggaacagcggcaaagtgaaggcgggcggctcgaccatcagccagcagcttgccaaaaacctgtttttaaacgaaagccgcagctatatccgcaaaggcgaagaagcggcgattaccgcgatgatggaagccgttaccgacaaagacaggatttttgaactgtatttaaactcaatcgaatggcactacggcgttttcggcgcggaagccgcgtcccggtatttttatcaaatacccgccgccaagctgaccaaacagcaggcggcaaaactgacggcgcgcgtccccgccccgctctactacgccgaccatccgaaaagcaaacggctccgcaacaaaaccaatatcgtgctcagacgcatgggttcggcagagttgcctgaaagcgacacggactga

SEQ ID NO: 3668 - protein, 233 aa, Neisseria meningitidis
MFRIIKWLIALPVGIFIFFNAYVYGNIITYRAVAPHRTAFMSMRMKQFEQEGRDVALDYRWMPYKRISTNLKKALIASEDARFAGHGGFDWGGIQNAIRRNRNSGKVKAGGSTISQQLAKNLFLNESRSYIRKGEEAAITAMMEAVTDKDRIFELYLNSIEWHYGVFGAEAASRYFYQIPAAKLTKQQAAKLTARVPAPLYYADHPKSKRLRNKTNIVLRRMGSAELPESDTD

SEQ ID NO: 3669 - DNA, 1749 bp, Neisseria meningitidis
atgttgattaaaagcgaatataagccccggatgctgcccaaagaagagcaggtcaaaaagccgatgaccagtaacggacggattagcttcgtcctgatggcaatggcggtcttgtttgcctgtctgattgcccgcgggctgtatctgcagacggtaacgtataactttttgaaagaacagggcgacaaccggattgtgcggactcaagcattgccggctacacgcggtacggtttcggaccggaacggtgcggttttggcgttgagcgcgccgacggagtccctgtttgccgtgcctaaagatatgaaggaaatgccgtctgccgcccaattggaacgcctgtccgagcttgtcgatgtgccggtcgatgttttgaggaacaaactcgaacagaaaggcaagtcgtttatttggatcaagcggcagctcgatcccaaggttgccgaagaggtcaaagccttgggtttggaaaactttgtatttgaaaaagaattaaaacgccattacccgatgggcaacctgtttgcacacgtcatcggatttaccgatattgacggcaaaggtcaggaaggtttggaactttcgcttgaagacagcctgtatggcgaagacggcgcggaagttgttttgcgggaccggcagggcaatattgtggacagcttggactccccgcgcaataaagcaccgcaaaacggcaaagacatcatcctttccctcgatcagaggattcagaccttggcctatgaagagttgaacaaggcggtcgaataccatcaggcaaaagccggaacggtggtggttttggatgcccgcacgggggaaatcctcgccttggccaatacgcccgcctacgatcccaacagacccggccgggcagacagcgaacagcggcgcaaccgtgccgtaaccgatatgatcgaacctggttcggcaatcaaaccgttcgtgattgcgaaggcattggatgcgggcaaaaccgatttgaacgaacggctgaatacgcagccttataaaatcggaccgtctcccgtgcgcgatgatacccatgtttacccctctttggatgtgcgcggcattatgcagaaatcgtccaacgtcggcacaagcaaactgtctgcgcgtttcggcgccgaagaaatgtatgacttctatcatgaattgggcatcggtgtgcgtatgcactcgggctttccgggggaaactgcaggtttgttgagaaattggcgcaggtggcggcccatcgaacaggcgacgatgtctttcggttacggtctgcaattgagcctgctgcaattggcgcgcgcctataccgcactgacgcacgacggcgttttgctgccgctcagctttgagaagcaggcggttgcgccgcaaggcaaacgcatattcaaagaatcgaccgcgcgcgaggtacgcaatctgatggtttccgtaaccgagccgggcggcaccggtacggcgggtgcggtggacggtttcgatgtcggcgctaaaaccggcacggcgcgcaagttcgtcaacgggcgttatgccgacaacaaacacgtcgctacctttatcggttttgcccccgccaaaaacccccgtgtgattgtggcggtaaccatcgacgaaccgactgcccacggctattacggcggcgtagtggcagggccgcccttcaaaaaaattatgggcggcagcctgaacatcttgggcatttccccgaccaagccactgaccgccgcagccgtcaaaacaccgtcttaa

SEQ ID NO: 3670 - protein, 582 aa, Neisseria meningitidis
MLIKSEYKPRMLPKEEQVKKPMTSNGRISFVLMAMAVLFACLIARGLYLQTVTYNFLKEQGDNRIVRTQALPATRGTVSDRNGAVLALSAPTESLFAVPKDMKEMPSAAQLERLSELVDVPVDVLRNKLEQKGKSFIWIKRQLDPKVAEEVKALGLENFVFEKELKRHYPMGNLFAHVIGFTDIDGKGQEGLELSLEDSLYGEDGAEVVLRDRQGNIVDSLDSPRNKAPQNGKDIILSLDQRIQTLAYEELNKAVEYHQAKAGTVVVLDARTGEILALANTPAYDPNRPGRADSEQRRNRAVTDMIEPGSAIKPFVIAKALDAGKTDLNERLNTQPYKIGPSPVRDDTHVYPSLDVRGIMQKSSNVGTSKLSARFGAEEMYDFYHELGIGVRMHSGFPGETAGLLRNWRRWRPIEQATMSFGYGLQLSLLQLARAYTALTHDGVLLPLSFEKQAVAPQGKRIFKESTAREVRNLMVSVTEPGGTGTAGAVDGFDVGAKTGTARKFVNGRYADNKHVATFIGFAPAKNPRVIVAVTIDEPTAHGYYGGVVAGPPFKKIMGGSLNILGISPTKPLTAAAVKTPS

SEQ ID NO: 3671 - DNA, 1746 bp, Neisseria meningitidis
atgttgattaagagcgaatataagcctcggatgctgcccaaagaagagcaggtcaaaaagccgatgaccagtaacggacggatcagcttcgtcctgatggcaatagcggtcttgtttgccggtctgattgctcgcggactgtatctgcagacggtaacgtataactttttgaaagaacagggcgacaaccggattgtgcggactcaaacattgccggctacacgcggtacggtttcggaccggaacggtgcggttttggcgttgagtgcgccgacggagtccctgtttgccgtgcctaaagagatgaaggaaatgccgtctgccgcacaattggaacgcctgtccgagcttgtcgatgtgccggttgatgttttgaggaacaagctcgaacagaaaggcaagtcgtttatctggattaagcggcagctcgatcccaaggttgccgaagaggtcaaagccttgggtttggaaaactttgtatttgaaaaagaattaaaacgccattacccgatgggcaacctgtttgcacacgtcatcggatttaccgatattgacggcaaaggtcaggaaggtttggaactttcgcttgaagacagcctgcatggcgaagacggcgcggaagtcgttttgcgggaccggcagggcaatattgtggacagcttggactccccgcgcaataaagccccgaaaaacggcaaagacatcatcctttccctcgatcagaggattcagaccttggcctatgaagagttgaacaaggcggtcgaataccatcaggcaaaagccggaacggtggtggttttggatgcccgcacgggggaaatcctcgccttggccaatacgcccgcctacgatcccaacaggcccggccgggcagacagcgaacagcggcgcaaccgtgccgtaaccgatatgatcgaacccggttcggcaatcaaaccgtttgtgattgcgaaggcattggatgcgggcaaaaccgatttgaacgaacggctgaatacgcagccttataaaatcggaccgtctcccgtgcgcgatacccatgtttacccctctttggatgtgcgcggcatcatgcagaaatcgtccaacgtcggcacaagcaaactgtctgcgcgtttcggtgccgaagaaatgtatgacttctatcatgagttgggcatcggtgtgcgtatgcactcgggctttccgggcgaaactgcaggtttgttgagaaattggcgcaggtggcggcctatcgaacaggcgacgatgtctttcggttacggcctgcaattgagcctgctgcaattggcgcgcgcctataccgcactgacgcacgacggcgttttactgccggtcagctttgaaaaacaggcggttgcgccgcaaggcaaacgcatattcaaagaatcgaccgcgcgcgaggtacgcaatctgatggtttccgtaaccgagccgggcggcaccggtacggcgggtgcggtggacggtttcgatgtcggcgcgaaaaccggcacggcgcgcaagttcgtcaacgggcgttatgccgacaacaaacacatcgctacctttatcggttttgcccccgccaaaaatccccgtgtgattgtggcggtaaccattgacgaaccgactgcccacggttattacggcggcgtagtggcagggccgcccttcaaaaaaattatgggcggcagcctgaacatcttgggcatttccccgaccaagccactgaccgccgcagccgtcaaaacaccgtcttaa

SEQ ID NO: 3672 - protein, 581 aa, Neisseria meningitidis
MLIKSEYKPRMLPKEEQVKKPMTSNGRISFVLMAIAVLFAGLIARGLYLQTVTYNFLKEQGDNRIVRTQTLPATRGTVSDRNGAVLALSAPTESLFAVPKEMKEMPSAAQLERLSELVDVPVDVLRNKLEQKGKSFIWIKRQLDPKVAEEVKALGLENFVFEKELKRHYPMGNLFAHVIGFTDIDGKGQEGLELSLEDSLHGEDGAEVVLRDRQGNIVDSLDSPRNKAPKNGKDIILSLDQRIQTLAYEELNKAVEYHQAKAGTVVVLDARTGEILALANTPAYDPNRPGRADSEQRRNRAVTDMIEPGSAIKPFVIAKALDAGKTDLNERLNTQPYKIGPSPVRDTHVYPSLDVRGIMQKSSNVGTSKLSARFGAEEMYDFYHELGIGVRMHSGFPGETAGLLRNWRRWRPIEQATMSFGYGLQLSLLQLARAYTALTHDGVLLPVSFEKQAVAPQGKRIFKESTAREVRNLMVSVTEPGGTGTAGAVDGFDVGAKTGTARKFVNGRYADNKHIATFIGFAPAKNPRVIVAVTIDEPTAHGYYGGVVAGPPFKKIMGGSLNILGISPTKPLTAAAVKTPS

SEQ ID NO: 3673 - DNA, 1746 bp, Neisseria meningitidis; identical to SEQ ID NO: 3671

SEQ ID NO: 3674 - protein, 581 aa, Neisseria meningitidis; identical to SEQ ID NO: 3672

SEQ ID NO: 3675 - DNA, 1548 bp, Neisseria meningitidis
gtgcgtttcaatcatttcataatggtaacgattattatatatgtgatttcccctgcaaacaagccggtccgccgccccggcgttcccacttatccggctttgccttataattgctttttttatgtaacagattcacctatgaatttccccaaaacagcggcctccctgctgctgcttctcgcctccctcgccgcacacgcgctcgataccggccgcattccgcaaaacgaaatcgctgtatatgtccaagagcttgacagcggaaaagtcatcattgaccaccgtgccggcatacccgtcaatcccgcgtccacgatgaagctcgttaccgcgtttgccgccttcaaaaccttcggcagcaattaccgctgggcgaccgagtttaaaagcaacggtacggtaaacgacggcacgcttgacggaaacctgtattgggcgggcagcggcgaccccgttttcaatcaggaaaacctgcttgccgtccaacgccagttgcgcgacaaaggcatccgcaatatcacggggcgcctgatgctcgaccacagcctgtggggcgaagtcggcagtcccgaccattttgaagccgacagcggttcgccgtttatgacgcccccaaatccgactatgctgtctgccggtatggttatggtgcgcgccgaacgcaatgccgccggcagtaccgacatcctcaccgatccgcctttgccgcatatttttgcccaaaacaacttgaaaattaccgcctcccaagctgcctgcccttcggtcaaaaaactgatgcgcgcatctttttcgggcaatacgctgaaattgcgcggcaatattcccgaaagctgtttgggcaagcctgtcggtgtccggatgttcgcgcttgacgaactgatccgccaaagttttaccaaccgctggctgctcggcggcggacggatttcagacggcatcggcatagccgacacaccggaaggcgcgcagacgcttgccgttgcacactccaaaccgatgaaggaaattttgacggacatgaacaagcgttcggacaatctgattgcgcgttccgtcttcctcaaactcggcggcgacggcaaactgcccgccgtttccgaacaggcggcgtctgccgtccggcgagaacttgccgtatcgggcatcgatgttgcggatttggttttggaaaacggttcgggtctgtccagaaaagaaagggtaacggcgagaatgatggcgcaaatgttggaaacggcttatttcagcccgtttgcacaagatttcatcgacacgctgcccatcgccggcacagacgggactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgcccgacttggacaacttcgttgccaaaaacatcatctccggcggcgacggctggctggatgcgaaactgatgtgcaaagaacgccgcgcctga

SEQ ID NO: 3676 - protein, 515 aa, Neisseria meningitidis
VRFNHFIMVTIIIYVISPANKPVRRPGVPTYPALPYNCFFYVTDSPMNFPKTAASLLLLLASLAAHALDTGRIPQNEIAVYVQELDSGKVIIDHRAGIPVNPASTMKLVTAFAAFKTFGSNYRWATEFKSNGTVNDGTLDGNLYWAGSGDPVFNQENLLAVQRQLRDKGIRNITGRLMLDHSLWGEVGSPDHFEADSGSPFMTPPNPTMLSAGMVMVRAERNAAGSTDILTDPPLPHIFAQNNLKITASQAACPSVKKLMRASFSGNTLKLRGNIPESCLGKPVGVRMFALDELIRQSFTNRWLLGGGRISDGIGIADTPEGAQTLAVAHSKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVAKNIISGGDGWLDAKLMCKERRA

SEQ ID NO: 3677 - DNA, 1548 bp, Neisseria meningitidis
gtgcgtctcaatcatttcataatgatagcgattattatatatgtgatttcccctgcaaacaagccggcccgccgccacagcgttcccacttatccggctttgccttataattgctttttttatgtaacagatttacctatgaatttccccaaaacagcggcctccctgctgctgcttctcgcctccctcgccgcacacgcgctcgataccggccgcattccgcaaaacgaaatcgccgtatatgtccaagagcttgacagcggaaaagtcatcattgaccaccgctcggatgtccccgtcaaccccgcctccacaatgaaactcgttaccgcgtttgccgccttcaaaaccttcggcagcaattaccgctgggcgaccgagtttaaaagcaacggtacggtaaacgacggcacgcttgacggaaacctatattgggcgggcagcggcgaccccgttttcaatcaggaaaacctgcttgatgctcaaaaacagttgcgcgaacaaggcatactcaatatcacgggacacctgatgctcgaccacagcctgtggggcgaagtcggcagccccgacgatttcgaagccgacagcggttcgccgtttatgacgccccccaatccaactatgctgtctgccggtatggttatggtgcgcgccgaacgcaatgccgccggcagtaccgacatcctcaccgatccgcctttgccgcatattttcgcccaaaacaacttgaaaattaccgcctcccaagctgcctgcccttcgatcaaaaaactgatgcgtgcatctttttcggacaatacgctgaaattgcgcggcaatattcccgagagctgtttgggcaagcctgtcggtgtccggatgttcgcgcttgacgaactgatccggcaaagttttaccaaccactggctgctcggcggcggacggatttcagacggtatcggcatagccgacacgccggaaggcgcgcagacacttgccgttgcacacgccaaaccgatgaaagaaattttgacggacatgaacaagcgttcggacaatctaattgcgcgttccgtcttcctcaaactcggcggcgacggcaaactgcccgccgtttccgaacaggcggcgtctgccgtccggcgcgaacttgccgtatcgggcatcgatgttgcggatttggttttggaaaacggttcgggcctgtccagaaaagaaagggtaacggcgagaatgatggcgcaaatgttggaaacggcttatttcagcccgtttgcacaagatttcatcgacacgctacccatcgccggcacagacggaactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgccagacttggacaacttcgttgccaacaacatcatctccggcggcgatggctggctggatgcgaaactgatgtgcaaagaacgccgagcctga

SEQ ID NO: 3678 - protein, 515 aa, Neisseria meningitidis
VRLNHFIMIAIIIYVISPANKPARRHSVPTYPALPYNCFFYVTDLPMNFPKTAASLLLLLASLAAHALDTGRIPQNEIAVYVQELDSGKVIIDHRSDVPVNPASTMKLVTAFAAFKTFGSNYRWATEFKSNGTVNDGTLDGNLYWAGSGDPVFNQENLLDAQKQLREQGILNITGHLMLDHSLWGEVGSPDDFEADSGSPFMTPPNPTMLSAGMVMVRAERNAAGSTDILTDPPLPHIFAQNNLKITASQAACPSIKKLMRASFSDNTLKLRGNIPESCLGKPVGVRMFALDELIRQSFTNHWLLGGGRISDGIGIADTPEGAQTLAVAHAKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVANNIISGGDGWLDAKLMCKERRA

SEQ ID NO: 3679 - DNA, 1548 bp, Neisseria meningitidis
gtgcgtctcaatcatttcataatgatagcgattattatatatgtgatttcccctgcaaacaagccggcccgccgccacagcgttcccacttatccggctttgccttataattgctttttttatgtaacagatttacctatgaatttccccaaaacagcggcctccctgctgctgcttctcgcctccctcgccgcacacgcgctcgatacaggtcgcattccgcaaaacgaaatcgccgtatatgtccaagagcttgacagcggaaaagtcatcattgaccaccgctcggatgtccccgtcaaccccgcctccacaatgaaactcgttaccgcgtttgccgccttcaaaaccttcggcagcaattaccgctgggcgaccgagtttaaaagcaacggtacggtaaacgacggcacgcttgacggaaacctgtattgggcgggcagcggcgaccccgttttcaatcaggaaaacctgcttgccgtccaacgccagttgcgcgaacaaggcatacgcaatatcacgggacacctgatgctcgaccacagcctgtggggcgaagtcggcagccccgacgatttcgaagccgacagcggttcgccgtttatgacgccccccaatccaactatgctgtctgccggtatggttatggtgcgcgccgaacgcaatgccgccgacagtaccgacatcctcaccgatccgcctttgccgcatattttcgcccaaaacaacttgaaaattaccgcctcccaagctgcctgcccttcgatcaaaaaactgatgcgtgcatctttttcggacaatacgctgaaattgcgcggcaatattcccgagagctgtttgggcaagcctgtcggtgtccggatgttcgcgcttgacgaactgatccggcaaagttttaccaaccactggctgctcggcggcggacggatttcagacggcatcggcatatccgacacgccggaaggcgcgcagacgcttgccgttgcacactcaaagccgatgaaggaaattttgacggacatgaacaagcgttcggacaatctaattgcgcgttccgtcttcctcaaactcggcggcgacggcaaactgcccgccgtttccgaacaggcagcgtctgccgtccggcgtgaacttgccgtgtcgggcatcgatgttgcggatttggttttggaaaacggttcaggtctgtccagaaaagaaagggtaacggcgagaatgatggcgcaaatgttggaaacggcttatttcagcccgtttgcacaagatttcatcgatacgctgcccatcgccggcacagacgggactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgcccgacttggacaacttcgttgccaacaacatcatctccggcggcgatggctggctggatgcgaaactgatgtgcaaagaacgccgagcctga

SEQ ID NO: 3680 - protein, 515 aa, Neisseria meningitidis
VRLNHFIMIAIIIYVISPANKPARRHSVPTYPALPYNCFFYVTDLPMNFPKTAASLLLLLASLAAHALDTGRIPQNEIAVYVQELDSGKVIIDHRSDVPVNPASTMKLVTAFAAFKTFGSNYRWATEFKSNGTVNDGTLDGNLYWAGSGDPVFNQENLLAVQRQLREQGIRNITGHLMLDHSLWGEVGSPDDFEADSGSPFMTPPNPTMLSAGMVMVRAERNAADSTDILTDPPLPHIFAQNNLKITASQAACPSIKKLMRASFSDNTLKLRGNIPESCLGKPVGVRMFALDELIRQSFTNHWLLGGGRISDGIGISDTPEGAQTLAVAHSKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVANNIISGGDGWLDAKLMCKERRA

SEQ ID NO: 3681 - DNA, 1172 bp, Neisseria meningitidis
atgccgtctgaaatgccgtctgaaacgtggcaggcggaggttcggacggcattgggtttatttcaacgggcggatgccgaccgcatcgcgtactttatccaacaattcgcgcgcttctttgcgcgctttttgcgcgcctgcctgcaaaatctcttcgatttgcgaaggattagaggtcaatgcgttgtagcgttcgcgcagttctgccaattcggcgttgattttcgccgccgaaagttttttcgcctcgccccaagccaagccgtcggcaagcatttgcgtaaattccgccgtttcagacggcgtggagaaggctttatagatttcaaacaaagggctttcgtcgggctgtttcggctcgcccggctctttcatgttggtaatgattttgttgaccgatttttgggtttttttgtcgttttcccaaagcggaatggtattgccgtaggatttggacattttgcgtccgtccaaaccgaccaagagttcgacgttttcgtcgattttcacttcgggcagggtgaagagttcttggaaaccgtgggtgaagcggccggcaatgtcgcgcgccatttcgacgtgttggatttggtcgcgcccgacggggacttcgttggcgttgaacatcaaaatgtcggcagtcatcagaatcggataactgaacaaacccatttccacaccgaaatcggggtcttcctgcccgttttccgcattggcttgaacggcggctttgtaggcgtgggcgcggttcatcaaacccttggcggtgatgcaggtcagaatccagttcaactccatcacttcgggaatgtcgctttggcggtagaaggtggtgcgctcggggtcgagtccgcaggcaagccaagtggcggcaacggcttgggtggattggtgaatcatctcctgctcgtggcatttgatgatgccgtggtaatcggcgaggaagaggaaggattcggtatcggggttttgcgccgcgcggacggcggggcggatggcgccgacgtagttgcccagatgcggggtgccggtggtggttacgccggtcagaactcgttttttgctcataaaaatgtccttacggcagcaatgccgtctgaaagggaaaagatgcgccgattatacccgatttgccacatacatccagccgacaacagacttttccatattaa

SEQ ID NO: 3682 - protein, 390 aa, Neisseria meningitidis
MPSEMPSETWQAEVRTALGLFQRADADRIAYFIQQFARFFARFLRACLQNLFDLRRIRGQCVVAFAQFCQFGVDFRRRKFFRLAPSQAVGKHLRKFRRFRRRGEGFIDFKQRAFVGLFRLARLFHVGNDFVDRFLGFFVVFPKRNGIAVGFGHFASVQTDQEFDVFVDFHFGQGEEFLETVGEAAGNVARHFDVLDLVAPDGDFVGVEHQNVGSHQNRITEQTHFHTEIGVFLPVFRIGLNGGFVGVGAVHQTLGGDAGQNPVQLHHFGNVALAVEGGALGVESAGKPSGGNGLGGLVNHLLLVAFDDAVVIGEEEEGFGIGVLRRADGGADGADVVAQMRGAGGGYAGQNSFFAHKNVLTAAMPSEREKDAPIIPDLPHTSSRQQTFPY

SEQ ID NO: 3683 - DNA, 1160 bp, Neisseria meningitidis
atgccgtctgaaacgcggcaggcggaggttcggacggcatcgggttcatttcaacgggcggatgccgaccgcatcggtactttgtccaataattcgcgtgcttctttacgcgctttcgccgcgcctgcctgcaaaatctcttcgatttgcgaagggtcggcggtcagctcgttgtagcgttcgcgcggttcggcgagttcggcgttgattttcgccgccaaaagttttttggcttcaccccacgccaagccgtcggcaagcattttcgtaaattccaccgtttcagacggcgtggagaaggctttgtagatttcaaacaatgggctttcgtcgggctgtttcggctcgcccggctctttcatattggtgatgattttgttgaccgatttttgggtttttttgtcgttttcccaaagcggaatggtgttgccgtaggatttggacattttgcgtccgtccaaaccgaccaagagttcgacgttttcatcgattttcacttcgggcagggtgaagagttcccggaagcggtggttgaagcggccggcgatgtcgcgcgccatttcgacgtgttggatttggtcgcgcccgacgggcacttcgttggcgttgaacatcagaatatcggcagtcatcagaatcggataactgaacaaacccatttccacaccgaaatcagggtcttcctgcccgttttctgcatttgcctgcacggcggctttgtaggcatgggcgcggttcatcaaacccttggcagtgatgcaggtcagaatccagttcaattccatcacttcgggagtgtcgctttggcggtagaaggtggtgcgctcggggtcgagtccgcaggcaagccaagtggcggcaacggcttgggtggattggtgaatcatctccggctcgtggcatttgatgataccgtggtaatcggcgaggaagaggaaggattcggtatcgaggttttgcgccgcgcggacggcggggcggatggcgccgacgtagttgcccagatgcgggatgccggtggtggttacgccggtcagaactcgttttttgctcataaaaatgtccttgcggcatcaatgccgtctgaaagggaaaaagatgtgccgattatacccgatttgccacctacatccagccgacaacagacttttccatattaa

SEQ ID NO: 3684 - protein, 385 aa, Neisseria meningitidis
  VARIANT (1)...(385): Xaa = Any Amino Acid
MPSETRQAEVRTASGSFQRADADRIXYFVQFACFFTRFRRACLQNLFDLRRVGGQLVVAFARFGEFGVDFRRQKFFGFTPRQAVGKHFRKFHRFRRRGEGFVDFKQWAFVGLFRLARLFHIGDDFVDRFLGFFVVFPKRNGVAVGFGHFASVQTDQEFDVFIDFHFGQGEEFPEAVVEAAGDVARHFDVLDLVAPDGHFVGVEHQNIGSHQNRITEQTHFHTEIRVFLPVFCICLHGGFVGMGAVHQTLGSDAGQNPVQFHHFGSVALAVEGGALGVESAGKPSGGNGLGGLVNHLRLVAFDDTVVIGEEEEGFGIEVLRRADGGADGADVVAQMRDAGGGYAGQNSFFAHKNVLAASMPSEREKDVPIIPDLPPTSSRQQTFPY

SEQ ID NO: 3685 - DNA, 1137 bp, Neisseria meningitidis
gaggttcggacggcattgggtttatttcaacgggcggataccgaccgcatcacgtactttgcccaataattcgcgtgcttctttacgcgctttttgcgcgcctgcctgcaaaatctcttcgatttgcgaagggtcggcggtcagctcgttgtagcgttcgcgcggttcggcgagttcggcgttgattttcgccgccaaaagtttttttgcctcgccccaagccaagccgtcggcaagcattttcgtaaattctgccgtttcagacggcgtggagaaagctttgtagatttcaaacagagggctttcgtcgggcttcttcggctcgcccggctctttcatattggtgatgattttgttgaccgatttttgggtttttttgtcgttttcccaaagcggaatggtgttgccgtaggatttggacattttgcgtccgtccaaaccaaccaagagttcgacgttttcgtcgattttcacttcgggcagtgtgaagagttcccggaagcggtggttgaagcggccggcaatatcgcgtgccatttcaacgtgttggatttggtcgcgaccgactggaacttcatgggcattgaacatgagaatgtcggcagtcatgaggatagggtagctgtacaaacccatttccacgccgaaatcggggtcttcctgcccgttttccgcatttgcctgcacggcggctttgtaggcgtgggcgcggttcatcaaacccttggcggtgatgcaggtcagaatccagttcaattccatcacttcgggaatgtcgctttgacggtagaaggtggtgcgctcggggtcgagtccgcaggcaagccaagtggcggcaacggcttgggtggattggtgaatcatctccggctcgtggcatttgatgataccgtggtaatcggcgaggaagaggaaggattcggtatcagggttttgcgccgcgcggacggcggggcggatagcaccgacgtagttgcccagatgcgggatgccggtggtggttacgccggtcagaactcgttttttgctcataaaaatgtccttgcggcatcaatgccgtctgaaagggaaaaagatgcgccgattatacccgatttgccacctacatccagccgacaacagacttttccatattaa

SEQ ID NO: 3686 - protein, 377 aa, Neisseria meningitidis
EVRTALGLFQRADTDRITYFAQFACFFTRFLRACLQNLFDLRRVGGQLVVAFARFGEFGVDFRRQKFFCLAPSQAVGKHFRKFCRFRRRGESFVDFKQRAFVGLLRLARLFHIGDDFVDRFLGFFVVFPKRNGVAVGFGHFASVQTNQEFDVFVDFHFGQCEEFPEAVVEAAGNIACHFNVLDLVATDWNFMGIEHENVGSHEDRVAVQTHFHAEIGVFLPVFRICLHGGFVGVGAVHQTLGGDAGQNPVQFHHFGNVALTVEGGALGVESAGKPSGGNGLGGLVNHLRLVAFDDTVVIGEEEEGFGIRVLRRADGGADSTDVVAQMRDAGGGYAGQNSFFAHKNVLAASMPSEREKDAPIIPDLPPTSSRQQTFPY

SEQ ID NO: 3687 - DNA, 810 bp, Neisseria meningitidis
  misc_feature (1)...(810): n = A,T,C or G
atgcccgatttttcgatgtccaatttggccgttgccttttccatcacattggctgccggtttgtttaccgtattakgyagtggcttggtgatgttttccaaaacgcccaatccgcgtgtgttgtcgtttggtttggcgtttgccggcggtgcgatggtatatgtttccctgacggagattttcagtaagtccagcgaggcgttcgctgaaatttatgataaagaccacgcgtttgcggcggcgaccatggcatttttggccgggatgggcggcattgcgctgattgaccgtctggtgccgaacccgcatgaaactttagacgcgcaagacccgtcgtttcaagaaagcaaacgccgccatatcgcgcgagtcggcatgatggcggcgtttgcgattactgcgcacaatttccccgaaggcttggcgacgttttttgccacattggaaaatccagcagtcgggatgcctttggccttggcgattgccatccataatattccggagggcatttccatcgccgcgccggtttattttgccacccgcagccgtaagaaaacggtgtgggcgtgtctgctatccggcttggccgagccgttgggggcggctttgggctatttggttttgcagccgtttttgtcgcctgccgtgtttggttcggtattcggcgtgatagccggtgtgatggtgtttttggcgttggacgagctgntgccggctgccaaacgctattcagacggccatgaaaccgtttacggcctgacaacgggtatggcggtgattgccgtcagcctggtattgttccatttttaa

SEQ ID NO: 3688 - protein, 269 aa, Neisseria meningitidis
  VARIANT (1)...(269): Xaa = Any Amino Acid
MPDFSMSNLAVAFSITLAAGLFTVLXSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELXPAAKRYSDGHETVYGLTTGMAVIAVSLVLFHF

SEQ ID NO: 3689 - DNA, 810 bp, Neisseria meningitidis
atgcccgatttttcgatgtccaatttggccgttgccttttccattacgttggctgccggtttgtttaccgtattaggcagcggcttggtgatgttttccaaaacgcccaatccgcgcgtgttgtcgtttggtttggcatttgccggcggtgcgatggtgtatgtttccctgacggagattttcagtaagtccagcgaggcgttcgctgaaatttatgataaagaccacgcgtttgcggcggcgaccatggcatttttggcagggatgggcggcattgcgctgattgaccgtctggtgccgaacccgcatgaaactttagacgcgcaagacccgtcgtttcaagaaagcaaacgccgccatatcgcgcgagtcggcatgatggcggcgtttgcgattactgcgcacaatttccccgaaggcttggcgacgttttttgccacattggaaaatccagcagtcgggatgcctttggccttggcgattgccatccataatattccggagggcatttccatcgccgcgccggtttattttgccacccgcagccgtaagaaaacggtgtgggcgtgtctgctatccggcttggccgagccgttgggggcggctttgggctatttggttttgcagccgtttttgtcgcctgccgtgtttggttcggtattcggcgtgatagccggtgtgatggtgtttttggcgttggacgagctgctgccggctgccaaacgctattcagacggccatgaaaccgtttacggcctgacaatgggcatggcggtgattgccgtcagcctggtattgttccatttttaa

SEQ ID NO: 3690 - protein, 269 aa, Neisseria meningitidis
MPDFSMSNLAVAFSITLAAGLFTVLGSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELLPAAKRYSDGHETVYGLTMGMAVIAVSLVLFHF

SEQ ID NO: 3691 - DNA, 1089 bp, Neisseria meningitidis
atgccgtccgaacccgaacggcggcatggcaatactgccctacccttcccgatagccgcacgcccaacggtcggtttttccggcaagcctttcaagataaccggcaagtgtgtcgtattgcgccgccgcattgtccaagcggttgatttcacgccgcgcctgttcgccgtcgggcatttcgccgatgtaccagcctatgtgtttgcgtgcgatgcgcacaccgacggtctcaccataaaacgcgtgcatggcgcggatgtggttcaaaatggcggctctgcattctgccaaactcaaggcaggcggtaaaacgccgtgttcggcataatgcttcaaatcgcggaaaaaccacggcctgccttgcgcgccgcgccctatcatgatgccgtcggcggcggtttgtttgaggacggcggcggctttttgcggcgaagtgatgtcgccgttgacccaggccgggatgttcagacggcttttggtctcggcgatgagttcgtaacgcgcctcgcctttgtacatttgcgtgcgcgcgcgcccgtgaacggcaagggcggcaatgccgcaatcttcggcgattttggcgacggcgggcaggttttgatcgtcgtcgtgccaacccaaacgggttttgagggtaacgggtacgcccgccgccttgaccaccgcctccaaaatggcggcaaccagcggctcgtcctgcatcagcgcgctaccggcttggacgttgcacactttcttggcggggcagcccatattgatgtcgatgacctgcgccccgagtccgacgttgtaacgcgccgcatccgccatctgttcggggtcgctgccggcaatctgcacggcaacgatgccgccttcatcggcaaaatcactgcggtgcagggtttttccggtattcctgagcgtcggatcgctggccagcatttcgcacaccgcccaacctgcgccaaacgcccgacagaggcggcggaagggtttgtcggcaatgcccgccatcggcgcaagtgcgatggggttgtcgataaaataaccgccgatgtgcataatgggcccgcgtttcaaaaaagtgcgccattgtacattttttaa

SEQ ID NO: 3692 - protein, 361 aa, Neisseria meningitidis
MPSEPERRHGNTALPFPIAARPTVGFSGKPFKITGKCVVLRRRIVQAVDFTPRLFAVGHFADVPAYVFACDAHTDGLTIKRVHGADVVQNGGSAFCQTQGRRNAVFGIMLQIAEKPRPALRAAPYHDAVGGGLFEDGGGFLRRSDVAVDPGRDVQTAFGLGDEFVTRLAFVHLRARAPVNGKGGNAAIFGDFGDGGQVLIVVVPTQTGFEGNGYARRLDHRLQNGGNQRLVLHQRATGLDVAHFLGGAAHIDVDDLRPESDVVTRRIRHLFGVAAGNLHGNDAAFIGKITAVQGFSGIPERRIAGQHFAHRPTCAKRPTEAAEGFVGNARHRRKCDGVVDKITADVHNGPAFQKSAPLYIF

SEQ ID NO: 3693 - DNA, 1083 bp, Neisseria meningitidis
ttgcactttcaaaggataatcaagtgttcagaaggcatttgggcggtaggcgcacgcccaactgtcggttttttcggcaagtctttcaagataacctgcaagcatgtcgtattgcgccgccgcactgtccaagcggttgatttcacgacgtgtctgttcgccgtcgggcatttcgtcgatgtaccagcctatgtgtttgcgtgcgatgcgcacaccggcggtgtcgccgtaaaacgcgtgtatggcgcggatgtggttcaaaatagcggcggcgcattctgccaaactcaaggcaggcggcaaaacaccgtgttcggcataatgtttcaaatcgcggaagaaccacggcctgccttgcgcgccgcgccctatcataatgccgtcggcggcggtttgtttgaggacggcttgggctttttgcggcgaagtaatgtcgccgttgacccagaccgggatgttcagacggcatttggtttcggcgatgagttcgtaacgcgcttcgcctttgtacatttgcgtacgcgtgcgtccgtggacggcaagggcggcgatgccgcaatcttcggcgattttggcgatgacgggcaggttttgatggtcgtcgtgccaacccaaacgggttttgagggtaacgggtacgcctgccgcacggacgacggcttccaaaatggcggcaaccagcggctcgttctgcatcagcgcgctaccggcttggacattgcagacttttttagcgggacagcccatgttgatgtcgataagctgcgccccaaggctgacgttgtaacgcgcggcatccgccatctgctgcggatcgcttccggcaatctgcacggcaacaatgccgccttcatcggcaaaatcgctgcggtgcaaggtttttctagtatttctgagcgtcgggtcgctggtcagcatttcgcacaccgcccaacctgcgccaaaatctcggcaaagtcggcggaacggtttgtcggtaatgcccgccatcggcgcaagtgcgatggggttgtcgataaaatagccgccgatgtgcataatggatccgcgtttcaaaaaagtacgccattgtacattttttaa

SEQ ID NO: 3694 - protein, 360 aa, Neisseria meningitidis
LHFQRIIKCSEGIWAVGARPTVGFFGKSFKITCKHVVLRRRTVQAVDFTTCLFAVGHFVDVPAYVFACDAHTGGVAVKRVYGADVVQNSGGAFCQTQGRRQNTVFGIMFQIAEEPRPALRAAPYHNAVGGGLFEDGLGFLRRSNVAVDPDRDVQTAFGFGDEFVTRFAFVHLRTRASVDGKGGDAAIFGDFGDDGQVLMVVVPTQTGFEGNGYACRTDDGFQNGGNQRLVLHQRATGLDIADFFSGTAHVDVDKLRPKADVVTRGIRHLLRIASGNLHGNNAAFIGKIAAVQGFSSISERRVAGQHFAHRPTCAKISAKSAERFVGNARHRRKCDGVVDKIAADVHNGSAFQKSTPLYIF

SEQ ID NO: 3695 - DNA, 1083 bp, Neisseria meningitidis
ttgcactttcaaaggataatcaagtgttcagaaggcatttgggcggtaggcgcacgcccaactgtcggttttttcggcaagtctttcaagataacctgcaaacatgtcgtattgcgccgccgcactgtccaagcggttgatttcacgacgtgtctgttcgccgtcgggcatttcgtcgatgtaccagcctatgtgtttgcgtgcgatgcgcacaccggcggtgtcgccgtaaaacgcgtgcatggctcggatgtggttcaaaatagtggcggtacattctgccaaactcaaggcaggcggtaaaacaccgtgttcggcgtaatgtttcaaatcgcggaagaaccacggtctgccttgcgcgccgcgccctatcataatgccgtctgcggcggtttgtttgaggacggcttgggctttttgcggcgaggtaatgtcgccgttgacccagaccgggatgttcagacggcatttggtttcggcaatcaggtcgtaagccgcttcgcctttgtacatttgcgtgcgcgtgcgtccgtggacggcaagggcggcaatgccgcaatcttcggcgattttggcgatgacgggcaggttttgatggtcgtcgtgccaacccaaacgggttttgagggtaacgggtacgcccgccgctttgaccaccgcctccaaaatggcggcaaccagcggctcgttctgcatcagcgcgctaccggcttggacattgcagacttttttagcgggacagcccatgttgatgtcgataagctgcgccccaaggctgacgttgtaacgcgcggcatccgccatctgctgcggatcgcttccggcaatctgcacggcaacaatgccgccttcatcggcaaaatcgctgcggtgcaaggtttttctagtatttctgagcgtcgggtcgctggtcagcatttcgcacaccgcccaacctgcgccaaaatctcggcaaagtcggcggaacggtttgtcggtaatgcccgccatcggcgcaagtgcgatggggttgtcgataaaatagccgccgatgtgcataatggatccgcgtttcaaaaaagtacgccattgtacattttttaa

SEQ ID NO: 3696 - protein, 359 aa, Neisseria meningitidis
LHFQRIIKCSEGIWAVGARPTVGFFGKSFKITCKHVVLRRRTVQAVDFTTCLFAVGHFVDVPAYVFACDAHTGGVAVKRVHGSDVVQNSGGTFCQTQGRRNTVFGVMFQIAEEPRSALRAAPYHNAVCGGLFEDGLGFLRRGNVAVDPDRDVQTAFGFGNQVVSRFAFVHLRARASVDGKGGNAAIFGDFGDDGQVLMVVVPTQTGFEGNGYARRFDHRLQNGGNQRLVLHQRATGLDIADFFSGTAHVDVDKLRPKADVVTRGIRHLLRIASGNLHGNNAAFIGKIAAVQGFSSISERRVAGQHFAHRPTCAKISAKSAERFVGNARHRRKCDGVVDKIAADVHNGSAFQKSTPLYIF

SEQ ID NO: 3697 - DNA, 1578 bp, Neisseria meningitidis
atggcaacacaggtaggcggtgcaaattcggatgaggcaagcccctgctttcctatttctgaggtggaattggtgggtgaagaaacggctaaattccggtttgcgctcaaccatgccttgtgccaaacacattttgtttccggcaagtgtctgcatgcgggcgacattaatcaaatcatgtccttagcacaaaatgctttgatcggcaggggatataccacgacccgtatcttggctgcgccacaggatttgaatagtggcaagcttcaattaaccctgatgccgggctatctgcgctccatacgaatcgatcggtccaacgatgatcaaacccatgcaggacgtattgcagcattccaaaacaaatttcccacccgctcgaacgatctgttgaatctgcgtgatttggaacaaggactggaaaatctcaaatgtctcccgactgcggaagccgatctccaaatcgttcccgtagagagagaaccaaaccaaagtgatgtcgtggtgcaatggcggtaacgtctgctgccctactgtgtgagtgtggggatggataattcgggtagtgaggcgacaggaaaataccaaggaaatatcactttctctgccgacaatccttttggactgagtgatatgttctatgtaaattatggacgttcaattggcggtacgcccgatgaggaaaattttgacggccatcgcaaagaaggcggatcaaacaattacgccgtacattattcagcccctttcggtaaatggacatgggcattcaatcacaatggctaccgttaccatcaggcggtttccggattatcggaagtctatgactataatggaaaaagttacaacactgatttcggcttcaaccgcctgttgtatcgtgatgccaaacgcaaaacctatctcagtgtaaaactgtggacgagggaaacaaaaagttacattgatgatgccgaactgactgtacaacggcgtaaaaccacaggttggttggcagaactttcccacaaaggatatatcggtcgcagtacggcagattttaagttgaaatataaacacggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgcctgccgagcggggatggtattggcgcaacgatttgagctggcaatttaaaccaggccatcagctttatcttggggctgatgtaggacatgtttcaggacaatccgccaaatggttatcgggccaaactctagccggcacagcaattgggatacgcgggcagataaagcttggcggcaacctgcattacgatatatttaccggccgtgcattgaaaaagcccgaatattttcagacgaagaaatgggtaacggggtttcaggtgggttattcgttttga

SEQ ID NO: 3698 - protein, 525 aa, Neisseria meningitidis
  VARIANT (1)...(525): Xaa = Any Amino Acid
MATQVGGANSDEASPCFPISEVELVGEETAKFRFALNHALCQTHFVSGKCLHAGDINQIMSLAQNALIGRGYTTTRILAAPQDLNSGKLQLTLMPGYLRSIRIDRSNDDQTHAGRIAAFQNKFPTRSNDLLNLRDLEQGLENLKCLPTAEADLQIVPVEREPNQSDVVVQWRXRLLPYCVSVGMDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 3699 - DNA, 1644 bp, Neisseria meningitidis
atgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggtgcgcaaattttcttttcttccttctgtgctcatgaaagaaacagcttttaaaactgggatgtgtttaggttccaataatttgagcaggctacaaaaagccgcgcaacagatactgatcgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatgaaattatggacacgccaaacctataaatacatcgacgatgccgaaatcgaagtacaacgccgccgctctgcaggctgggaagccgaattgcgccaccgtgcttacctcaaccgttggcagcttgacggcaagttgtcttacaaacgcgggaccggcatgcgccaaagtatgcctgcaccggaagaaaacggcggcgatattcttccaggtacatctcgtatgaaaatcattactgccagtttggacgcagccgccccatttaytttaggcaaacagcagtttttctacgcaaccgccattcaagctcaatggaacaaaacgccgttggttgcccaagataaattgtcaatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaa

SEQ ID NO: 3700 - protein, 547 aa, Neisseria meningitidis
  VARIANT (1)...(547): Xaa = Any Amino Acid
MQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFXLGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 3701 - DNA, 1644 bp, Neisseria meningitidis
  misc_feature (1)...(1644): n = A,T,C or G
atgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggcgcgcaaattttcttttcttccttctgtgctcatgaaagaaacagcttttaaaactgggatgtgtttaggttccaataatttgagcaggctacaaaaagccgcgcaacagatactgattgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggtgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacaggtttcataaaacttcagtcggaatgaaattatggacacgccaaacctataaatacatcgacgatgccgaaatcgaagtgcaacgccgccgctctgcaggctgggaagccgaattgcgccaccgtgcttacctcaaccgttggcagcttgacggcaagttgtcttacaaacgcgggaccggcatgcgccaaagtatgcccgcacctgaagaaaacggcggcggtactattccaggcacatcccgtatgaaaatcataaccgccggattggatgcagcggccccgtttatgttgggcaaacagcagtttttctacgcaaccgccattcaagctcaatggaacaaaacgcctttggttgcccaagacaagttgtctatcggcagccgctacaccgttngcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggnttcagaggaggncataaagtaggcggtatgtttgcttatgatctgtttgccggcaagccgcttcataaacccaaaggctttcagacgaccaacaccgtttacggcttcaacttgaattacagtttctaa

SEQ ID NO: 3702 - protein, 547 aa, Neisseria meningitidis
  VARIANT (1)...(547): Xaa = Any Amino Acid
MQRQQHIDAELLTDANVRFEQPLEKNNYVLSEDETPCTRVNYISLDDKTARKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLVHKTDLTDATGTETESGSRSYSVHYSVPVKKWLFSFNHNGHRYHEATEGYSVNYDYNGKQYQSSLAAERMLWRNRFHKTSVGMKLWTRQTYKYIDDAEIEVQRRRSAGWEAELRHRAYLNRWQLDGKLSYKRGTGMRQSMPAPEENGGGTIPGTSRMKIITAGLDAAAPFMLGKQQFFYATAIQAQWNKTPLVAQDKLSIGSRYTVXGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 3703 - DNA, 1311 bp, Neisseria meningitidis
atgatgcagcacaatcgtttcttcgcggtcggggccggtggagacgatggcgaccggcgcgccgcagacttcttcaatccgtttcaaatatgctttggcattggcaggcaatgcgtcgtagcttttcacgccgacagtcgattcgcgccagccgggcatggtttcgtaaatcggtttgcaggtttccaccgcatccgaaccgcaaggcaggatgtcggttttgccgccgcctggcaattcgtagccgacgcagatattgatggtttcaacgccgtccattacatcgagtttggtaatgcacataccggaaatgccgttgatttggatggagcgtttcagggcggcggcatcaaaccagccgcagcggcgcgcgcggccggttaccgaaccgaattcgtgtccgcgctccgccaaacctgcgcctacttcgtcgaacaattcggtcgggaacgggcccgaaccgacgcgcgtggtataggctttgacgatgcccaaaacataatccagcatttgaggacctacgcccgcgcctgccgaagccgcgccggcgagacagttggacgaggtaacgaaggggtaagtgccgtagtcgatgtccaacaacgcaccttgcgcgccttcaaacagcagtttttcgccgtttttgtttttttcgttcaacacgcgggacacgtcggcaatcatcggcgcaatgcgcggcgcgactttttcgataaccgccatcacgtcttccgctttaaccggtccggcgttatgcaggtattggagttggacgttgtaataggcaaggacggcatccagtttttcacgcagtttttcaggatgcagcaaatcggcggcgcgaatggcgcggcgtgccactttgtcttcgtaggcagggccgatgccgcggccggtcgtgccgattttgcctttgccgcgcgatgcttcgcgggcttggtcgagcgcgatgtggtaaggcaggatcagcgggcaggtcggcgcgattttcagacggccttcgacgtttttcacgcctgccgcgttcaactcgtcgatttcgcccaacagggcttcgggggaaacgacaacgcccgaaccgatgaagcaatccaatccttcgtgcaggataccgctcggaatcaggcgcaaaatggtttttttgccgccgacgaccaaggtatggcccgcattgtggccgccttggaagcgcacgacgctgccggcttcttccgccagccagtcaacgattttacctttaccctcgtcgccccactgtgcgccgattactacaacatttttagccatagccatataacctatcgatattaa

SEQ ID NO: 3704 - protein, 436 aa, Neisseria meningitidis
MMQHNRFFAVGAGGDDGDRRAADFFNPFQICFGIGRQCVVAFHADSRFAPAGHGFVNRFAGFHRIRTARQDVGFAAAWQFVADADIDGFNAVHYIEFGNAHTGNAVDLDGAFQGGGIKPAAAARAAGYRTEFVSALRQTCAYFVEQFGRERARTDARGIGFDDAQNIIQHLRTYARACRSRAGETVGRGNEGVSAVVDVQQRTLRAFKQQFFAVFVFFVQHAGHVGNHRRNARRDFFDNRHHVFRFNRSGVMQVLELDVVIGKDGIQFFTQFFRMQQIGGANGAACHFVFVGRADAAAGRADFAFAARCFAGLVERDVVRQDQRAGRRDFQTAFDVFHACRVQLVDFAQQGFGGNDNARTDEAIQSFVQDTARNQAQNGFFAADDQGMARIVAALEAHDAAGFFRQPVNDFTFTLVAPLCADYYNIFSHSHITYRY

SEQ ID NO: 3705 - DNA, 1310 bp, Neisseria meningitidis
atgatgcagcacaatcgtttcttctcggtcggggccggtggagacgatggcgaccggcgcgccgcagacttcttcaatccgtttcaaatatgctttggcgttttcgggcaatgcgccgtagtccttcacgccgaaagtggattcgcgccagccgggcatggtttcgtaaatcggcttgcaggtttccaccgcatcggaaccgcaaggcaggatgtcggttttgccgccgtcgggcaattcatagccgacgcagatattgatggtttcaacgccgtccattacatcgagtttagtaatacacataccggaaatgccgttgatttggatggagcgtttcagggcggcggcatcaaaccagccgcagcggcgtgcgcgtccggttaccgaaccgaattcgtgtccgcgttctgccaaacctacgcctacttcgtcgaacaattcggtcgggaacgggcccgaaccgacgcgcgtggtataggctttgacgatgcccaaaacataatccagcatttgaggacctacgcccgcgcctgccgaagctgcgcccgccagacagttggacgaggtaacgaagggataagtgccgtagtcgatgtccaacaacgcaccttgcgcgccttcaaacagcagtttttcgccgtttttgtttttctcgttcaacacgcgggacacgtcggtaatcatcggcgcaatgcgcggcgcgactttttcgataaccgccatcacgtcttccgctttaaccggctcggcattgtgcagatgttgcagttggacattgtaataggcaaggacggcatccagtttttcacgcagtttytcaggatgcagcaaatcggcggcgcgaatggcgcggcgtgccactttgtcttcgtaggcagggccgatgccgcggccggtcgtgccgattttgcctttgccgcgcgatcttcgcgggcttggtcgagcgcgatgtggtaaggcaggatcagcgggcaggtcggcgcgattttcagacggccttcgacgtttttcacgcctgccgcgttcaactcgtcgatttcgcccaacagggcttcgggggagacgacaacgcccgaaccgatgaagcagtccaaactttcatgcaggatgccgctcggaatcaggcgcaaaatggtttttttgccgccgacaaccaaggtatggcccgcattgtggccgccttggaagcgcaccacgccgccggcttcttccgccagccagtcaacgattttacctttaccctcgtcgccccactgtgcgccgattastacaacatttttagccatagccatataacctatcgatattaa

SEQ ID NO: 3706 - protein, 436 aa, Neisseria meningitidis
  VARIANT (1)...(436): Xaa = Any Amino Acid
MMQHNRFFSVGAGGDDGDRRAADFFNPFQICFGVFGQCAVVLHAESGFAPAGHGFVNRLAGFHRIGTARQDVGFAAVGQFIADADIDGFNAVHYIEFSNTHTGNAVDLDGAFQGGGIKPAAAACASGYRTEFVSAFCQTYAYFVEQFGRERARTDARGIGFDDAQNIIQHLRTYARACRSCARQTVGRGNEGISAVVDVQQRTLRAFKQQFFAVFVFLVQHAGHVGNHRRNARRDFFDNRHHVFRFNRLGIVQMLQLDIVIGKDGIQFFTQFXRMQQIGGANGAACHFVFVGRADAAAGRADFAFAAXIFAGLVERDVVRQDQRAGRRDFQTAFDVFHACRVQLVDFAQQGFGGDDNARTDEAVQTFMQDAARNQAQNGFFAADNQGMARIVAALEAHHAAGFFRQPVNDFTFTLVAPLCADXYNIFSHSHITYRY

SEQ ID NO: 3707 - DNA, 1310 bp, Neisseria meningitidis
atgatgcagcacaatcgtttcttcgcggtcggggccggtggagacgatggcgaccggcgcaccgcagacttcttcaatccgtttcaaatatgctttggcattggcaggtaatgcgtcgtagcttttcacgccgaaagtggattcgctccaaccgggcatggtttcgtaaatcggcttgcaggcttctaccgcatcagagccgcaaggcaggatgtcggttttgccgccgtcgggcaattcgtagccgacgcagatattgatggtttcaacgccgtccattacatcgagtttggtaatacacataccggaaatgccgttgatttggatggagcgtttcagggcggcggcatcaaaccagccgcagcggcgtgcgcgtccggttaccgaaccgaattcgtgtccgcgttctgccaaacctgctccgacttcgtcgaacaattcggtcgggaacgggcccgaaccgacgcgcgtggtataggctttgacgatgcccaaaacataatccagcatttgagggcctacgcccgcgcctgccgaagccgcgccggcgaggcagttggacgaagtaacgaaggggtaagtgccgtagtcgatgtccaacaacgcaccttgcgcgccttcaaacagcagtttttcgccgtttttgtttttttcgttcaacacgcgggacacgtcggtaatcatcggcgtaatgcgcggcgcgactttttcgataaccgccatcacgtcttccgctttcaccgactcggcattgtgcagatgttgcagttggacgttgtaataagcaaagacggcatccagtttttcacgcagtttttcaggatgcagcaaatcggcggcgcgaatggcgcggcgtgccactttgtcttcgtaggcagggccgatgccgcggccggtcgtgccgattttgcctttgccgcgcgatgcttctcgggcttggtcgagcgcgatgtgataaggcaggatcagcgggcaggtcggcgcgattttcagacggccttcgacgtttttcacgcctgccgcgttcaactcgtcgatttcgcccaacagggcttcgggggagacgacaacgcccgaaccgatgaagcagtccagactttcatgcaggatgccgctcggaatcaggcgcaaaatggtttttttgccgccgacaaccaaggtatgacccgcattgtggccgccttggaagcgcaccacgcctccggcttcttccgccagccagtcaacgattttacctttaccctcgtcgccccactgtgcgccgattactacaacatttttagccatagccatataaccttcgatattaa

SEQ ID NO: 3708 - protein, 435 aa, Neisseria meningitidis
  VARIANT (1)...(435): Xaa = Any Amino Acid
MMQHNRFFAVGAGGDDGDRRTADFFNPFQICFGIGRCVVAFHAESGFAPTGHGFVNRLAGFYRIRAARQDVGFAAVGQFVADADIDGFNAVHYIEFGNTHTGNAVDLDGAFQGGGIKPAAAACASGYRTEFVSAFCQTCSDFVEQFGRERARTDARGIGFDDAQNIIQHLRAYARACRSRAGEAVGRSNEGVSAVVDVQQRTLRAFKQQFFAVFVFFVQHAGHVGNHRRNARRDFFDNRHHVFRFHRLGIVQMLQLDVVISKDGIQFFTQFFRMQQIGGANGAACHFVFVGRADAAAGRADFAFAARCFSGLVERDVIRQDQRAGRRDFQTAFDVFHACRVQLVDFAQQGFGGDDNARTDEAVQTFMQDAARNQAQNGFFAADNQGMTRIVAALEAHHASGFFRQPVNDFTFTLVAPLCADYYNIFSHSHITXRY

SEQ ID NO: 3709 - DNA, 339 bp, Neisseria meningitidis
atgaaatatatcgtatcaatctctctggctatgggattggctgcctgttcgtttgggggatttaaaccaaatccgtgggacgccgcgtcattttgggaattgaaaaattacgccaatccctatccgggatcagcctcggcggcacttgaccaatatccatcgaaagcaagacgaaggcaactgaaagacatgcaagagtgcggctatgacccaatagacggcggaaagtctgaagcagatgcctgcctgaggaaaaaaggctggtgtcgtaagggtttcgacccttatcccgaaaacaaaaaatacgaatggcctcgagaagaaggaaaaacaaaatga

SEQ ID NO: 3710 - protein, 112 aa, Neisseria meningitidis
MKYIVSISLAMGLAACSFGGFKPNPWDAASFWELKNYANPYPGSASAALDQYPSKARRRQLKDMQECGYDPIDGGKSEADACLRKKGWCRKGFDPYPENKKYEWPREEGKTK

SEQ ID NO: 3711 - DNA, 378 bp, Neisseria meningitidis
atgaaaaaaccgaccgataccctacccgtcaatctgcaacgccgccgcctgctgtgtgccgccggcgcgctgttgatcagcccgctggcgcacgccggcgcgcaacgtgaagaaacgcttgccgacgatgtggcttccgtgatgaggagttctgtcggcagcgtcaatccgccgaggctggtgttcgacaatccgaaagagggcgaacgttggttgtccgcgatgtcggcacgtttggcaagattcgtccccgacgagggggagcggcgcaggctgctggtcaatatccaatacgaaagcagccgggccggtttggatacgcagattgtgttggggctgattgaagtggaaagcgggtaccgagctcgaatcatatca

SEQ ID NO: 3712 - protein, 126 aa, Neisseria meningitidis
MKKPTDTLPVNLQRRRLLCAAGALLISPLAHAGAQREETLADDVASVMRSSVGSVNPPRLVFDNPKEGERWLSAMSARLARFVPDEGERRRLLVNIQYESSRAGLDTQIVLGLIEVESGYRARIIS

SEQ ID NO: 3713 - DNA, 624 bp, Neisseria meningitidis
atgagaaaaccgaccgataccctacccgttaatctgcaacgccgccgcctgttgtgtgccgccggtgcgttgttgctcagtcctctggcgcacgccggcgcgcaacgtgaggaaacgcttgccgacgatgtggcttccgtgatgaggagttctgtcggcagcgtcaatccgccgaggctggtgtttgacaatccgaaagagggcgagcgttggttgtctgccatgtcggcacgtttggcaaggttcgtccccgaggaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttktggaaaaactacatcggcaaaccggcgcacaacctgttcgacatccgcaccaacctgcgttacggctgtaccatcctgcgccattaccggaatcttgaaaaaggcaacatcgtccgcgcgcttgcccgctttaacggcagcttgggcagcaataaatatccgaacgccgttttgggcgcgtggcgcaaccgctggcagtggcgttga

SEQ ID NO: 3714 - protein, 207 aa, Neisseria meningitidis
  VARIANT (1)...(207): Xaa = Any Amino Acid
MRKPTDTLPVNLQRRRLLCAAGALLLSPLAHAGAQREETLADDVASVMRSSVGSVNPPRLVFDNPKEGERWLSAMSARLARFVPEEEERRRLLVNIQYESSRAGLDTQIVLGLIEVESAFRQYAISGVGARGLMQVMPXWKNYIGKPAHNLFDIRTNLRYGCTILRHYRNLEKGNIVRALARFNGSLGSNKYPNAVLGAWRNRWQWR

SEQ ID NO: 3715 - DNA, 624 bp, Neisseria meningitidis
atgaaaaaaccgaccgataccctacccgtcaatctgcaacgccgccgcctattgtgtgctgccggcgcgctgttgctcagcccgctggcacaagccggcgcgcaacgtgaagaaacgcttgccgacgatgtggcttccgtgatgaggagctctgtcggcagcataaatccgccgaggctggtgttcgacaatccgaaagagggcgagcgttggctgtccgcgatgtctgctcggttggcaaggttcgtccccgatgaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttttggaaaaactacatcggcaaaccggcgcacaacctgttcgacatccgcaccaacctgcgttacggctgtaccatcctgcgccattaccggaatcttgaaaaaggcaacatcgtccgcgcactcgcccgttttaacggtagcctcggcagcaataaatatccgaacgccgttttgggcgcgtggcgcaaccgctggcagtggcgttga

SEQ ID NO: 3716 - protein, 207 aa, Neisseria meningitidis
MKKPTDTLPVNLQRRRLLCAAGALLLSPLAQAGAQREETLADDVASVMRSSVGSINPPRLVFDNPKEGERWLSAMSARLARFVPDEEERRRLLVNIQYESSRAGLDTQIVLGLIEVESAFRQYAISGVGARGLMQVMPFWKNYIGKPAHNLFDIRTNLRYGCTILRHYRNLEKGNIVRALARFNGSLGSNKYPNAVLGAWRNRWQWR

SEQ ID NO: 3717 - DNA, 500 bp, Neisseria meningitidis
atgagaaaagccgtctaagccggtataaacaaaataaactcattgggctatttgtcgcaggtgtaactgcaagaacagcggcagagttggtaggcattaataaaaataccgcagcctatgattttcatcgtttacgatgactgatttatcaaaacggtccgcatttagaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagtattgtttatacggattgttatcgtagctatgatgtattagatgtgagcgaatttagccattttagcttcgctgaaacttcgttttcgtatcaatcacagcacacattttgccgaacgacaaaaccatattaa

SEQ ID NO: 3718 - protein, 165 aa, Neisseria meningitidis
  VARIANT (1)...(165): Xaa = Any Amino Acid
MXKSRLSRYKQNKLIGLFVAGVTARTAAELVGINKNTAAYDFHRLRLIYQNGPHLEMFDGEVEADESYFGGQRKGKRGRGAAGKVAVFGLLKRNGKVYTVTVPNTQTATLFPIIREQVKPDSIVYTDCYRSYDVLDVSEFSHFSFAETSFSYQSQHTFCRTTKPY

SEQ ID NO: 3719 - DNA, 501 bp, Neisseria meningitidis
atgagaaaaagtcgtctaagccagtataaacaaamtaaactcattgaactgtttgtcacaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaa

SEQ ID NO: 3720 - protein, 166 aa, Neisseria meningitidis
  VARIANT (1)...(166): Xaa = Any Amino Acid
MRKSRLSQYKQXKLIELFVTGVTARTAAELVGVNKNTAAYYFHRLRLLIYQNSPHLEMFDGEVEADESYFGGQRKGKRGRGAAGKVAVFGLLKRNGKVYTVTVPNTQTATLFPIIREQVKPDSIFYTDCYRSYDVLDVREFSHFSFAETSFSYQSQHTFCRTTKPY

SEQ ID NO: 3721 - DNA, 501 bp, Neisseria meningitidis
atgagaaaaagtcgtctaagccagtataaacaaaataaactcattgagctatttgtcgcaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattgtttatacggattgttatcgtagctatgatgtattagatgtgcgcgaatttagccattttagcttcgctgaaacttcgttttcgtatcaatcacagcacacattttgccgaacgacaaaaccatattaa

SEQ ID NO: 3722 - protein, 166 aa, Neisseria meningitidis
MRKSRLSQYKQNKLIELFVAGVTARTAAELVGVNKNTAAYYFHRLRLLIYQNSPHLEMFDGEVEADESYFGGQRKGKRGRGAAGKVAVFGLLKRNGKVYTVTVPNTQTATLFPIIREQVKPDSIVYTDCYRSYDVLDVREFSHFSFAETSFSYQSQHTFCRTTKPY

SEQ ID NO: 3723 - DNA, 327 bp, Neisseria meningitidis
atgcgtaaaaccgtacttatcctgaccatctccgccgcccttttgtcgggctgcacatgggaaacttatcaagacggcagcggcaaaaccgccgtccgtgcaaaatgttccaccggcacgccgctgtgttggcaagacgggcgcggctcgaaaaaggtggactgcgacgagtacggtggcgaacgccgggccgtgttgcgcaaccaaaagcgggggaagcccgcgacgaggagagccgcaacgctggggaaaccgagtttccgggcgagggacgggggggggcgggtgaacagggcagaaacgggggaggggaagcgatcggcgagg

SEQ ID NO: 3724 - protein, 109 aa, Neisseria meningitidis
MRKTVLILTISAALLSGCTWETYQDGSGKTAVRAKCSTGTPLCWQDGRGSKKVDCDEYGGERRAVLRNQKRGKPATRRAATLGKPSFRARDGGGRVNRAETGEGKRSAR

SEQ ID NO: 3725 - DNA, 273 bp, Neisseria meningitidis
atgcgtaaaaccttcctcttcctgaccgctgccgccgcccttttgtcgggctgcgcgtgggaaacttatcaagacggcaacggcaagaccgccgtccgtcaaaaatatcccgccggcacgcccgtttattaccaagacggcagctactcgaaaaatatgaactacaaccaataccgtcccgaacgccatgccgtgttacccaatcaaaccggcaacaacgccgacgaagagcatcgccaacactggcaaaaaccaaagtttcaaaaccgataa

SEQ ID NO: 3726 - protein, 90 aa, Neisseria meningitidis
MRKTFLFLTAAAALLSGCAWETYQDGNGKTAVRQKYPAGTPVYYQDGSYSKNMNYNQYRPERHAVLPNQTGNNADEEHRQHWQKPKFQNR

SEQ ID NO: 3727 - DNA, 273 bp, Neisseria meningitidis
atgcgtaaaaccttccttatcctgatgactgccgccgcccttttgtcgggctgcgcgtgggaaacttatcaagacggcaacggcaagaccgccgtccgtcaaaaatatcccgccggcacgcccgtttattaccaagacggcagctactcgaaaaatatgaactacaaccaataccgtcccgaacgccatgccgtgttacccaaccaaaccggcaacaacgccgacgaagagcatcgccaacactggcaaaagcccaaatttcaaaaccgataa

SEQ ID NO: 3728 - protein, 90 aa, Neisseria meningitidis
MRKTFLILMTAAALLSGCAWETYQDGNGKTAVRQKYPAGTPVYYQDGSYSKNMNYNQYRPERHAVLPNQTGNNADEEHRQHWQKPKFQNR

SEQ ID NO: 3729 - DNA, 285 bp, Neisseria meningitidis
atgaaaaaactgttattggccgccgttgtttccctaaatgccgcaaccgcatttgccggcgactctgccgagcgtcagatttacggcgatccccattttgaacaaaaccgcacaaaagccgtgaaaatgttggaacagcgcggttatcaggtttacgatgtcgatgccgacgactactggggcaaacctgttttggaagtggaagcctataaagacggccgcgaatacgacatcgtgttgtcttaccccgacctgaaaatcatcaaagagcagctcgatcgctga

SEQ ID NO: 3730 - protein, 94 aa, Neisseria meningitidis
MKKLLLAAVVSLNAATAFAGDSAERQIYGDPHFEQNRTKAVKMLEQRGYQVYDVDADDYWGKPVLEVEAYKDGREYDIVLSYPDLKIIKEQLDR

SEQ ID NO: 3731 - DNA, 285 bp, Neisseria meningitidis
atgaaaaaactgttattggctgccgttgtttctctgagtgccgctgccgcatttgccggcgactctgccgagcgtcagatttacggcgatccccattttgaacaaaaccgcacaaaagctgtgaaaatgttggagcagcgcggttatcaggtttacgatgtcgatgccgacgaccattggggtaagcctgtgctggaagtggaagcctataaagacggccgcgaatacgacatcgtgttgtcttaccccgacctgaaaatcatcaaagagcagctcgatcgctga

SEQ ID NO: 3732 - protein, 94 aa, Neisseria meningitidis
MKKLLLAAVVSLSAAAAFAGDSAERQIYGDPHFEQNRTKAVKMLEQRGYQVYDVDADDHWGKPVLEVEAYKDGREYDIVLSYPDLKIIKEQLDR

SEQ ID NO: 3733 - DNA, 285 bp, Neisseria meningitidis
atgaaaaaactgttattggtcgccgttgtttccttgagtgccgcaaccgcatttgccggcgactctgccgagcgtcagatttacggcgatccctattttgaacaaaaccgcacaaaagccgtgaaaatgttggaacagcgcggttatcaggttcacgatgtcgatgccgacgaccattggggcaaacctgttttggaagtggaagcctataaagacggccgcgaatacgacattgtgttgtcttaccccgacctgaaaatcatcaaagagcagctcgatcgctga

SEQ ID NO: 3734 - protein, 94 aa, Neisseria meningitidis
MKKLLLVAVVSLSAATAFAGDSAERQIYGDPYFEQNRTKAVKMLEQRGYQVHDVDADDHWGKPVLEVEAYKDGREYDIVLSYPDLKIIKEQLDR

SEQ ID NO: 3735 - DNA, 495 bp, Neisseria meningitidis
atgaaaaagaacatattggaattttgggtcggactgttcgtcttgatcggcgcggcggcggttgcctttctcgctttccgcgtggcgggcggcgcggcgttcggcggttcggacaaaacttacgccgtttatgccgatttcggcgacatcggcggtttgaaggtcaatgcccccgtcaaatccgcaggcgtattggtcgggcgcgtcggcgctatcgggcttgacccgaaatcctatcaggcgagggtgcgccttgatttggacggcaagtatcagttcagcagtgacgtttccgcgcaaatcctgacttcgggacttttgggcgaacagtacatcgggctgcagcagggcggcgatacggaaaaccttgctgccggcgacaccatctccgtaaccagttctgcaatggttctggaaaacctgatcggtaaattcatgaccagcttcgccgagaaaaacgctgagggcggcaatgcggaaaaagccgcagaataa

SEQ ID NO: 3736 - protein, 164 aa, Neisseria meningitidis
MKKNILEFWVGLFVLIGAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNAEGGNAEKAAE

SEQ ID NO: 3737 - DNA, 495 bp, Neisseria meningitidis
atgaagaagaacatattggaattttgggtcggactgttcgtcctgattggcgcggcggcggttgcctttctcgctttccgcgtggccggcggtgcggcgttcggcggttcggacaaaacttacgccgtttatgccgatttcggcgacatcggcggtttgaaggtcaatgcccccgtcaaatccgcaggcgtattggtcgggcgcgtcggcgctatcggacttgacccgaaatcctatcaggcgagggtgcgcctcgatttggacggcaagtatcagttcagcagcgacgtttccgcgcaaatcctgacttcgggacttttgggcgagcagtacatcgggctgcagcagggcggcgacacggaaaaccttgctgccggcgacaccatctccgtaaccagttctgcaatggttctggaaaaccttatcggcaaattcatgacgagttttgccgagaaaaatgccgacggcggcaatgcggaaaaagccgccgaataa

SEQ ID NO: 3738 - protein, 164 aa, Neisseria meningitidis
MKKNILEFWVGLFVLIGAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNADGGNAEKAAE

SEQ ID NO: 3739 - DNA, 495 bp, Neisseria meningitidis
atgaaaaagaacatattggaattttgggtcggactgttcgtcctgattggcgcggcggcggttgcctttctcgctttccgcgtggccggcggtgcggcgttcggcggttcggacaaaacttacgccgtttatgccgatttcggcgacatcggcggtttgaaggtcaatgcccccgtcaaatccgcaggcgtattggtcgggcgcgtcggcgctatcggacttgacccgaaatcctatcaggcgagggtgcgcctcgatttggacggcaagtatcagttcagcagcgacgtttccgcgcaaatcctgacttcgggacttttgggcgagcagtacatcgggctgcagcagggcggcgacacggaaaaccttgctgccggcgacaccatctccgtaaccagttctgcaatggttctggaaaaccttatcggcaaattcatgacgagttttgccgagaaaaatgccgacggcggcaatgcggaaaaagccgccgaataa

SEQ ID NO: 3740 - protein, 164 aa, Neisseria meningitidis; identical to SEQ ID NO: 3738

SEQ ID NO: 3741 - DNA, 591 bp, Neisseria meningitidis
gtgaaaaaatcctccttcatcagcgcattgggcatcggtattttgagcatcggcatggcatttgcctccccggccgacgcagtgggacaaatccgccaaaacgccacacaggttttgaccatcctcaaaagcggcgacgcggcttctgcacgcccaaaagccgaagcctatgcggttccctatttcgatttccaacgtatgaccgcattggcggtcggcaacccttggcgtaccgcgtccgacgcgcaaaaacaagcgttggccaaagaatttcaaaccctgctgatccgcacctattccggcacgatgctgaaattcaaaaacgcgaccgtcaacgtcaaagacaatcccatcgtcaataagggcggcaaggaaatcgtcgtccgtgccgaagtcggcatccccggtcagaagcccgtcaatatggactttaccacctaccaaagcggcggcaaataccgtacctacaacgtcgccatcgaaggcacgagcctggttaccgtgtaccgcaaccaattcggcgaaatcatcaaagccaaaggcatcgacgggctgattgccgagttgaaagccaaaaacggcggcaaataa

SEQ ID NO: 3742 - protein, 196 aa, Neisseria meningitidis; identical to SEQ ID NO: 352

SEQ ID NO: 3743 - DNA, 591 bp, Neisseria meningitidis; identical to SEQ ID NO: 347

SEQ ID NO: 3744 - protein, 196 aa, Neisseria meningitidis; identical to SEQ ID NO: 348

SEQ ID NO: 3745 - DNA, 591 bp, Neisseria meningitidis; identical to SEQ ID NO: 349

SEQ ID NO: 3746 - protein, 196 aa, Neisseria meningitidis; identical to SEQ ID NO: 350

SEQ ID NO: 3747 - DNA, 834 bp, Neisseria meningitidis
atgaaaaaaaccgcctacgccatcctcctgctgatcgggttcgcttccgcccctgcatttgcagaaacccgccccgccgacccttatgaaggctacaaccgcgccgtttccaaattcaacgaccaagccgaccgctacattttcgcccctgccgcgcgcggctaccgcaaagttacgccgaaacccgtccgcgccggcgtgtccaatttttttaacaacctgcgcgacgtggtcagtttcggcagcaatatcttgcgtttggacatcaaacgcgcaagcgaagacctcgtccgcgtcggcatcaataccaccttcggtttgggcgggctcattgatattgccggcgcgggcggcgttcccgacaataaaaacactttgggcgacacgtttgcctcgtggggctggaaaaacagcaattatttcgtgttgcccgtcttaggcccgtccaccgtccgcgacgcgctcggcacgggcattacctctgtttatccgcccaagaatatcgttttccatacccctgccggacgctggggcacgactgccgctgccgccgtcagtacgcgcgaaggcctcctcgatttgaccgacagtctggacgaagccgccatcgacaaatacagctacacgcgcgacctctatatgaaagtccgcgcacggcagaccggtgcaacacctgccgaaggtacggaagataacatcgacatcgacatcgacgaattggtcgaaagtgccgaaaccggcgcggcagagcccgccgttcacgaagattccgtatccgaaacacaggcagaagcagcaggggaagccgaaacgcaacctggaacacaaccctaa

SEQ ID NO: 3748 - protein, 277 aa, Neisseria meningitidis
MKKTAYAILLLIGFASAPAFAETRPADPYEGYNRAVSKFNDQADRYIFAPAARGYRKVTPKPVRAGVSNFFNNLRDVVSFGSNILRLDIKRASEDLVRVGINTTFGLGGLIDIAGAGGVPDNKNTLGDTFASWGWKNSNYFVLPVLGPSTVRDALGTGITSVYPPKNIVFHTPAGRWGTTAAAAVSTREGLLDLTDSLDEAAIDKYSYTRDLYMKVRARQTGATPAEGTEDNIDIDIDELVESAETGAAEPAVHEDSVSETQAEAAGEAETQPGTQP

SEQ ID NO: 3749 - DNA, 828 bp, Neisseria meningitidis
atgaaaaaaaccgcctatgccttcctcctgctgatcgggttcgcttccgcccctgcatttgccgaaacccgccccgccgacccttatgaaggctacaaccgcgccgttttcaaattcaacgaccaagccgaccgctacattttcgcccctgccgcgcgcggctaccgcaaagttgcgccgaaacccgtccgcgccggcgtgtccaatttttttaacaacctgtgcgacgtggtcagcttcggcagcaatatcttgcgcttggacatcaaacgcgcaagcgaagaccttgtccgcgtcggcatcaacaccactttcggtttgggcgggcttatcgacatcgccggcgcgggcggcattcccgacaataaaaacaccttgggcgacacgtttgcctcgtggggatggaaaaacagcaattatttcgtgttgcccgtcttagggccgtccaccgtccgcgacgcgctcggcacgggtattacctccgtttattcgcccaagaatatcgtcttccgcacccctgtcggacgctggggcacgactgccgtatccgccgtcagtacgcgcgaaggcctgctcgatttgaccgacagtctggacgaagccgccatcgacaaatacagctacacgcgcgacctctatatgaaagtccgtgcgcggcagaccggtgcaacacctgccgaaggtacggaagataacatcgacatcgacgaattggtcgaaagtgccgaaaccggcgcggcggaaactgccgttcaagaagattccgtatccgaaacacaggcagaagcagcaggggaagccgaaacgcaacctggaacacaaccttaa

SEQ ID NO: 3750 - protein, 275 aa, Neisseria meningitidis
MKKTAYAFLLLIGFASAPAFAETRPADPYEGYNRAVFKFNDQADRYIFAPAARGYRKVAPKPVRAGVSNFFNNLCDVVSFGSNILRLDIKRASEDLVRVGINTTFGLGGLIDIAGAGGIPDNKNTLGDTFASWGWKNSNYFVLPVLGPSTVRDALGTGITSVYSPKNIVFRTPVGRWGTTAVSAVSTREGLLDLTDSLDEAAIDKYSYTRDLYMKVRARQTGATPAEGTEDNIDIDELVESAETGAAETAVQEDSVSETQAEAAGEAETQPGTQP

SEQ ID NO: 3751 - DNA, 840 bp, Neisseria meningitidis
atgaaaaaaaccgcctatgccttcctcctgctgatcgggttcgcttccgcccctgcatttgccgaaacccgccccgccgacccttatgaaggctacaaccgcgccgttttcaaattcaacgaccaagccgaccgctacattttcgcccctgccgcgcgcggctaccgcaaagttgcgccgaaacccgtccgcgccggcgtgtccaatttttttaacaacctgtgcgacgtggtcagcttcggcagcaatatcttgcgcttagacatcaaacgcgcaagcgaagaccttgtccgcgtcggtatcaacaccactttcggtttgggcgggcttatcgacatcgccggcgcgggcggcattcccgacaataaaaacaccttgggcgacacgtttgcttcgtggggatggaaaaacagcaattatttcgtgttgcccgtcttagggccgtccaccgtccgcgacgcgctcggcacgggtattacctccgtttattcgcccaagaatatcgtcttccgcacccctgtcggacgctggggcacgactgccgtatccgccgtcagtacgcgcgaaggcctgctcgatttgaccgacagtctggacgaagccgccatcgacaaatacagctacacgcgcgacctctatatgaaagtccgtgcgcggcagaccggtgcaacacctgccgaaggtacggaagataacatcgacatcgacgaattggtcgaaagtgccgaaaccggcgcggcggaaactgccgttcaagaagattccgtatccgaaacacaggcagaagcagcaggggaagccgaaacgcaacctggaacacaacctggaacacaaccttaa

SEQ ID NO: 3752 - protein, 279 aa, Neisseria meningitidis
MKKTAYAFLLLIGFASAPAFAETRPADPYEGYNRAVFKFNDQADRYIFAPAARGYRKVAPKPVRAGVSNFFNNLCDVVSFGSNILRLDIKRASEDLVRVGINTTFGLGGLIDIAGAGGIPDNKNTLGDTFASWGWKNSNYFVLPVLGPSTVRDALGTGITSVYSPKNIVFRTPVGRWGTTAVSAVSTREGLLDLTDSLDEAAIDKYSYTRDLYMKVRARQTGATPAEGTEDNIDIDELVESAETGAAETAVQEDSVSETQAEAAGEAETQPGTQPGTQP

SEQ ID NO: 3753 - DNA, 729 bp, Neisseria meningitidis
atgaaaaaatgtattttgggcattttgaccgcgtgtgccgccatgcctgcatttgccgacagaatcagcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcggagatgaggcaatccgatgcagaaaattcgattgatgtatcggttggacggataaagaaacggatacggagcttggcttccgtctctgtttttctctgcccgattttccatgcatcgggtttcagacggcattggagtgtcagtcgtgttctgccgattcgtaggcttcgacgattttttgcaccagaggatgccggacaacgtcttcgccggtgaaggtatggaaatacagtcctgccacgccgtgcagtttctcacgtgcgtctttcaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatatag

SEQ ID NO: 3754 - protein, 240 aa, Neisseria meningitidis
MKKCILGILTACAAMPAFADRISDLEARLAQLEHRVAVLESGGNTVKIDLFGSNSTMYVCSVTPFQKTFEASDRNEGVARQKVRQACNRETSAMFCGDEAIRCRKFDCIGWTDKETDTELGFRLCFSLPDFPCIGFQTALECQSCSADSASTIFCTRGCRTTSSPVKVWKYSPATPCSFSRASFNPDLMFLGRSIWLVSPVMTAFAPKPMRVRNIFICSGVVFCASSRMMYAPLSVLPRI

SEQ ID NO: 3755 - DNA, 735 bp, Neisseria meningitidis
atgaaaaaatgtattttgggcattttgaccgcgtgtgccgccatgcctgcatttgccgacagaatcggcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcgaagatgaggcaatccgatgcagaaaattcgattgatgtatcggttggacggataaagaaacggatacggatacggagcttggcttccgtatctgtttttctctgcctgattttccatgcatcgggtttcagacggcattggaatgtcagtcgtgttctgccgattcgtaggcttcgacgattttttgcaccaaaggatgccggacaacgtcttcgccggtaaaggtgtggaaatacagcccttccacgttgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatatag

SEQ ID NO: 3756 - protein, 244 aa, Neisseria meningitidis
  VARIANT (1)...(244): Xaa = Any Amino Acid
MKKCILGILTACAAMPAFADRIGDLEARLAQLEHRVAVLESGGNTVKIDLFGSNSTMYVCSVTPFQKTFEASDRNEGVARQKVRQACNRETSAMFCEDEAIRCRKFDXCIGWTDKETDTDTELGFRICFSLPDFPCIGFQTALECQSCSADSXASTIFCTKGCRTTSSPVKVWKYSPSTLCSFSRASFNPDLMFLGRSIWLVSPVMTAFAPKPMRVRNIFICSGVVFCASSRMMYAPLSVLPRI

SEQ ID NO: 3757 - DNA, 729 bp, Neisseria meningitidis
atgaaaaaatgtattttgggcattttgaccgcgtgtgccgccatgcctgcatttgccgacagaatcggcgatttggaagcacgtctggcgcagttggaacaccgtgtcgccgtattggaaagcggcagcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcgaagatgaggcaatccgatgcagaaaattcgattgatgtatcggttggacggataaagaaacggatacggagcttggcttccgtatctgtttttctctgcccgattttccatgcatcgggtttcagacggcattggaatgtcagtcgtgttctgccgattcgtaggcttcgacgattttttgcaccaaaggatgccggacaacgtcttcgccggtaaaggtgtggaaatacagcccttccacgccgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatatag

SEQ ID NO: 3758 - protein, 240 aa, Neisseria meningitidis
MKKCILGILTACAAMPAFADRIGDLEARLAQLEHRVAVLESGSNTVKIDLFGSNSTMYVCSVTPFQKTFEASDRNEGVARQKVRQACNRETSAMFCEDEAIRCRKFDCIGWTDKETDTELGFRICFSLPDFPCIGFQTALECQSCSADSASTIFCTKGCRTTSSPVKVWKYSPSTPCSFSRASFNPDLMFLGRSIWLVSPVMTAFAPKPMRVRNIFICSGVVFCASSRMMYAPLSVLPRI

SEQ ID NO: 3759 - DNA, 495 bp, Neisseria meningitidis; identical to SEQ ID NO: 2967

SEQ ID NO: 3760 - protein, 164 aa, Neisseria meningitidis; identical to SEQ ID NO: 2968

SEQ ID NO: 3761 - DNA, 494 bp, Neisseria meningitidis
atgaaaaaaaccctgttggcaattgttgccgtttccgccttaagtgctgccggcaggcggaagagggaccgccgcctttaccccggcagattagcgaccgttcggtcggacactattgcagtatgaacctgaccgaacacaacggccccaaagcccagattttcttgaacggcaaacccgatcagcccgtttggttctccaccatcaagcagatgttcggctataccaagctgcccgaagagcctaaaggcatccgcgtgatttacgttaccgatatgggcaatgttaccgattggacgaatcccaatgccgacacggagtggatggatgcgaaaaaagccttttacgtcatcgacagcggctttatcggcggtatgggtgcggaagacgcgctgccgttcggcaacaaagagcaggctgagaaatttgcaaaggataaaggcggtaaggttgtcggtttcgacgatatgcctgatacctatattttcaaataa

SEQ ID NO: 3762 - protein, 164 aa, Neisseria meningitidis
  VARIANT (1)...(164): Xaa = Any Amino Acid
MKKTLLAIVAVSALSXCRQAEEGPPPLPRQISDRSVGHYCSMNLTEHNGPKAQIFLNGKPDQPVWFSTIKQMFGYTKLPEEPKGIRVIYVTDMGNVTDWTNPNADTEWMDAKKAFYVIDSGFIGGMGAEDALPFGNKEQAEKFAKDKGGKVVGFDDMPDTYIFK

SEQ ID NO: 3763 - DNA, 495 bp, Neisseria meningitidis; identical to SEQ ID NO: 2969

SEQ ID NO: 3764 - protein, 164 aa, Neisseria meningitidis; identical to SEQ ID NO: 2970

SEQ ID NO: 3765 - DNA, 1131 bp, Neisseria meningitidis
atggtcaaacatctgccactcgccgtcctgactgctttgctgcttgcagcgtgcggcggttcggacaaaccgcctgccgaaaaaccggcaccggcggaaaaccaaaacgtattgaaaatttataactggtcggaatacgtcgatccggaaaccgttgccgattttgaaaagaaaaacggcatcaaggttacttatgatgtgtacgacagtgatgaaacgctggaaagcaaggtgctgaccggaaaatccggttacgacattgtcgcgccgtccaatgcgtttgtgggcaggcagattaaggcaggtgcgtatcagaaaatcgataagtcgatgattcccaattataaacatctcaaccctgaaatgatgaggctgatggacggggtcgatcccgaccacgaatacgccgtgccgttttattgggggacaaataccttcgccatcaataccgaacgcgtgaaaaaggctttgggtacggacaagctgccggacaaccagtgggatttggtgttcaaccccgaatacacgttcaaactcaaacaatgcggcatcagctatttggacagcgcggcggaaatttatcccatggtgttgaactatttgggcaaaaacccgaacagcagcaatacggaagacatcagggaggcaaccgccctgctcaagaaaaaccgccccaatatcaaacgctttacttcgtccggctttatcgatgatttggcgcgcggcgatacctgcgtaacaatcggtttcggcggagatttgaacatcgccaaacgccgtgccgaagaagcgggcggcaaggaaaaaatccgcgtgatgatgccgaaagagggcgtggggatttgggtggattctttcgtgattccgaaagatgcgaaaaacgtcgccaacgcgcacaaatacatcaacgacttcctcgatccggaagtgtcggcgaaaaacggcaatttcgttacctacgcgccttcgagcaagccggcgcgcgatttgatggaggacgaatttaaaaacgacaatacgattttcccgagcggggaagatttgaaaaacagctttatcatggtgcctatccggccggcggcattgaagtttatggtgcgccagtggcaggatgtgaaggcggggaaataa

SEQ ID NO: 3766 - protein, 376 aa, Neisseria meningitidis
MVKHLPLAVLTALLLAACGGSDKPPAEKPAPAENQNVLKIYNWSEYVDPETVADFEKKNGIKVTYDVYDSDETLESKVLTGKSGYDIVAPSNAFVGRQIKAGAYQKIDKSMIPNYKHLNPEMMRLMDGVDPDHEYAVPFYWGTNTFAINTERVKKALGTDKLPDNQWDLVFNPEYTFKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARDLMEDEFKNDNTIFPSGEDLKNSFIMVPIRPAALKFMVRQWQDVKAGK

SEQ ID NO: 3767 - DNA, 1131 bp, Neisseria meningitidis
atgaccaaacatctgcccctggccgtcctgactgctttgctgcttgcagcgtgcggcggttcggacaaaccgcctgccgaaaaaccggcaccggcggaaaaccaaaacgtattgaaaatttacaactggtcggaatatgtcgatccggaaaccgttgccgattttgaaaagaaaaacggcatcaaggttacttatgatgtgtacgacagcgatgaaacgctggaaagcaaggtgctgacaggcaagtccggttacgacattgtcgcgccgtccaatgcgtttgtgggcaggcagattaaggcaggtgcgtatcagaaaatcgataagtcgctgattcccaattataaacacctcaaccccgaaatgatgaggctgatggacggggtcgatcccggccacgaatacgccgtgccgttttattgggggacaaataccttcgccatcaataccgaacgcgtgaaaaaggctttgggtacggacaagctgccggacaaccagtgggatttggtgttcgaccccgaatacacgtccaaactcaagcaatgcggcatcagctatttggacagcgcggcggaaatctatcctatggtgttgaactatttgggtaaaaacccgaacagcagcaatacggaagacatcagggaggcaaccgccctactcaagaaaaaccgccccaatatcaaacgctttacttcgtccggctttatcgatgatttggcgcgcggcgatacctgcgtaacaatcggtttcggcggcgatttgaacatcgccaaacgccgtgccgaagaagcgggcggcaaggaaaaaatccgcgtgatgatgcccaaagagggcgtggggatttgggtggattctttcgtgattccgaaagatgcgaaaaacgtcgccaacgcgcacaaatacatcaacgacttcctcgacccggaagtgtcggcgaaaaacggcaatttcgttacttacgcgccttcgagcaagcctgcgcgtgagctgatggaagacgaatttaaaaacgacaatacgattttcccaaccgaggaggatttgaaaaacagctttatcatggtgcctatccagccggcggcattgaagtttatggtgcgccagtggcaggatgtgaaggcggggaaataa

SEQ ID NO: 3768 - protein, 376 aa, Neisseria meningitidis
MTKHLPLAVLTALLLAACGGSDKPPAEKPAPAENQNVLKIYNWSEYVDPETVADFEKKNGIKVTYDVYDSDETLESKVLTGKSGYDIVAPSNAFVGRQIKAGAYQKIDKSLIPNYKHLNPEMMRLMDGVDPGHEYAVPFYWGTNTFAINTERVKKALGTDKLPDNQWDLVFDPEYTSKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARELMEDEFKNDNTIFPTEEDLKNSFIMVPIQPAALKFMVRQWQDVKAGK

SEQ ID NO: 3769 - DNA, 1131 bp, Neisseria meningitidis
atgaccaaacatctgcccctggccgtcctgactgctttgctgcttgcagcgtgcggcggttcggacaaaccgcctgccgaaaaaccggcgccggcggaaaaccgaaacgtattgaaaatttacaactggtcggaatacgtcgatccggaaaccgttgccgattttgaaaagaaaaacggcatcaaggttacttatgatgtgtacgacagcgatgaaacgctggaaagcaaggtgctgaccggaaaatctggttacgacattgtcgcgccgtccaatgcgtttgtgggcaggcagattaaggcaggtgcgtatcagaaaatcgataagtcgctgattcccaattataaacacctcaaccccgaaatgatgaggctgatggacggggtcgatcccggccacgaatacgccgtgccgttttattgggggacaaataccttcgccatcaataccgaacgcgtgaaaaaggctttgggtacggacaagctgccggacaaccagtgggatttggtgttcgaccccgaatacacgtccaaactcaagcaatgcggcatcagctatttggacagcgcggcggaaatctatcctatggtgttgaactatttgggtaaaaacccgaacagcagcaatacggaagacatcagggaggcaaccgccctactcaagaaaaaccgccccaatatcaaacgctttacttcgtccggctttatcgatgatttggcgcgcggcgatacctgcgtaacaatcggtttcggcggcgatttgaacatcgccaaacgccgtgccgaagaagcgggcggcaaggaaaaaatccgcgtgatgatgcccaaagagggcgtggggatttgggtggattctttcgtgattccgaaagatgcgaaaaacgtcgccaacgcgcacaaatacatcaacgacttcctcgacccggaagtgtcggcgaaaaacggcaatttcgttacttacgcgccttcgagcaagcctgcgcgtgagctgatggaagacgaatttaaaaacgacaatacgattttcccaaccgaggaggatttgaaaaacagctttatcatggtgcctatccagccggcggcattgaagtttatggtgcgccagtggcaggatgtgaaggcggggaaataa

SEQ ID NO: 3770 - protein, 376 aa, Neisseria meningitidis
MTKHLPLAVLTALLLAACGGSDKPPAEKPAPAENRNVLKIYNWSEYVDPETVADFEKKNGIKVTYDVYDSDETLESKVLTGKSGYDIVAPSNAFVGRQIKAGAYQKIDKSLIPNYKHLNPEMMRLMDGVDPGHEYAVPFYWGTNTFAINTERVKKALGTDKLPDNQWDLVFDPEYTSKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARELMEDEFKNDNTIFPTEEDLKNSFIMVPIQPAALKFMVRQWQDVKAGK

SEQ ID NO: 3771 - DNA, 1326 bp, Neisseria meningitidis
atgaaaaaacacctgctccgctccgccctgtacggcatcgccgccgccatcctcgccgcctgccaaagcaggagcatccaaacctttccgcaacccgacacatccgtcatcaacggcccggaccggccggccggcatccccgaccccgccggaacgacggttgccggcggcggggccgtctataccgttgtgccgcacctgtccatgccccactgggcggcgcaggattttgccaaaagcctgcaatccttccgcctcggctgcgccaatttgaaaaaccgccaaggctggcaggatgtgtgcgcccaagcctttcaaacccccgtgcattcctttcaggcaaagcggttttttgaacgctatttcacgccgtggcaggttgcaggcaacggaagccttgcaggtacggttaccggctattacgaaccggtgctgaagggcgacggcaggcggacggaacgggcccgcttcccgatttacggtattcccgacgattttatctccgtcccgctgcctgccggtttgcggggcggaaaaaaccttgtccgcatcaggcagacggggaaaaacagcggcacgatcgacaatgccggcggcacgcataccgccgacctctcccgattccccatcaccgcgcgcacaacggcaatcaaaggcaggtttgaaggaagccgcttcctcccttaccacacgcgcaaccaaatcaacggcggcgcgcttgacggcaaagcccccatcctcggttacgccgaagaccccgtcgaactttttttcatgcacatccaaggctcgggccgcctgaaaaccccgtccggcaaatacatccgcatcggatacgccgacaaaaacgaacatccgtatgtttccatcggacgctatatggcggacaaaggctacctcaagctcgggcagacctcgatgcagggcatcaaagcctatatgcggcaaaatccgcaacgcctcgccgaagttttgggtcaaaaccccagctatatctttttccgcgagcttgccggaagcggcaatgagggccccgtcggcgcactgggcacgccactgatgggggaatacgccggcgcaatcgaccggcactacattaccttgggcgcgcccttatttgtcgccaccgcccatccggttacccgcaaagccctcaaccgcctgattatggcgcaggatacaggcagcgcgatcaaaggcgcggtgcgcgtggattatttttggggttacggcgacgaagccggcgaacttgccggcaaacagaaaaccacgggatacgtctggcagctcctgcccaacggcatgaagcccgaataccgcccgtga

SEQ ID NO: 3772 - protein, 441 aa, Neisseria meningitidis
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 3773 - DNA, 1326 bp, Neisseria meningitidis
atgaaaaaatacctattccgcgccgccctgtacggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtctataccgttgtaccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattcctttcaggcaaaacagttttttgaacgctatttcacgccgtggcaggttgcaggcaacggaagccttgccggtacggttaccggctattacgaaccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccgattccccatcaccgcgcgcacaacagcaatcaaaggcaggtttgaaggaagccgcttcctcccctaccacacgcgcaaccaaatcaacggcggcgcgcttgacggcaaagccccgatactcggttacgccgaagaccctgtcgaacttttttttatgcacatccaaggctcgggccgtctgaaaaccccgtccggcaaatacatccgcatcggctatgccgacaaaaacgaacatccytacgtttccatcggacgctatatggcggataagggctacctcaaactcggacaaacctccatgcagggcattaagtcttatatgcggcaaaatccgcaacgcctcgccgaagttttgggtcaaaaccccagctatatctttttccgcgagcttgccggaagcagcaatgacggccctgtcggcgcactgggcacgccgctgatgggggaatatgccggcgcagtcgaccggcactacattaccttgggtgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagctcctacccaacggtatgaagcccgaataccgcccgtaa

SEQ ID NO: 3774 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3775 - DNA, 1326 bp, Neisseria meningitidis
atgaaaaaatacctattccgcgccgccctgtgcggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtttataccgttgtgccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattccgttcaggcaaaacagttttttgaacgctatttcacgccgtggcaggttgcaggcaacggaagccttgccggtacggttaccggctattacgagccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccaattccccatcactgcgcgcacaacggcaatcaaaggcaggtttgaaggaagccgcttcctcccctaccacacgcgcaaccaaatcaacggcggcgcgcttgacggcaaagccccgatactcggttacgccgaagaccccgtcgaacttttttttatgcacatccaaggctcgggccgtctgaaaaccccgtccggcaaatacatccgcatcggctatgccgacaaaaacgaacatccctacgtttccatcggacgctatatggcggacaaaggctacctcaagctcgggcagacctcgatgcagggcatcaaagcctatatgcagcaaaacccgcaacgcctcgccgaagttttggggcaaaaccccagctatatctttttccgagagcttaccggaagcagcaatgacggccctgtcggcgcactgggcacgccgctgatgggcgagtacgccggcgcagtcgaccggcactacattaccttgggcgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagcttctgcccaacggtatgaagcccgaataccgcccgtaa

SEQ ID NO: 3776 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3777 - DNA, 624 bp, Neisseria meningitidis
ccgatgcagctggttaccgaaaaaggtaaggaaaacatgattcaacgcggcacatacaactaccaataccgcagcaaccgtcccgtcaaagacggcagctacctcgttaccgccgaatatcagcctactttccggtcaaaaaacaaagcaggctggaaacaggctggcatcaaagaaatgcctgacgcaagctattgcgaacaaacccgtatgttcggtaaaaacattgtcaacgtgggacacgaaagcgcggacaccgccatcatcaccaaaccggtcggacaaaacttggaaatcgtcccgctggacaatcccgccgacattcacgtgggctaacgcttcaaagtccgcgttctgttccgtggcgaaccgctgcccaatgccaccgttaccgctacatttgacggcttcgacaccagcgaccgcagcaaaacgcacaaaaccgaagcccaagccttctccgacaccaccgacggcgaaggcgaagtggacatcatccccttgcgccaaggcttttggaaagcgagtgtcgaatacaaagccgatttccccgatcaaagcctgtgccgaaaacaggcgaactacacaactttaaccttccaaatcgcccattctcaccattaa

SEQ ID NO: 3778 - protein, 207 aa, Neisseria meningitidis
  VARIANT (1)...(207): Xaa = Any Amino Acid
PMQLVTEKGKENMIQRGTYNYQYRSNRPVKDGSYLVTAEYQPTFRSKNKAGWKQAGIKEMPDASYCEQTRMFGKNIVNVGHESADTAIITKPVGQNLEIVPLDNPADIHVGXRFKVRVLFRGEPLPNATVTATFDGFDTSDRSKTHKTEAQAFSDTTDGEGEVDIIPLRQGFWKASVEYKADFPDQSLCRKQANYTTLTFQIAHSHH

SEQ ID NO: 3779 - DNA, 807 bp, Neisseria meningitidis
atgaagaaaacattgacactgctctccgtttccgccctatttgccacatccgcccacgcccaccgmgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaawacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaarccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaawmccgaagcacaggctttctccgacagcacagacgacaaaggcgaagtggacatcatcmccttgcgccaaggcttctggaaagccaatgtcgaacacaaaaccgacttccccgatcaaagcgtgtgccaaaaacaggcgaactactcgactttaaccttccaaatcggtcattcgcaccattaa

SEQ ID NO: 3780 - protein, 268 aa, Neisseria meningitidis
  VARIANT (1)...(268): Xaa = Any Amino Acid
MKKTLTLLSVSALFATSAHAHRVWVETAHTHGGEYLKADLGYGEFPELEPIAKDRLHIFSKPMQLVTEKGKENMIQRGTYNYQYRSNRPVKDGSYLVIAEYQPTFWSKXKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHXXEAQAFSDSTDDKGEVDIIXLRQGFWKANVEHKTDFPDQSVCQKQANYSTLTFQIGHSHH

SEQ ID NO: 3781 - DNA, 807 bp, Neisseria meningitidis
tgaaagaaaacattgacactgctcgccgtttccgccctatttgccgcatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaacaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaagccgacttccccgatcaaagcgtgtgccaaaaacaggcgaactactcgactttaaccttccaaatcggccattcgcaccattaa

SEQ ID NO: 3782 - protein, 267 aa, Neisseria meningitidis
KKTLTLLAVSALFAASAHAHRVWVETAHTHGGEYLKADLGYGEFPELEPIAKDRLHIFSKPMQLVTEKGKENMIQRGTYNYQYRSNRPVKDGSYLVIAEYQPTFWSKNKAGWKQAGIKQMPDASYCEQTRMFGKNIVNVGHESADTAIITKPVGQNLEIVPLDNPANIHVGERFKVRVLFRGEPLPNATVTATFDGFDTSDRSKTHKTEAQAFSDSTDDKGEVDIIPLRQGFWKANVEHKADFPDQSVCQKQANYSTLTFQIGHSHH

SEQ ID NO: 3783 - DNA, 807 bp, Neisseria meningitidis
atgaagaaaacattgacactgctcgccgtttccgcactatttgccacatccgcacacccccaccgcgtctgggtcgaaaccgcccacacgcacggcggcgaataccttaaagccgacttgggctacggcgaattccccgaactcgaacccatcgccaaagaccgcctgcacatcttcagcaaaccgatgcagctggttaccgaaaaaggtaaggaaaacatgattcaacgcggcacatacaactaccaataccgcagcaaccgtcccgtcaaagacggcagctacctcgttaccgccgaatatcagcctactttccggtcaaaaaacaaagcaggctggaaacaggctggcatcaaagaaatgcctgacgcaagctattgcgaacaaacccgtatgttcggtaaaaacattgtcaacgtgggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgctacatttgacggcttcgacaccagcgaccgcagcaaaacgcacaaaaccgaagcccaagccttctccgacaccaccgacggcaaaggcgaagtggacatcatccccttgcgccaaggcttttggaaagcgagtgtcgaatacaaagccgatttccccgatcaaagcctgtgccaaaaacaggcgaactacacaactttaaccttccaaatcggccattctcaccattaa

SEQ ID NO: 3784 - protein, 268 aa, Neisseria meningitidis
MKKTLTLLAVSALFATSAHPHRVWVETAHTHGGEYLKADLGYGEFPELEPIAKDRLHIFSKPMQLVTEKGKENMIQRGTYNYQYRSNRPVKDGSYLVTAEYQPTFRSKNKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHKTEAQAFSDTTDGKGEVDIIPLRQGFWKASVEYKADFPDQSLCQKQANYTTLTFQIGHSHH

SEQ ID NO: 3785 - DNA, 807 bp, Neisseria meningitidis
atgaagaaaacattgacactgctcgccgtttccgccctatttgccacatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaaaccgacttccccgatcaaagcgtgtgccaaaaacaggcgaactactcgactttaaccttccaaatcggtcattcgcaccattaa

SEQ ID NO: 3786 - protein, 268 aa, Neisseria meningitidis
MKKTLTLLAVSALFATSAHAHRVWVETAHTHGGEYLKADLGYGEFPELEPIAKDRLHIFSKPMQLVTEKGKENMIQRGTYNYQYRSNRPVKDGSYLVIAEYQPTFWSKNKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHKTEAQAFSDSTDDKGEVDIIPLRQGFWKANVEHKTDFPDQSVCQKQANYSTLTFQIGHSHH

SEQ ID NO: 3787 - DNA, 807 bp, Neisseria meningitidis; identical to SEQ ID NO: 3781

SEQ ID NO: 3788 - protein, 267 aa, Neisseria meningitidis; identical to SEQ ID NO: 3782

SEQ ID NO: 3789 - DNA, 489 bp, Neisseria meningitidis
atgaaaaaataccttatccctctttccattgcggcagtcctttccgggtgccagtctatttatgtgcccacattgacggaaatccccgtgaatcccatcaataccgtcaaaacggaagcacctgcaaaaggttttcgcctcgccccttcgcattgggcggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcggtagacagccagcgcggcgaaatcaatacggaacagtccaagctgtatatcgagaatgccttgcgcggctggcagcagcgttggaaaaatatggatgccaaacccgataatcccgcatttaccaactttttgatggaagtgatgaagatgcagcccttgaaatga

SEQ ID NO: 3790 - protein, 162 aa, Neisseria meningitidis
MKKYLIPLSIAAVLSGCQSIYVPTLTEIPVNPINTVKTEAPAKGFRLAPSHWADVAKISDEATRLGYQVGIGKMTKVQAAQYLNNFRKRLVGRNAVDDSMYEIYLRSAVDSQRGEINTEQSKLYIENALRGWQQRWKNMDAKPDNPAFTNFLMEVMKMQPLK

SEQ ID NO: 3791 - DNA, 489 bp, Neisseria meningitidis
atgaaaaaataccttatccctctttccattgcggcagttctttccggctgccagtctatttatgtgcccacattgacggaaatccccgtgaatcctatcaataccgtcaaaacggaagcacctgcaaaaggtttccgccttgcctcttcgcattggacggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcgatagacagccagcggggcgcaatcaatacggaacagtccaagctgtatatccagaatgccttgcgcggctggcagcagcgttggaaaaatatggatgtcaaacccaacaaccccgcatttaccaactttttgatggaagtgatgaagatgcagcccttgaaatga

SEQ ID NO: 3792 - protein, 162 aa, Neisseria meningitidis
MKKYLIPLSIAAVLSGCQSIYVPTLTEIPVNPINTVKTEAPAKGFRLASSHWTDVAKISDEATRLGYQVGIGKMTKVQAAQYLNNFRKRLVGRNAVDDSMYEIYLRSAIDSQRGAINTEQSKLYIQNALRGWQQRWKNMDVKPNNPAFTNFLMEVMKMQPLK

SEQ ID NO: 3793 - DNA, 489 bp, Neisseria meningitidis
atgaaaaaataccttatccctctttccattgtggcagttctttccggctgccagtctatttatgtgcccacattgacggaaatccccgtgaatcctatcaataccgtcaaaacggaagcacctgcaaaaggtttccgccttgcctcttcgcattggacggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcgatagacagccagcggggcgcaatcaatacggaacagtccaagctgtatatccagaatgccttgcgcggctggcagcagcgttggaaaaatatggatgtcaaacccaacaaccccgcatttaccaactttttgatggaagtgatgaagatgcagcccttgaaatga

SEQ ID NO: 3794 - protein, 162 aa, Neisseria meningitidis
MKKYLIPLSIVAVLSGCQSIYVPTLTEIPVNPINTVKTEAPAKGFRLASSHWTDVAKISDEATRLGYQVGIGKMTKVQAAQYLNNFRKRLVGRNAVDDSMYEIYLRSAIDSQRGAINTEQSKLYIQNALRGWQQRWKNMDVKPNNPAFTNFLMEVMKMQPLK

SEQ ID NO: 3795 - DNA, 1092 bp, Neisseria meningitidis
atggaaaagagaaaaatactgccgctggcaatttgtttggcggctttgtctgcctgtacggcgatggaggcccgcacaccccgggcaaatgaagcccaagccccccgcgcggatgaaatgaaaaaagaaagccgccccgcgtttgacgcggcagccgtaccggtatccgacagcgggtttgccgccaatgcaaatgtccgccgttttgtggacgatgaagtcgggaaaggggatttttcccaggcggaatggcaggatttttttgacaaagcggcttacaaggcggacatcgtcaagattatgcaccgaccctccacatcgcgtccgtggtatgtgttccgcacgggaaattcgggcagggcgaaatttcacggcgcgcgcaggttttatgcggaaaaccgcgcggttatcgatgatgtggcgcaaaaatacggcgtgcctgccgagcttatcgtggcgattatcgggattgaaacgaattacggcaaaaatacgggcagtttccgtgtggcggacgcattggcgactttaggctttgattatccccgccgcgccgggtttttccaaaaagaattggtcgagcttttaaagctggcaaaagaagaaggcggtgatgttttcgcctttaagggcagctatgcgggtgcaatgggtatgccgcaatttatgccttcgagctaccggaaatgggcggtggattatgacggggacggacatcgggatatatggggcaacgtcggtgatgtcgcggcatcggttgccaattatatgaagcagcacggttggcgcacgggcggtaaaatgttggtgtcggcgacgttggcgccgggtgcggatgttcaggcaatcattggcgaaaaaaccgccctgacgcggacggtggcggatttgaaggcgtacggcatcatccccggggaaacgctcgcagatgatgaaaaggcggttttgttcaaactggaaaccgcacccggcgtgtttgaatattatttgggcttgaacaatttttatacggtatggcagtacaaccacagccggatgtatgtaacggcggtcagggacattgccaattcgctcggcggcccgggattgtaa

SEQ ID NO: 3796 - protein, 363 aa, Neisseria meningitidis
MEKRKILPLAICLAALSACTAMEARTPRANEAQAPRADEMKKESRPAFDAAAVPVSDSGFAANANVRRFVDDEVGKGDFSQAEWQDFFDKAAYKADIVKIMHRPSTSRPWYVFRTGNSGRAKFHGARRFYAENRAVIDDVAQKYGVPAELIVAIIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASVANYMKQHGWRTGGKMLVSATLAPGADVQAIIGEKTALTRTVADLKAYGIIPGETLADDEKAVLFKLETAPGVFEYYLGLNNFYTVWQYNHSRMYVTAVRDIANSLGGPGL

SEQ ID NO: 3797 - DNA, 1110 bp, Neisseria meningitidis
atgaaaaagagaaaaatactgccgctggcaatttgtttggcggctttgtctgcctgtacggcgatggaggcacgcccaccccgggcaaatgaagcccaagccccccgcgcggttgaaatgaaaaaagaaagccgccccgcgtttgacgcggcagccgtatttgacgcggcagccgtaccggtatccgacagcgggtttgccgccaatgcaaatgtccgccgttttgtggacgatgaagtcgggaaaggggatttttcccgggcggaatggcaggatttttttgacaaagcggcttacaaggcggacatcgtcaagattatgcaccgcccctccacatcgcgtccgtggtatgtgttccgcacgggaaattcgggcaaggcgaaatttcgcggcgcgcgccggttttatgcggaaaaccgcgcgcttatcgatgatgtggcgcaaaaatacggcgtgcctgccgaacttatcgtggcggttatcgggattgaaacgaattacggcaaaaatacgggcagtttccgtgtggcggacgcattggcgaccttaggctttgattacccccgccgcgccgggtttttccaaaaagaattggtcgagcttttaaagctggcaaaagaagaaggcggcgatgttttcgcctttaaaggcagctatgcgggcgcaatggggatgccgcaatttatgccttcgagctaccggaaatgggcggtggattatgacggggacggacatcgggacatatggggcaacgtcggcgatgtcgcggcatcggttgccaattatatgaagcagcacggttggcgcacgggcgggaaaatgctggtgtctgcaacattggcgccgggtgcggatgttcaggcaatcattggcgaaaaaaccgccctgacgcggacggtggcggatttgaaggcgtacggcatcatccccggcgaagagcttgcagatgatgaaaaggcggttttgttcaaactggaaaccgcaccgggcgtgtttgaatattatttgggcttgaacaatttttatacggtatggcagtacaaccacagccggatgtatgtaacggcggtcagggacattgccaattcgcttggcggcccgggattgtaa

SEQ ID NO: 3798 - protein, 369 aa, Neisseria meningitidis
MKKRKILPLAICLAALSACTAMEARPPRANEAQAPRAVEMKKESRPAFDAAAVFDAAAVPVSDSGFAANANVRRFVDDEVGKGDFSRAEWQDFFDKAAYKADIVKIMHRPSTSRPWYVFRTGNSGKAKFRGARRFYAENRALIDDVAQKYGVPAELIVAVIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASVANYMKQHGWRTGGKMLVSATLAPGADVQAIIGEKTALTRTVADLKAYGIIPGEELADDEKAVLFKLETAPGVFEYYLGLNNFYTVWQYNHSRMYVTAVRDIANSLGGPGL

SEQ ID NO: 3799 - DNA, 1110 bp, Neisseria meningitidis
atgaaaaacagaaaaatactgccgctggcaatttgtttggcggctttgtctgcctgtacggcgatggaggcacgcccgccccgggcaaatgaagcccaagccccccgcgcggatgaaatgaaaaaagaaagccgccccgcgtttgacgcggcagccgtatttgacgcggcagccgtaccggtatccgacagcgggtttgccgccaatgcaaatgtccgccgttttgtggacgatgaagtcgggaaaggggatttttcccgggcggaatggcaggatttttttgacaaagcggcttacaaggcggacatcgtcaagattatgcaccgcccctccacatcgcgtccgtggtatgtgttccgcacgggaaattcgggcaaggcgaaatttcgcggcgcgcgccggttttatgcggaaaaccgcgcgcttatcgatgatgtggcgcaaaaatacggcgtgcctgccgaacttatcgtggcggttatcgggattgaaacgaattacggcaaaaatacgggcagtttccgtgtggcggacgcattggcgaccttaggctttgattacccccgccgcgccgggtttttccaaaaagaattggtcgagcttttaaagctggcaaaagaagaaggcggcgatgttttcgcctttaaaggcagctatgcgggcgcaatggggatgccgcaatttatgccttcgagctaccggaaatgggcggtggattatgacggggacggacatcgggacatatggggcaatgttggcgatgtcgcggcatcgattgccaattatatgaagcagcacggttggcgcacgggcgggaaaatactggtgtctgcaacattggcgccgggtgcggatgttcaggcaatcattggcgaaaaaaccgccctgacgcggacggtggcggatttgaaggcgtacggcatcatccccggcgaagagcttgccgatgatgaaaaggcggttttgttcaaactggaaaccgcacccggcgtgtttgaatattatttgggcttgaacaatttttatacggtatggcagtacaatcacagtcggatgtatgtaacggcggtcagggacattgccaattcgcttggcggcccgggattgtaa

SEQ ID NO: 3800 - protein, 369 aa, Neisseria meningitidis
MKNRKILPLAICLAALSACTAMEARPPRANEAQAPRADEMKKESRPAFDAAAVFDAAAVPVSDSGFAANANVRRFVDDEVGKGDFSRAEWQDFFDKAAYKADIVKIMHRPSTSRPWYVFRTGNSGKAKFRGARRFYAENRALIDDVAQKYGVPAELIVAVIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASIANYMKQHGWRTGGKILVSATLAPGADVQAIIGEKTALTRTVADLKAYGIIPGEELADDEKAVLFKLETAPGVFEYYLGLNNFYTVWQYNHSRMYVTAVRDIANSLGGPGL

SEQ ID NO: 3801 - DNA, 372 bp, Neisseria meningitidis
atgaagcggcaggctttcttcaaaccgatggcgtgtgcggcatttctgtccgccgtttcgctgcgcctccccgtattgggcgcgtgttacgcaatattgtccctctatgcgtttgcactttacggcatcgacaaacggcgtgccgtgcggggaaaacgccgcattcccgaacaccgcctgctcctgcctgccttgttcggcggttggacgggcgcatacttgggtagtaggatgttcaggcataaaacggcgaaaaagcgttttgttgtgctgttccgtctgactgtttcgggcaatgtcctggcgacctgcatcctgattgattatttcgttccgcccgaactttttgtaaaactcgggcaacatctctga

SEQ ID NO: 3802 - protein, 123 aa, Neisseria meningitidis
MKRQAFFKPMACAAFLSAVSLRLPVLGACYAILSLYAFALYGIDKRRAVRGKRRIPEHRLLLPALFGGWTGAYLGSRMFRHKTAKKRFVVLFRLTVSGNVLATCILIDYFVPPELFVKLGQHL

SEQ ID NO: 3803 - DNA, 476 bp, Neisseria meningitidis
atgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggtgcgccatacgggggcaacgccgcattcccgaacaccgcctgctgctgcctgcattgctcggcggctgggtgggcgcgtatttcggcagcatgacattcaaacataagacagcgaaaaagcgttttgttgtgctgttccgtctgactgtttcaggtaatgtcttggcgaccctcatcctgatttatagtggattaaatttaaaccagtacggcgttgcctcgccttgccgtactatttgtactgtctgcggcttcgtcgccttgtcctgatttttgttaatccactatattattttgtcccgcctgaatttttcgtaaaactcgggcagaatacctga

SEQ ID NO: 3804 - protein, 157 aa, Neisseria meningitidis
  VARIANT (1)...(157): Xaa = Any Amino Acid
MKRQAFFKLMACAAFLSAVSLRLPVLGACYAILSLYAFALYGIDKRCAIRGQRRIPEHRLLLPALLGGWVGAYFGSMTFKHKTAKKRFVVLFRLTVSGNVLATLILIYSGLNLNQYGVASPCRTICTVCGFVALSFLLIHYXYFVPPEFFVKLGQNT

SEQ ID NO: 3805 - DNA, 526 bp, Neisseria meningitidis
atgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggcgtgccgtgcggggaaaacgccgcattcccgaacaccgcctgctgctgcctgccttgttcggcggttgggcgggcgcatacttgggcagcaggatattcaggcataaaacggcgaaaaagcgttttgttgtgctgttccgtctgactgtttcgggcaatgtcctggcgaccctcatcctgatttatagtggattaaatttaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatattattttgtcccgcctgaatttttcgtaaaactcgggcagaatacctga

SEQ ID NO: 3806 - protein, 174 aa, Neisseria meningitidis
  VARIANT (1)...(174): Xaa = Any Amino Acid
MKRQAFFKLMACAAFLSAVSLRLPVLGACYAILSLYAFALYGIDKRRAVRGKRRIPEHRLLLPALFGGWAGAYLGSRIFRHKTAKKRFVVLFRLTVSGNVLATLILIYSGLNLNQYGVASPXAQRERFSKVLKHQVNRFRTICTVCGFVALSFLLIHYXYFVPPEFFVKLGQNT

SEQ ID NO: 3807 - DNA, 516 bp, Neisseria meningitidis
atgaaacaaatgcttttggccgtcggcgtgggcgcggtgttggcgggctgcggcaaggatgccggcggttacgagggttattggcgcgaaaagtcggacaaaaaagagggcgtgattgccgtcaaaaaaaaaggcaattacttccttaataaaatcaacgtgtttacaggcaaggaggagtctttgcttttgtctgaaaaagacggcgcgctttcgataaacacggggataggggaaatcccgatcaaactttccgacgacgggaaagagctgtatgtcgaacgcaggcggtatgtgaaaaccgatgcggcgatgaaggacaaaatcatcgcccaccagaaaaagtgcggacaaacggcacaggcatacctcgacgcgcgaaatgcgttgccgtcaaaccaaacgtatcagcagcgtcaggcggcgatcgagcaattgaaacggcggtttgaagccgagtttgacgaattggaaaaagaaatcaaatgcaacggcaaaccgacattgttgttttag

SEQ ID NO: 3808 - protein, 171 aa, Neisseria meningitidis
MKQMLLAVGVGAVLAGCGKDAGGYEGYWREKSDKKEGVIAVKKKGNYFLNKINVFTGKEESLLLSEKDGALSINTGIGEIPIKLSDDGKELYVERRRYVKTDAAMKDKIIAHQKKCGQTAQAYLDARNALPSNQTYQQRQAAIEQLKRRFEAEFDELEKEIKCNGKPTLLF

SEQ ID NO: 3809 - DNA, 150 bp, Neisseria meningitidis
atgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttcctt

SEQ ID NO: 3810 - protein, 50 aa, Neisseria meningitidis
MKQMLLAVGVVAVLAGCGKDAGGYEGYWREKSDKKEGMIAVKKEKGNYFL

SEQ ID NO: 3811 - DNA, 516 bp, Neisseria meningitidis
atgaaacaaatgcttttggccgtcggcgtggcggcggtgttggcgggctgcggcaaggatgccggcggttacgagggttattggcgcgaaaagtcggacaaaaaagagggcgtgattgccgtcaaaaaaaaaggcaattacttccttaataaaatcaacgtgtttacaggcaaggaggagtctttgcttttgtctgaaaaagacggcgcgctttcgataaacacggggataggggaaatcccgatcaaactttccgacgacgggaaagagctgtatgtcgaacgcaggcggtatgtgaaaaccgatgcggcgatgaaggacaaaatcatcgcccaccagaaaaagtgcggacaaacggcacaggcatacctcgacgcgcgaaatgcgttgccgtcaaaccaaacgtatcagcagcgtcaggcggcgatcgagcaattgaaacggcggtttgaagccgagtttgacgaattggaaaaagaaatcaaatgcaacggcaaaccgacattgttgttttag

SEQ ID NO: 3812 - protein, 171 aa, Neisseria meningitidis
MKQMLLAVGVAAVLAGCGKDAGGYEGYWREKSDKKEGVIAVKKKGNYFLNKINVFTGKEESLLLSEKDGALSINTGIGEIPIKLSDDGKELYVERRRYVKTDAAMKDKIIAHQKKCGQTAQAYLDARNALPSNQTYQQRQAAIEQLKRRFEAEFDELEKEIKCNGKPTLLF

SEQ ID NO: 3813 - DNA, 522 bp, Neisseria meningitidis
atgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttccttaataaaatccacgtggttacaggcaaggaagagtccttgcttttgtctgaaaaagacggcgcgctttcgataaacacagggataggggaaatcccgatcaaactttccgacgacgggaaagagctgtatgtcgaacgtaggcagtatgtcaaaaccgatgcggcgatgaaggacaaaatcatcgcccatcagaaaaagtgcggacaaacagcacaggcataccgcgacgcgcgaaatgcgttgccgtcaaaccagacgtatcagcagcatctggcggcgatcgagcaattgaaacggcggtttgaagccgagtttgacgaattggaaaaagaaatcaaatgcaacggcagaagcccggcattgttgctttag

SEQ ID NO: 3814 - protein, 173 aa, Neisseria meningitidis
MKQMLLAVGVVAVLAGCGKDAGGYEGYWREKSDKKEGMIAVKKEKGNYFLNKIHVVTGKEESLLLSEKDGALSINTGIGEIPIKLSDDGKELYVERRQYVKTDAAMKDKIIAHQKKCGQTAQAYRDARNALPSNQTYQQHLAAIEQLKRRFEAEFDELEKEIKCNGRSPALLL

SEQ ID NO: 3815 - DNA, 369 bp, Neisseria meningitidis
aataaaatcaacgtgtttacaggtaaggaagaatctatgcttttgtctgaaaaagacggcgcgctttcgataaacacggggataggggaaatcccgatcaaactttccgacgacgggaaagagctgtatgtcgaacgcaggcagtatgtcaaaaccgatgcggcgatgaaggacaaaatcatcgcccatcagaaaaagtgcggacaaacggcacaggcatatctcgacgcgcgaaatgcgttgccgtcaaaccagacgtatcagcagcatcaggcggcgatcgagcagttgaaacggcggtttgaagccgagtttgacgaattggaaaaagaaatcaaatgcaacggcaaaccgacattgttgttttag

SEQ ID NO: 3816 - protein, 122 aa, Neisseria meningitidis
NKINVFTGKEESMLLSEKDGALSINTGIGEIPIKLSDDGKELYVERRQYVKTDAAMKDKIIAHQKKCGQTAQAYLDARNALPSNQTYQQHQAAIEQLKRRFEAEFDELEKEIKCNGKPTLLF

SEQ ID NO: 3817 - DNA, 489 bp, Neisseria meningitidis
atgaaacacaccgtatccgcatcggtcatcctgcttttgaccgcttgcgcgcaattacctcaaaataacgaaaacctgtggcagccgtccgaacacatcagcagttttgcagcggaagggcggttggcagtcaaagcggaagggaaaggttcgtatgcaaatttcgattggacataccaaccgcccgtggaaaccatcaatatcaacacccctttgggcagtacgctcggacagttgtgtcaagacagggacggcgcattggcagtggacggcaaaggaaatgtctatcaggcagagggtacggaagacttgagcaggcagctggtcggtttcaaactgccaatccaatatctgcatatctgggcggaaggcaggcgtgtggcgggcgcgccttaccgcatccgttcagacggcatattggaacaatacggttggacaatcgggcagaactgccgacagtggggggcaagtccgaacgttgcaactgaa

SEQ ID NO: 3818 - protein, 163 aa, Neisseria meningitidis
MKHTVSASVILLLTACAQLPQNNENLWQPSEHISSFAAEGRLAVKAEGKGSYANFDWTYQPPVETININTPLGSTLGQLCQDRDGALAVDGKGNVYQAEGTEDLSRQLVGFKLPIQYLHIWAEGRRVAGAPYRIRSDGILEQYGWTIGQNCRQWGASPNVATE

SEQ ID NO: 3819 - DNA, 582 bp, Neisseria meningitidis
atgaaacacaccgtatccgcatcggtcatcctgcttttgaccgcttgcgcgcaattacctcaaaataacgaaaacctgtggcagccgtccgaacacatcagcagttttgcagcagaagggcggttggcagtgaaagcggaagggaaaggttcgtatgcaaatttcgattggacataccaaccgcccgtggaaaccatcaatatcaatacccctttgggcagtacgctcgggcagttgtgtcaagacagggacggcgcattggcagtggacggcaaaggaaatgtctatcaggcggaaagtgcggaagaattgagcaggcagctggtcggtttcaaactgccaatccaatatctgcatatctgggcagatggcaggcgtgtggcgggcgcgccttaccgcatcctgccggacggcatattggaacaatacggttggactgtcggcagaaccgccgacagtggggggcaagtccgaacgttgcaactgaataacggaaatttgaacatcaggctggttttcaccgaaatcggtatgccgtctgaaaccgaaaccccggaacgctgtgcggcgcgcacgagataa

SEQ ID NO: 3820 - protein, 193 aa, Neisseria meningitidis
MKHTVSASVILLLTACAQLPQNNENLWQPSEHISSFAAEGRLAVKAEGKGSYANFDWTYQPPVETININTPLGSTLGQLCQDRDGALAVDGKGNVYQAESAEELSRQLVGFKLPIQYLHIWADGRRVAGAPYRILPDGILEQYGWTVGRTADSGGQVRTLQLNNGNLNIRLVFTEIGMPSETETPERCAARTR

SEQ ID NO: 3821 - DNA, 724 bp, Neisseria meningitidis
atgaaaacctacgcacaggcactctataccgcagccctgctcaccgcctgcagccccgcagccgattcaaaccatccgtccggacaaaatgccccggccaataccgaatccgacggaaaaaacattaccctgctcaatgcctcgtacgatgtgacacggtatttttacaaagaatacgaccacttgtttgtcggaacataccaatccgaacaccccggcacatccgtcagcatccaacaatcccacggcggcttcagcaaacaggcattatccgtagccaacggccttcaagccgatgtcgtaaccatgaaccaatcttccgacatcgacctgctcgaaaaaaaggactggtagaaaaaggctggcaacaagccctccccgatcacgccgcaccctacaccagcactatggttttccttgtccgaaaaaacaaccccaaacagatccgcgattggaacgaccttgccaaagacggcgttaacatcgtcatcgccaagacctcgggcaacggacgctacgccttcctcggcgcatacggttacggtctgaaagccaacaacggcaacgagcaggaagcccaaaaactcgtcgcatccatcctcaaaaacacacccgtttttgaaaacggcggacgcgcccgccgccaccaccttcacacaacgcaacatcggcgacgtactcatcacttttgaaaacgaagccaactacgtcagcaaaaaactga

SEQ ID NO: 3822 - protein, 241 aa, Neisseria meningitidis
  VARIANT (1)...(241): Xaa = Any Amino Acid
MKTYAQALYTAALLTACSPAADSNHPSGQNAPANTESDGKNITLLNASYDVTRYFYKEYDHLFVGTYQSEHPGTSVSIQQSHGGFSKQALSVANGLQADVVTMNQSSDIDLLEKXGLVEKGWQQALPDHAAPYTSTMVFLVRKNNPKQIRDWNDLAKDGVNIVIAKTSGNGRYAFLGAYGYGLKANNGNEQEAQKLVASILKNTPVFENGGRXPPPPPSHNATSATYSSLLKTKPTTSAKN

SEQ ID NO: 3823 - DNA, 729 bp, Neisseria meningitidis
atgaaaacctacgcaccggcactctataccgcagccctgctcaccgcctgcagccccgcagccgattcaaaccatccgtccggacaaaatgccccggccaataccgaatccgacggaaaaaacattaccctgctcaacgcctcatacgatgtggcacgggatttttacaaagaatacaaccccttatttatcaaaacataccaatccgaacaccccggcacatccgtcagcatccaacagtcccacggcggctccagcaaacaggcattatccgtagccaacggccttcaagccgatgtcgtaaccatgaaccaatcctccgacatcgacctgctcgaaaaaaaaggactggtagaaaaaggctggcaacaagccctccccgaccacgccgcgccctacaccagcactatggttttccttgtccgaaaaaacaaccccaaacagatccgcgattggaacgaccttgccaaagacggcgttaacatcgtcatcgccaatcccaaaacctcgggcaacggacgctacgccttcctcggcgcatacggttacggtctgaaaaccaccaacggcaacgaacaggaagcccaaaaactcgtcgcatccatcctcaaaaacacccccgtttttgaaaacggcggacgckcgccaccaccaccttcacacaacgcaacatcggcgacgtactcatcacttttgaaaacgaagccaactacgtcagcraaaaactga

SEQ ID NO: 3824 - protein, 242 aa, Neisseria meningitidis
  VARIANT (1)...(242): Xaa = Any Amino Acid
MKTYAPALYTAALLTACSPAADSNHPSGQNAPANTESDGKNITLLNASYDVARDFYKEYNPLFIKTYQSEHPGTSVSIQQSHGGSSKQALSVANGLQADVVTMNQSSDIDLLEKKGLVEKGWQQALPDHAAPYTSTMVFLVRKNNPKQIRDWNDLAKDGVNIVIANPKTSGNGRYAFLGAYGYGLKTTNGNEQEAQKLVASILKNTPVFENGGRXPPPPSHNATSATYSSLLKTKPTTSAKN

SEQ ID NO: 3825 - DNA, 729 bp, Neisseria meningitidis
atgaaaacctacgcaccggcactctataccgcagccctgctcagcgcctgcagccccgcagccgattcaaaccatccgtccggacaaaatgccccggccaataccgaatccgacggaaaaaacattaccctgctcaacgcctcatacgatgtggcacgggatttttacaaagaatacaaccccttatttatcaaaacataccaatccgaacaccccggcacatccgtcagcatccaacagtcccacggcggctccagcaaacaggcattatccgtagccaacggccttcaagccgatgtcgtaaccatgaaccaatcctccgacatcgacctgctcgaaaaaaaaggactggtagaaaaaggctggcaacaagccctccccgaccacgccgcgccctacaccagcactatggttttccttgtccgaaaaaacaaccccaaacagatccgcgattggaacgaccttgccaaagacggcgttaacatcgtcatcgccaatcccaaaacctcgggcaacggacgctacgccttcctcggcgcatacggttacggtctgaaaaccaccaacggcaacgaacaggaagcccaaaaactcgtcgcatccatcctcaaaaacacccccgtttttgaaaacggcggacgcgcgccaccaccaccttcacacaacgcaacatcggcgacgtactcatcacttttgaaaacgaagccaactacgtcagcaaaaaactga

SEQ ID NO: 3826 - protein, 242 aa, Neisseria meningitidis
MKTYAPALYTAALLSACSPAADSNHPSGQNAPANTESDGKNITLLNASYDVARDFYKEYNPLFIKTYQSEHPGTSVSIQQSHGGSSKQALSVANGLQADVVTMNQSSDIDLLEKKGLVEKGWQQALPDHAAPYTSTMVFLVRKNNPKQIRDWNDLAKDGVNIVIANPKTSGNGRYAFLGAYGYGLKTTNGNEQEAQKLVASILKNTPVFENGGRAPPPPSHNATSATYSSLLKTKPTTSAKN

SEQ ID NO: 3827 - DNA, 1464 bp, Neisseria meningitidis
atgaaattgggtttcaaaccgatacccctcgccattgccgcagtattgtgcgccctggttttggcactgcccgtacccgacggggtcaagcctcaggcttggacgctgctggctatgtttgtcggtgtgattgccgccattatcggcaaggttatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaattatcattccaatcccatttcgtcggctatggctattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgctgttcaatttgccaaagaccgtctgagcgagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttctcgctgctgccgtttcactgaatgccccggcgatgccgactgcgctgatgatggcggccgcatccaacattatgatgaccctcactcattatgcgaccggtacttcacctgtgattttcggctcgggctacaccacaatgggagaatggtggaaggcgggttttatcatgagcgtagtcaattttctgattttttccgttatcggcagcatttggtggaaagttctgggatattggtaa

SEQ ID NO: 3828 - protein, 487 aa, Neisseria meningitidis
MKLGFKPIPLAIAAVLCALVLALPVPDGVKPQAWTLLAMFVGVIAAIIGKVMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMAITATAPNPLIVNLIAENLGSSFRLSWGAWAWAMAVPGVIAFFVMPLILYFLYPPEIKETPNAVQFAKDRLSEMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFLAAAVSLNAPAMPTALMMAAASNIMMTLTHYATGTSPVIFGSGYTTMGEWWKAGFIMSVVNFLIFSVIGSIWWKVLGYW

SEQ ID NO: 3829 - DNA, 1464 bp, Neisseria meningitidis
atgaaattgggtttcaaaccgatacccctcgccattgccgcagtattgtgcgccctggttttggcactgcccgtacccgacggggtcaagcctcaggcttggacgctgctggccatgtttgtcggtgtgattgccgccattatcggcaaggccatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaactatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatatttwytgtatccgcctgaaattaaagaaacgcccaatgccgttcaatttgccaaagaccgtctgagggagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttttcgctgctgccgtttcactgaatgccccggcgatgccgaccgcgctgatgatggcggccgcatccaacattatgatgaccctcactcattatgcgaccggtacttcgcctgtgattttcggttcgggctacaccacaatgggagaatggtggaaggcgggttttatcatgagcgtagtcaattttctgatttttttcgttatcggcagcatttggtggaaagttctggggtattggtaa

SEQ ID NO: 3830 - protein, 487 aa, Neisseria meningitidis
  VARIANT (1)...(487): Xaa = Any Amino Acid
MKLGFKPIPLAIAAVLCALVLALPVPDGVKPQAWTLLAMFVGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYXLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 3831 - DNA, 1464 bp, Neisseria meningitidis
atgaaattgggtttcaaaccgatacccctcgccattgccgcagtattgtgcgccttggttttggcactgcccgtacccgacggggtcaagcctcaggcttggacgctgctggccatgtttatcggtgtgattgccgccattatcggcaaggccatgccgttgggtgcgctgtcgattattgccgtcgggttggtcgcagtaaccggcgtaaccgccgacaaaccgggtgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaactatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgccgttcaatttgccaaagaccgtctgagggagatgggtaaaatgtcggcagacgaaatcattatggcggtcattttcggtatcttgttgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttttcgctgctgccgtttcactgaatgccccggcgatgccgaccgcgctgatgatggcggccgcatctaacattatgatgaccctcactcattatgcgaccggtacttcgcctgtgattttcggttcgggctacaccacaatgggagaatggtggaaggcgggttttatcatgagcgtagtcaattttctgatttttttcgttatcggcagcatttggtggaaagttctggggtattggtaa

SEQ ID NO: 3832 - protein, 487 aa, Neisseria meningitidis
MKLGFKPIPLAIAAVLCALVLALPVPDGVKPQAWTLLAMFIGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 3833 - DNA, 483 bp, Neisseria meningitidis
atgaaacttcctttatcctatttgcctaatattcgctttttgtcttggtgctgcttattggcaggtatcattgctcctgctactttgttggcctcccccaaccctgccgaaatccgtatgcagcaagatattcagcaacgccaacgcgaagagcagttgcgccaaaccatgcagcctgaaagcgatgtgcgtttgcatcaaaaaaacacgggggaaacggttaatcagttgatgggcgatgacagcagccaaccgtgttttgccattaacgaatgggtgttggaaggcgaacaccatgctcggtttcagtttgccctaaaacgtgccttgcgcgaaacgggttttcaggctggcaagtgtctgcatgcgggcaacattaatcaaatcatgtccttagcacaaaatgctttgatcggcaggggatataccacgacccgtatcttggctgcgccacaggatttgaatagtggaagcttcaattaa

SEQ ID NO: 3834 - protein, 160 aa, Neisseria meningitidis
MKLPLSYLPNIRFLSWCCLLAGIIAPATLLASPNPAEIRMQQDIQQRQREEQLRQTMQPESDVRLHQKNTGETVNQLMGDDSSQPCFAINEWVLEGEHHARFQFALKRALRETGFQAGKCLHAGNINQIMSLAQNALIGRGYTTTRILAAPQDLNSGSFN

SEQ ID NO: 3835 - DNA, 1437 bp, Neisseria meningitidis
ggcaagtgtctgcatgcgggcgacattaatcaaatcatgtccttagcacaaaatgctttgatcggcaggggatataccacgacccgtatcttggctgcgccacaggatttgaatagtggcaagcttcaattaaccctgatgccgggctatctgcgctccatacgaatcgatcggtccaacgatgatcaaacccatgcaggacgtattgcagcattccaaaacaaatttcccacccgctcgaacgatctgttgaatctgcgtgatttggaacaaggactggaaaatctcaaatgtctcccgactgcggaagccgatctccaaatcgttcccgtagagagagaaccaaaccaaagtgatgtcgtggtgcaatggcggtaacgtctgctgccctactgtgtgagtgtggggatggataattcgggtagtgaggcgacaggaaaataccaaggaaatatcactttctctgccgacaatccttttggactgagtgatatgttctatgtaaattatggacgttcaattggcggtacgcccgatgaggaaaattttgacggccatcgcaaagaaggcggatcaaacaattacgccgtacattattcagcccctttcggtaaatggacatgggcattcaatcacaatggctaccgttaccatcaggcggtttccggattatcggaagtctatgactataatggaaaaagttacaacactgatttcggcttcaaccgcctgttgtatcgtgatgccaaacgcaaaacctatctcagtgtaaaactgtggacgagggaaacaaaaagttacattgatgatgccgaactgactgtacaacggcgtaaaaccacaggttggttggcagaactttcccacaaaggatatatcggtcgcagtacggcagattttaagttgaaatataaacacggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgcctgccgagcggggatggtattggcgcaacgatttgagctggcaatttaaaccaggccatcagctttatcttggggctgatgtaggacatgtttcaggacaatccgccaaatggttatcgggccaaactctagccggcacagcaattgggatacgcgggcagataaagcttggcggcaacctgcattacgatatatttaccggccgtgcattgaaaaagcccgaatattttcagacgaagaaatgggtaacggggtttcaggtgggttattcgttttga

SEQ ID NO: 3836 - protein, 477 aa, Neisseria meningitidis
GKCLHAGDINQIMSLAQNALIGRGYTTTRILAAPQDLNSGKLQLTLMPGYLRSIRIDRSNDDQTHAGRIAAFQNKFPTRSNDLLNLRDLEQGLENLKCLPTAEADLQIVPVEREPNQSDVVVQWRRLLPYCVSVGMDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 3837 - DNA, 1788 bp, Neisseria meningitidis
atgaaacttcctttatcctatttgcctaatattcgctttttgtcttggtgctgcttattggcaggtatcattgctcctgctactttgttggcctcccccaaccctgccgaaatccgtatgcagcaagatattcagcaacgccaacgcgaagagcagttgcgccaaaccatgcagcctgaaagcgatgtgcgtttgcatcaaaaaaacacgggggaaacggttaatcagttgatgggcgatgacagcagccaaccgtgttttgccattaacgaagtggtgttggaaggcgaacaccatgctcggtttcagtttgccctaaaacgtgccttgcgcgaaacgggttttcaggctggcaagtgtctgcatgcgggcaacattaatcaaatcatgtccttagcacaaaatgctttgatcggcaggggatataccacgacccgtatcttggctgcgccacaggatttgaatagtggcaagcttcaattaaccctgataccgagctatctgcgctccatacgaatcgatcggtctaacgatgatcaaacccatgcaggacgtattgcagcattccagaacaaatttcccacccgctcgaacgatctgttgaatctgcgtgatttggaacaaggactggaaaatctcaaacgtctcccgactgcggaagccgatctccaaatcgttcccgtagagggagaaccaaaccaaagtgatgtcgtggtgcaatggcggcaacgtctgctgccctaccgtgtgagtgtggggatggataattcgggtagtgaggcgacaggaaaataccaaggaaatatcactttctctgccgacaatcctttgggactgagtgatatgttctatgtaaattatggacgttcgattggcggtacgcccgatgaggaaagttttgacggccatcgcaaagaaggcggatcaaacaattacgccgtacattattcagcccctttcggtaaatggacatgggcattcaatcacaatggctaccgttaccatcaggcagtttccggattatcggaagtctatgactataatggaaaaagttacaatactgatttcggcttcaaccgcctgttgtatcgtgatgccaaacgcaaaacctatctcggtgtaaaactgtggatgagggaaacaaaaagttacattgatgatgccgaactgactgtacaacggcgtaaaactgcgggttggttggcagaactttcccacaaagaatatatcggtcgcagtacggcagattttaagttgaaatataaacgcggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgtctgccgagcggggatggtattggcgcaacgatttgagctggcaatttaaaccaggccatcagctttatcttggggctgatgtaggacatgtttcaggacaatccgccaaatggttatcgggccaaactctagtcggcacagcaattgggatacgcgggcagataaagcttggcggcaacctgcattacgatatatttaccggccgcgcattgaaaaagcccgaatttttccaatcaaggaaatgggcaagcggttttcaggtaggctatacgttttaa

SEQ ID NO: 3838 - protein, 595 aa, Neisseria meningitidis
MKLPLSYLPNIRFLSWCCLLAGIIAPATLLASPNPAEIRMQQDIQQRQREEQLRQTMQPESDVRLHQKNTGETVNQLMGDDSSQPCFAINEVVLEGEHHARFQFALKRALRETGFQAGKCLHAGNINQIMSLAQNALIGRGYTTTRILAAPQDLNSGKLQLTLIPSYLRSIRIDRSNDDQTHAGRIAAFQNKFPTRSNDLLNLRDLEQGLENLKRLPTAEADLQIVPVEGEPNQSDVVVQWRQRLLPYRVSVGMDNSGSEATGKYQGNITFSADNPLGLSDMFYVNYGRSIGGTPDEESFDGHRKEGGSNNYAVHYSAPFGKWTWAFNHNGYRYHQAVSGLSEVYDYNGKSYNTDFGFNRLLYRDAKRKTYLGVKLWMRETKSYIDDAELTVQRRKTAGWLAELSHKEYIGRSTADFKLKYKRGTGMKDALRAPEEAFGEGTSRMKIWTASADVNTPFQIGKQLFAYDTSVHAQWNKTPLTSQDKLAIGGHHTVRGFDGEMSLSAERGWYWRNDLSWQFKPGHQLYLGADVGHVSGQSAKWLSGQTLVGTAIGIRGQIKLGGNLHYDIFTGRALKKPEFFQSRKWASGFQVGYTF

SEQ ID NO: 3839 - DNA, 612 bp, Neisseria meningitidis
atgaaacccaaattcaaaaccgttttaaccgcgctgcttttggcggtttccctgccgtctatggcggcaacccgcgtcctgatggaaaccgatatgggcaatatccgtttggttttggacgaatccaaagcctccaaaaccgttgccaatttcgtgcgctatgcccgaaaaggcttttacgacaacacgattttccaccgcgtcatcggcggcttcgtcatccaaggcgacggattgaccgaggacttggtgcaaaaggcaaccgataaggccgttgccaacgaatccggcaacggcttgaaaaacaccgtcggcaccatcgcaatggcgcggacggcagcccccgattccgccgccgcccaattctttatcaatctggcggacaacggttcgctcgactacaaaaacggacaatacggctacaccgttttcggcagggtagaaagcggaatggacaccgtttccaaaatcgcccgcgtcaaaaccgccacgcgcggcttttatcaaaacgtacccgtacagcccgtcaaaatccgtcgcgttgttgtcgggcagtaacacgcagacagacgttcagacggcgtcgcccgtttcccaaaaaacgccgtttaa

SEQ ID NO: 3840 - protein, 185 aa, Neisseria meningitidis
MKPKFKTVLTALLLAVSLPSMAATRVLMETDMGNIRLVLDESKASKTVANFVRYARKGFYDNTIFHRVIGGFVIQGDGLTEDLVQKATDKAVANESGNGLKNTVGTIAMARTAAPDSAAAQFFINLADNGSLDYKNGQYGYTVFGRVESGMDTVSKIARVKTATRGFYQNVPVQPVKIRRVVVGQ

SEQ ID NO: 3841 - DNA, 557 bp, Neisseria meningitidis
atgaaacccaaattcaaaaccgttttaaccgcgctgcttttggcggtttccctgccgtctatggcggcaacccatgttttgatggaaaccgatatgggcaatatccgtttggttttggacgaatccaaagcccccaaaaccgttgctaatttcgtgcgctatgcccgaaaaggcttttacgacgacaccgtttttcaccgcgttatcgacggttttgttatccagggcggtggattgaccgaggacttggcacaaaaggcaagcgataaggccgttgccaacgaatccggcaacggcttgaaaaacaccgccggcaccatcgccatggcgcggacgacagcccccgattccgccaccagccaattctttatcaatctggcggaccakcttcgctcgactacaaaaacggacaatacggctataccgttttcggcagggtcgaaagcggcatgaacaccgtttccaaaatcgcccgcgtcaaaaccgccacgcgcggcttttatcaaaacgtacccgtacagcccgtcaaaatccgtcgcgttgttgtcgggcagtaa

SEQ ID NO: 3842 - protein, 185 aa, Neisseria meningitidis
  VARIANT (1)...(185): Xaa = Any Amino Acid
MKPKFKTVLTALLLAVSLPSMAATHVLMETDMGNIRLVLDESKAPKTVANFVRYARKGFYDDTVFHRVIDGFVIQGGGLTEDLAQKASDKAVANESGNGLKNTAGTIAMARTTAPDSATSQFFINLADXXSLDYKNGQYGYTVFGRVESGMNTVSKIARVKTATRGFYQNVPVQPVKIRRVVVGQ

SEQ ID NO: 3843 - DNA, 558 bp, Neisseria meningitidis
atgaaacccaaattcaaaaccgttttaaccgcgctgcttttggcggtttccctgccgtctatggcggcaacccatgttttgatggaaaccgatatgggcaatatccgtttggttttggacgaatccaaagcacccaaaaccgttgccaatttcgtgcgctatgcccgaaaaggcttttacgacaatacgatttttcaccgcgtcatcggcggcttcgttatccaaggcggcggattgaccgaggacttggcacaaaaggcaagcgataaggccgttgccaacgaatccggcaacggcttgaaaaacactgtcggcaccatcgccatggcgcggacggccgatccggattccgccaccagccaattctttatcaatctggtggacaatgattcgctcaactacaaaaacggacaatacggctataccgttttcggcagggtcgaaagcggcatgaacaccgtttccaaaatcgcccgcgtcaaaaccgccacgcgcggcttttatcaaaacgtacccgtacagcccgtcaaaatccgtcgcgttgttgtcgggcagtaa

SEQ ID NO: 3844 - protein, 185 aa, Neisseria meningitidis
MKPKFKTVLTALLLAVSLPSMAATHVLMETDMGNIRLVLDESKAPKTVANFVRYARKGFYDNTIFHRVIGGFVIQGGGLTEDLAQKASDKAVANESGNGLKNTVGTIAMARTADPDSATSQFFINLVDNDSLNYKNGQYGYTVFGRVESGMNTVSKIARVKTATRGFYQNVPVQPVKIRRVVVGQ

SEQ ID NO: 3845 - DNA, 339 bp, Neisseria meningitidis; identical to SEQ ID NO: 3709

SEQ ID NO: 3846 - protein, 112 aa, Neisseria meningitidis; identical to SEQ ID NO: 3710

SEQ ID NO: 3847 - DNA, 689 bp, Neisseria meningitidis
atgaaaaaaatcatcgcctccgcgcttatcgcaacattcgcactcaccgcctgccaagacgacacgcaggcgcggctcgaacggcagcagaaacagattgaagccctgcaacagcagctcgcacagcaggcagacgatacggtttaccaactgactcccgaagcagtcaaagacaccattcctgcccaggcgcaggcaaacggcaacaacggtcagcccgttaccggcaaagacgggcagcagtatatttacgaccaatcgacaggaagctggctgctgcaaagcctgattggcgcggcggcaggcgcgtttatcggcaacgcgctggcaaacaaattcacacgggcgggcaaccaagacagccccgtcgcccgtcgcgcgcgtgctgcctaccatcagtccgcacgccccaatgcgcgcaccagcagggatttgaacacgcgcagcctccgtgcaaaacaacaggcggcgcaggcgcagcgttaccgcccgacaacgcgcccgcccgtcaattaccgccatcgcgctatgcgcggtttcggcagaaggcggtaaacccggcgcgtcaatgccgtctgaagggctttcagacggcatttttgtatttgttaggggcattgttatgttgccgtttgattttcagacggcattttgtttccaagcgtttgatgtcgggatggcaattctga

SEQ ID NO: 3848 - protein, 229 aa, Neisseria meningitidis
MKKIIASALIATFALTACQDDTQARLERQQKQIEALQQQLAQQADDTVYQLTPEAVKDTIPAQAQANGNNGQPVTGKRRAAVYLRPIDRKLAAAKPDWRGGRRVYRQRAGKQIHTGGQPRQPRRPSRACCLPSVRTPQCAHQQGFEHAQPPCKTTGGAGAALPPDNAPARQLPPSRYARFRQKAVNPARQCRLKGFQTAFLYLLGALLCCRLIFRRHFVSKRLMSGWQF

SEQ ID NO: 3849 - DNA, 617 bp, Neisseria meningitidis
  misc_feature (1)...(617): n = A,T,C or G
cggctcgaacagcagcagaaacagattgaagccctgcaacagcagctcgcacagcaggcagacgatacggtttaccaactgactcccgaagcagtcaaagacaccattcctgccgaagcacaggcaaacggcaacaacgggcaacccgttaccggtaaagacgggcagcagtatatttacgaccaatcgacaggaagctggctgctgcaaagcctggtcggcgcggcggcaggcgcgtttatcggcaacgcgctggcaaacaaattcacacgggcaggcaaccaagacagtcccgtcgcccggcgcgcgcgtgcagcctaccatcagtccgcacgccccaatgcgcgcaycagcagggatttgaacacgcgcagcctccgtgcaaaacaacaggcggcgcakgcgcagcgttaccgcccgacaacgcgcccgsccgscaattaccgccgccccgctatgcgcggtttcggcaggaggcggtaaacccggcgcgccaatgccgtctgaagagctttcagacggcatttntgcatttgttagggacattgttatgttgccgtttgattttcagacggcattttgtttccaagcgtttgatgtcgggatggcaattctga

SEQ ID NO: 3850 - protein, 205 aa, Neisseria meningitidis
  VARIANT (1)...(205): Xaa = Any Amino Acid
RLEQQQKQIEALQQQLAQQADDTVYQLTPEAVKDTIPAEAQANGNNGQPVTGXRRAAVYLRPIDRKLAAAKPGRRGGRRVYRQRAGKQIHTGRQPRQSRRPARACSLPSVRTPQCAHQQGFEHAQPPCKTTGGAXAALPPDNAPXRQLPPPRYARFRQEAVNPARQCRLKSFQTAFXHLLGTLLCCRLIFRRHFVSKRLMSGWQF

SEQ ID NO: 3851 - DNA, 689 bp, Neisseria meningitidis
atgaaaaaaatcatcgcctccgcgcttatcgcaacattcgcactcgccgcctgccaagacgacgcgcaggcgcggctcgaacagcagcagaaacagattgaagccctgcaacagcagctcgcacagcaggcagacgatacggtttaccaactgactcccgaagcagtcaaagacaccattcctgccgaagcacaggcaaacggcaacaacgggcaacccgttaccggtaaagacgggcagcagtatatttacgaccaatcgacaggaagctggctgctgcaaagcctggtcggcgcggcggcaggcgcgtttatcggcaacgcgctggcaaacaaattcacacgggcaggcaaccaagacagtcccgtcgcccggcgcgcgcgtgccgcctaccatcagtccgcacatcccaatgcgcgcaccagcagggatttgaacacgcgcagcctccgtgcaaaacaacaggcggcgcaggcgcagcgttaccgcccgacaacgcgcccgcccgccaattaccgccgccccgccatgcgcggtttcggcagaaggcggtaaatccggcgtgccaatgccgtctgaagggctttcagacggcatttttgtatttgttagggacattgttatgttgccgtttgatttttagacggcattttgtttccaagagtttgatgtcgggatggcaattctga

SEQ ID NO: 3852 - protein, 228 aa, Neisseria meningitidis
  VARIANT (1)...(228): Xaa = Any Amino Acid
MKKIIASALIATFALAACQDDAQARLEQQQKQIEALQQQLAQQADDTVYQLTPEAVKDTIPAEAQANGNNGQPVTXRRAAVYLRPIDRKLAAAKPGRRGGRRVYRQRAGKQIHTGRQPRQSRRPARACRLPSVRTSQCAHQQGFEHAQPPCKTTGGAGAALPPDNAPARQLPPPRHARFRQKAVNPACQCRLKGFQTAFLYLLGTLLCCRLIFRRHFVSKSLMSGWQF

SEQ ID NO: 3853 - DNA, 1518 bp, Neisseria meningitidis
atgttgtatttcagatacggctttttggttgtttggtgtgcggcaggtgtttctgccgcctatggggcggatgcgcccgcgattttggatgacaaggcattgttgcaggtgcagcggtcggtgtcggataagtgggcggaatcagattggaaagttgaaaatgatgccccgcgcgtggttgacggggattttttgttggcgcatccgaaaatgttggaacatagtttgcgcgacgcgctcaacggcaatcaggcggatttaatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccggctgaagtcggcagaaaggcattttgcggaggcggcaaaattggatttgccggcaccggttttggaaaatgtggggcgttttcggaaaaaaacggaggggctgacgggctggcgtttttcgggcggcatcagtccggcggtcaatagaaatgccaataatgccgcgccgcaatattgccggcaaaacggaggccggcagatatgcagtgtcagccgggcggagcgggcggcagggttgaattatgaaatcgaggcggaaaagctgacgccgttggcagataatcattatttgttgttccgttccaatatcggcggcacgagctattatttcagtaaaaaatcagcttatgatgacgggttcggcagggcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaacgctaccgcgaacaggatagggcggaatacaataacggcaggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggttgggcgcaggagtggcggcagttgggcggtttgaacagtcgggtttccgcgtcttatgcccgccgcaactataagggcattgcggctttctcgacagaggcgcaacgcaaccgcgaatggaatgtctcgctggctttgagccacgacaagttgtcgtacaaaggtatcgtgccggcgttgaattatcgtttcggcaggacggaaagtaatgtgccgtatgcgaaacgccgcaacagcgaggtgtttgtgtcggcggattggcggttttga

SEQ ID NO: 3854 - protein, 505 aa, Neisseria meningitidis
MLYFRYGFLVVWCAAGVSAAYGADAPAILDDKALLQVQRSVSDKWAESDWKVENDAPRVVDGDFLLAHPKMLEHSLRDALNGNQADLIASLADLYAKLPDYDAVLYGRARALLAKLAGRPAEAVARYRELHGENAADERILLDLAAAEFDDFRLKSAERHFAEAAKLDLPAPVLENVGRFRKKTEGLTGWRFSGGISPAVNRNANNAAPQYCRQNGGRQICSVSRAERAAGLNYEIEAEKLTPLADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGIAAFSTEAQRNREWNVSLALSHDKLSYKGIVPALNYRFGRTESNVPYAKRRNSEVFVSADWRF

SEQ ID NO: 3855 - DNA, 1518 bp, Neisseria meningitidis
atgttgtatttcagatacggttttttggttgtttggtgtgcggcaggtgtttctgccgcctatggggcggatgcgcccgcgattttggatgacaaggcattgttgcaggtgcagcggtcggtgtcggataagtgggcggaatcggattggaaagttgacaatgatgccccgcgcgtggttgacggggattttttgttggcgcatccgaaaatgttggaacatagtttgcgcgacgtgctcaacggcaatcaggcggatttgatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccggctgaagtcggcagaaaggcattttgccgaggcggaaaaattggatttgccggcgccggttttggaaaatgtggggcgttttcggaaaaaagcggaggggctgacgggctggcgtttttcgggcggcatcagtccggcggtcaatagaaatgccaataatgccgcgccgcagtattgccggcaaaacggaggccggcagatatgcagtgtcagccgggcggagcgggcggcaggcttgaattatgaaatcgaggcggaaaaactgacggcgttggcagataatcattatttgttgttccgttccaatatcggcggcacgagctattatttcagtaaaaaatcagcttatgacgacgggttcggcagagcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagttgtcccatacttaccgcccaaacccgggatggcaattttcggtcgcgctggaacattaccgccaacgctaccgcgaacaggatagggcggaatacaataacggtcggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggctgggcgcaggagtggcggcagttgggcggtttgaacagtcgggtttccgcgtcttatgcccgccgcaactataagggcgttgcggctttctcgacagaggcgcaacgcaaccgcgaatggaatgtctcgctggctttgagccacgacaagttgtcgtacaaaggtatcgtgcccgcgttgaattatcgtttcggcaggacggaaagtaatgtgccgtatgcgaaacgccgcaacagcgaggtgtttgtgtcggcggattggcggttttga

SEQ ID NO: 3856 - protein, 505 aa, Neisseria meningitidis
MLYFRYGFLVVWCAAGVSAAYGADAPAILDDKALLQVQRSVSDKWAESDWKVDNDAPRVVDGDFLLAHPKMLEHSLRDVLNGNQADLIASLADLYAKLPDYDAVLYGRARALLAKLAGRPAEAVARYRELHGENAADERILLDLAAAEFDDFRLKSAERHFAEAEKLDLPAPVLENVGRFRKKAEGLTGWRFSGGISPAVNRNANNAAPQYCRQNGGRQICSVSRAERAAGLNYEIEAEKLTALADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGVAAFSTEAQRNREWNVSLALSHDKLSYKGIVPALNYRFGRTESNVPYAKRRNSEVFVSADWRF

SEQ ID NO: 3857 - DNA, 609 bp, Neisseria meningitidis
atgaaacccaaaccacacaccgtccgcaccctgattgccgccgtcctcagccttgccctcggcggctgcttcagcgcagtcgtcggcggggccgccgtcggcgcaaaatccgtcatcgaccgccgaaccaccggcgcgcaaaccgatgacaacgttatggcgttgcgtatcgaaaccaccgcccgttcctacctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtatacaactacattaccgtcgcctccctgccgcgcactgcgggcgacatcgccggcgacacttggaacacgtccaaagtccgcgccacgctgctgggcatcagccccgctacacaggcgcgcgtcaaaatcattacctacggcaatgtaacctacgttatgggcatcctcacccccgaagaacaggcgcagattacccaaaaagtcagcaccaccgtcggcgtacaaaaagtcattaccctctaccaaaactacgtccaacgctga

SEQ ID NO: 3858 - protein, 202 aa, Neisseria meningitidis
MKPKPHTVRTLIAAVLSLALGGCFSAVVGGAAVGAKSVIDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIITYGNVTYVMGILTPEEQAQITQKVSTTVGVQKVITLYQNYVQR

SEQ ID NO: 3859 - DNA, 384 bp, Neisseria meningitidis
atgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgcc

SEQ ID NO: 3860 - protein, 128 aa, Neisseria meningitidis
MKPKPHTVRTLIAAIFSLALSGCVSAVIGSAAVGAKSAVDRRTTGAQTDDNVMALRIETTARSYLRQNNQTKGYTPQISVVGYNRHLLLLGQVATEGEKQFVGQIARSEQAAEGVYNYITVASLPRTA

SEQ ID NO: 3861 - DNA, 609 bp, Neisseria meningitidis
atgaaacccaaaccgcacaccgtccgcaccctgactgccgccgtcctcagccttgccctcggcggctgcgtcagcgcagtcgtcggcggcgcggcggtcggcgcgaaatccgccgtcgaccgccgaaccaccggcgcgcaaaccgacgacaacgtaatggcgctgcgtatcgaaaccaccgcccgctcctatctgcgccaaaacaaccaaaccaaaggctacacgccccaaatctccgttgtcggctacaaccgccacctgctgctgctcggacaagtcgccaccgaaggcgagaaacagttcgtcggtcagattgcacgttccgaacaggccgccgaaggcgtgtacaactacattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctga

SEQ ID NO: 3862 - protein, 202 aa, Neisseria meningitidis
MKPKPHTVRTLTAAVLSLALGGCVSAVVGGAAVGAKSAVDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIVTYGNVTYVMGILTPEEQAQITQKVSTTVGVQKVITLYQNYVQR

SEQ ID NO: 3863 - DNA, 609 bp, Neisseria meningitidis; identical to SEQ ID NO: 3857

SEQ ID NO: 3864 - protein, 202 aa, Neisseria meningitidis; identical to SEQ ID NO: 3858

SEQ ID NO: 3865 - DNA, 609 bp, Neisseria meningitidis
atgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctga

SEQ ID NO: 3866 - protein, 202 aa, Neisseria meningitidis
MKPKPHTVRTLIAAIFSLALSGCVSAVIGSAAVGAKSAVDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIVTYGNVTYVMGILTPEEQAQITQKVSTTVGVQKVITLYQNYVQR

SEQ ID NO: 3867 - DNA, 609 bp, Neisseria meningitidis; identical to SEQ ID NO: 3861

SEQ ID NO: 3868 - protein, 202 aa, Neisseria meningitidis; identical to SEQ ID NO: 3862

SEQ ID NO: 3869 - DNA, 867 bp, Neisseria meningitidis
atgaaaaatattctcttagtatttgttagctttgtgccattatgtgtccgcactgatctgccgctgaatatcgaagacataatgaccgacaagggaaaatggaaactggaaacttcccttacctacctgaacagcgaaaacagccgcgccgcacttgcctcaccggtttacattcagaccggctccgcttcctttatccccgtcccgaccgaaattcaggaaaacggcagcaataccgatatgctcgccggcacgctcggtttgcgctacggactgaccggcaataccgacatttacggcagcggcagctatctgtggcacgaagaacgcaaactcgacggcaacggcaaaacccgcaacaaacggatgtccgacatatccgccggcatcagccacaccttccttaaagacggcaaaaatcccgcactcatcgctttcctcgaaagcacggtttacgaaaaatcgcgcaacaaagcctcgtcgggaaaatcgtggctcatcggcgccaccacctacaaagccatagatccgattgtcctttccctcaccgccgcctaccgcatcaacggcagcaaaaccctttcagacgacgtcaaatacaaagcaggcaattactggatgctgaatcccaacatctcatttgccgccaacgacagaatcagcctgaccggaggcatccaatggctgggcaaacagcccgaccgcatagacggcaaaaaagaatccgcaagaaacacatccacctacgcccatttcggcgcaggtttcggtttcaccaaaaccgcggctttaaacgcatccgcacgtttcaacgtttcagggcaaagcagttccgaactgaaattgggcgtacagcatacattttaa

SEQ ID NO: 3870 - protein, 288 aa, Neisseria meningitidis
MKNILLVFVSFVPLCVRTDLPLNIEDIMTDKGKWKLETSLTYLNSENSRAALASPVYIQTGSASFIPVPTEIQENGSNTDMLAGTLGLRYGLTGNTDIYGSGSYLWHEERKLDGNGKTRNKRMSDISAGISHTFLKDGKNPALIAFLESTVYEKSRNKASSGKSWLIGATTYKAIDPIVLSLTAAYRINGSKTLSDDVKYKAGNYWMLNPNISFAANDRISLTGGIQWLGKQPDRIDGKKESARNTSTYAHFGAGFGFTKTAALNASARFNVSGQSSSELKLGVQHTF

SEQ ID NO: 3871 - DNA, 870 bp, Neisseria meningitidis; identical to SEQ ID NO: 2799

SEQ ID NO: 3872 - protein, 289 aa, Neisseria meningitidis; identical to SEQ ID NO: 2800

SEQ ID NO: 3873 - DNA, 870 bp, Neisseria meningitidis; identical to SEQ ID NO: 2801

SEQ ID NO: 3874 - protein, 289 aa, Neisseria meningitidis; identical to SEQ ID NO: 2802

SEQ ID NO: 3875 - DNA, 222 bp, Neisseria meningitidis
atgaaacgattgactttattggcctttgttttggctgccggtgcggtttccgcctctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaactatcggcatccgcgacgtaaacgcaccc

SEQ ID NO: 3876 - protein, 74 aa, Neisseria meningitidis
MKRLTLLAFVLAAGAVSASPKADVEKGKQVAATVCAACHAADGNSGIAMYPRLAAQHTAYIYHQTIGIRDVNAP

SEQ ID NO: 3877 - DNA, 624 bp, Neisseria meningitidis
atgaaacgattgactttattggcctttgttttggctgccggtgcggtttccgcatctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaaccatcggcatccgcgacggtaaacgcacccacggttcggcagctgtgatgaaaccggtggtaatgaatttgagcgatcaggatattttgaacgtatccgcattctatgccaaacagcagcccaaatccggtgaagccaatcctaaggaaaatcccgaattgggtgcgaaaatctatcgcggcggtttgagcgataaaaaagtgccggcgtgtatgtcctgccacggtccgagcggtgcgggtatgccggggggcggaagcgaaattcaggcttatccgcgtttgggcggtcagcatcaggcatatattgttgaacagatgaatgcctacaagtccggtcagcgtaaaaataccatcatggaagatattgcaaaccgtatgtctgaagaagatttgaaagcggtcgccaactttatccaaggtttgcgttaa

SEQ ID NO: 3878 - protein, 207 aa, Neisseria meningitidis
MKRLTLLAFVLAAGAVSASPKADVEKGKQVAATVCAACHAADGNSGIAMYPRLAAQHTAYIYHQTIGIRDGKRTHGSAAVMKPVVMNLSDQDILNVSAFYAKQQPKSGEANPKENPELGAKIYRGGLSDKKVPACMSCHGPSGAGMPGGGSEIQAYPRLGGQHQAYIVEQMNAYKSGQRKNTIMEDIANRMSEEDLKAVANFIQGLR

SEQ ID NO: 3879 - DNA, 339 bp, Neisseria meningitidis; identical to SEQ ID NO: 3389

SEQ ID NO: 3880 - protein, 112 aa, Neisseria meningitidis; identical to SEQ ID NO: 3390

SEQ ID NO: 3881 - DNA, 309 bp, Neisseria meningitidis; identical to SEQ ID NO: 3391

SEQ ID NO: 3882 - protein, 102 aa, Neisseria meningitidis; identical to SEQ ID NO: 3392

SEQ ID NO: 3883 - DNA, 309 bp, Neisseria meningitidis; identical to SEQ ID NO: 3393

SEQ ID NO: 3884 - protein, 102 aa, Neisseria meningitidis; identical to SEQ ID NO: 3392

SEQ ID NO: 3885 - DNA, 1845 bp, Neisseria meningitidis
atgattatgttacccgcccgtttcactattttatctgtcctcgcagcagccctgcttgccggacaggcgtatgctgccggcgcggcggatgtggagctgccgaaggaagtcggaaaggttttaaggaaacatcggcgttacagcgaggaagaaatcaaaaacgaacgcgcacggcttgcggcagtgggcgaacgggtcaacagggtgtttacgctgttgggcggtgaaacggctttgcagaaagggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagatcgagcctataccgggtgaggcgcaaaaacgggcggggtggctgcggaacgtattgagggaagggggaaatcagcatctggacgggttggaagaggtgctggcgcaatcggacgatgtgcaaaaacgcaggatatttttgctgctggtgcaagccgccgtgcagcagggtggggtggctcaaaaagcatcgaaagcggttcgccgtgcggcgttgaagtatgaacatctgcccgaagcggcggttgccgatgcggtgttcggcgtacagggacgcgaaaaggaaaaggcaatcgaagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcgtaagccggatgatgcctatgcgcgtttgaacgtgctgttggaacacaacccgaatgcaaacctgtatattcaggcggcgatattggcggcaaaccgaaaagaaggtgcgtccgttatcgacggctacgccgaaaaggcatacggcagggggacgggggaacagcggggcagggcggcaatgacggcggcgatgatatatgccgaccgcagggattacgccaaagtcaggcagtggttgaaaaaagtgtccgcgccggaatacctgttcgacaaaggcgtgctggcggctgcggcggctgccgaattggacggaggccgggcggctttgcggcagatcggcagggtgcggaaacttcccgaacagcaggggcggtattttacggcagacaatttgtccaaaatacagatgctcgccctgtcgaagctgcccgacaaacgggaagccctgatcgggctgaacaacatcatcgccaaactttcggcggcgggaagcacggaacctttggcggaagcattggcacagcgttccattatttacgaacagttcggcaaacggggaaaaatgattgccgaccttgaaaccgcgctcaaacttacgcccgataatgcacaaattatgaataatctgggctacagcctgctttccgattccaaacgtttggacgagggtttcgccctgcttcagacggcataccaaatcaacccggacgataccgccgttaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttaggggagacaagaaaatatggcgggagacgctcaaacgctacggaatcgccttgcccgagccttcccgaaaaccccggaaataa

SEQ ID NO: 3886 - protein, 614 aa, Neisseria meningitidis
MIMLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKRAGWLRNVLREGGNQHLDGLEEVLAQSDDVQKRRIFLLLVQAAVQQGGVAQKASKAVRRAALKYEHLPEAAVADAVFGVQGREKEKAIEALQRLAKLDTEILPPTLMTLRLTARKYPEILDGFFEQTDTQNLSAVWQEMEIMNLVSLRKPDDAYARLNVLLEHNPNANLYIQAAILAANRKEGASVIDGYAEKAYGRGTGEQRGRAAMTAAMIYADRRDYAKVRQWLKKVSAPEYLFDKGVLAAAAAAELDGGRAALRQIGRVRKLPEQQGRYFTADNLSKIQMLALSKLPDKREALIGLNNIIAKLSAAGSTEPLAEALAQRSIIYEQFGKRGKMIADLETALKLTPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLRGDKKIWRETLKRYGIALPEPSRKPRK

SEQ ID NO: 3887 - DNA, 1851 bp, Neisseria meningitidis
atgattatgttacctaaccgtttcaaaatgttaactgtgttgacggcaaccttgattgccggacaggtatctgccgccggaggcggtgcgggggatatgaaacagccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctggacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgaaatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacggaggaacagcggagcagggcggcgctaacggcggcgatgatgtatgccgaccgcagggattacgccaaagtcaggcagtggctgaaaaaagtatccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgctcgccctgtcgaagctgcccgataaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctgaccgattccaaacgtttggacgaaggtttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 3888 - protein, 616 aa, Neisseria meningitidis
MIMLPNRFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALKYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTEEQRSRAALTAAMMYADRRDYAKVRQWLKKVSAPEYLFDKGVLAAAAAVELDGGRAALRQIGRVRKLPEQQGRYFTADNLSKIQMLALSKLPDKREALRGLDKIIEKPPAGSNTELQAEALVQRSVVYDRLGKRKKMISDLERAFRLAPDNAQIMNNLGYSLLTDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 3889 - DNA, 1839 bp, Neisseria meningitidis
atgttacccgcccgtttcaccattttatctgtgctcgcggcagccctgcttgccgggcaggcgtatgccgccggcgcggcggatgcgaagccgccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctagacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgagatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacgggggaacagcggggcagggcggcaatgacggcggcgatgatatatgccgaccgaagggattacaccaaagtcaggcagtggttgaaaaaagtgtccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgttcgccctgtcgaagctgcccgacaaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctttccgattccaaacgtttggacgaaggcttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 3890 - protein, 612 aa, Neisseria meningitidis
MLPARFTILSVLAAALLAGQAYAAGAADAKPPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALRYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTGEQRGRAAMTAAMIYADRRDYTKVRQWLKKVSAPEYLFDKGVLAAAAAVELDGGRAALRQIGRVRKLPEQQGRYFTADNLSKIQMFALSKLPDKREALRGLDKIIEKPPAGSNTELQAEALVQRSVVYDRLGKRKKMISDLERAFRLAPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 3891 - DNA, 609 bp, Neisseria meningitidis
ttgtcttatcgtttgaatgctgcaccgatgtttaacgataatcctgttgtttacggaaaaatcaaattgcagagttggaaagcgcggcgggatttcaatattgtaaagcaggatttggatttttcctgcggggcggcttcggtggcgacgcttttgaacaatttttacgggcaaaagctgacggaagaagaagtgttggaaaaactgggtaaggaacagatgcgcgcgtcgtttgaggatatgcggcgcattatgcccgatttgggttttgaggcgaaaggctatgccctgtctttcgaacagctcgcgcagttgaaaatccccgtcatcgtgtatctgaaataccgcaaagacgaccatttttcggtattgcgcggagtggatggcaatacggttttgcttgccgacccgtcgccgggtcatgtttcgatgagcagggcgcagtttttggaggcttggcaaacccgtgagggaaatttggcaggcaaaattttggcggtcgtgccgaaaaaagcggaggcgatttcaaataaattgtttttcacacatcatcccaagcggcagacggagtttgcagtcggacaggtaaaatggtggcgtgcttattga

SEQ ID NO: 3892 - protein, 202 aa, Neisseria meningitidis
LSYRLNAAPMFNDNPVVYGKIKLQSWKARRDFNIVKQDLDFSCGAASVATLLNNFYGQKLTEEEVLEKLGKEQMRASFEDMRRIMPDLGFEAKGYALSFEQLAQLKIPVIVYLKYRKDDHFSVLRGVDGNTVLLADPSPGHVSMSRAQFLEAWQTREGNLAGKILAVVPKKAEAISNKLFFTHHPKRQTEFAVGQVKWWRAY

SEQ ID NO: 3893 - DNA, 657 bp, Neisseria meningitidis
atgatgaagttcaaatatgtttttctgttggcgtgtgttgtcgtttctttatcttatcgtttgaatgctgcaccgatgtttaacgataatcctgttgtttacggaaaaatcaaagtgcagagttggaaagcgcggcgggatttcaatattgtaaagcaggatttggatttttcctgtggggcggcttcggtggcgacgcttttgaacaatttttacgggcaaacgctgacggaagaagaagtgttgaaaaagctggataaggagcagatgcgcgcgtcgtttgaggatatgcggcgcattatgcctgatttgggttttgaggcgaagggctatgccctgtctttcgagcagctcgcgcagttgaaaatccccgtcatcgtgtatctgaaataccgcaaagacgaccatttttcggtattgcgcggtatagacggcaatacggttttgcttgccgacccgtcgctggggcatgtttcaatgagcagggcgcagtttttggatgcttggcaaacccgtgagggaaatttggcaggtaagattttggctgtcataccgaaaaaagccgagacaatttcaaataaattgtttttcacacaacacccaaaacggcagacggagtttacagtcggacaaatcaggcaagcacgtgcagagtaa

SEQ ID NO: 3894 - protein, 218 aa, Neisseria meningitidis
MMKFKYVFLLACVVVSLSYRLNAAPMFNDNPVVYGKIKVQSWKARRDFNIVKQDLDFSCGAASVATLLNNFYGQTLTEEEVLKKLDKEQMRASFEDMRRIMPDLGFEAKGYALSFEQLAQLKIPVIVYLKYRKDDHFSVLRGIDGNTVLLADPSLGHVSMSRAQFLDAWQTREGNLAGKILAVIPKKAETISNKLFFTQHPKRQTEFTVGQIRQARAE

SEQ ID NO: 3895 - DNA, 657 bp, Neisseria meningitidis
  misc_feature (1)...(657): n = A,T,C or G
atgatgaagttcaaatatgtttttctgttggcgtgtgttgtcgtttctttatcttatcgtttgaatgctgcaccgatgtttaacgataatcctgttgtttacggaaaaatcaaagtgcagagttggaaagaaaggcgggatttcaatattgtaaagcaggatttggatttttcctgcggggcggcttcggtggcgacgcttttgaacaatttttacgggcaaacgctgacggaagaagaagtgttgaaaaagctggataaggagcagatgcgcgcgtcgtttgaggatatgcggcgcattatgccagatttgggttttgaagcgaaaggctatgccctgtctttcgagcagctcgcacagttgaaaatccccgtcatcgtgtatctgaaataccgcaaggatgatcatttctcggtattgcgcgggatagacggcaatacggttttgcttgccgacccgtcgctgggtcatgtttcaatgagcagggcgcagttttnggatgcttggcaaacccgtgagggaaatttggcaggtaagattttggcggtcgtgccgaaaaaagccgagacaatttcaaataaattgtttttcacacatcatcccaagcggcagacggagtttgcagtcggacaaatcaggcaagcacgtgcagagtaa

SEQ ID NO: 3896 - protein, 218 aa, Neisseria meningitidis
  VARIANT (1)...(218): Xaa = Any Amino Acid
MMKFKYVFLLACVVVSLSYRLNAAPMFNDNPVVYGKIKVQSWKERRDFNIVKQDLDFSCGAASVATLLNNFYGQTLTEEEVLKKLDKEQMRASFEDMRRIMPDLGFEAKGYALSFEQLAQLKIPVIVYLKYRKDDHFSVLRGIDGNTVLLADPSLGHVSMSRAQFXDAWQTREGNLAGKILAVVPKKAETISNKLFFTHHPKRQTEFAVGQIRQARAE

SEQ ID NO: 3897 - DNA, 561 bp, Neisseria meningitidis
atgaaaaaaatcatcttcgccgcgctcgcagcggcagccgtcggcactgcctccgccacctacaaagtggacgaatatcacgccaacgtccgtttcgccatcgaccacttcaacaccagcaccaacgtcggcggtttttacggtctgaccggttccgtcgagttcgatcaagcaaaacgcgacggcaaaatcgacatcaccattcccgtcgccaacctgcaaagcggttcgcaacccttcaccggccacctgaaatccgccgacatcttcgatgccgctcaatatccggacatccgcttcgtttccaccaaattcaacttcaacggcaaaaaacttgtttccgttgacggcaacctgaccatgcgcggcaaaaccgcccccgtcaaactcaaagccgaaaaattcaactgctaccaaagcccgatggcggaaaccgaagtttgcggcggcgacttcagcaccaccatcgaccgcaccaaatggggcgtggactacctcgttaacgccggtatgaccaaaaacgtccgcatcgacatccaaatcgaagctgcaaaacaataa

SEQ ID NO: 3898 - protein, 186 aa, Neisseria meningitidis
MKKIIFAALAAAAVGTASATYKVDEYHANVRFAIDHFNTSTNVGGFYGLTGSVEFDQAKRDGKIDITIPVANLQSGSQPFTGHLKSADIFDAAQYPDIRFVSTKFNFNGKKLVSVDGNLTMRGKTAPVKLKAEKFNCYQSPMAETEVCGGDFSTTIDRTKWGVDYLVNAGMTKNVRIDIQIEAAKQ

SEQ ID NO: 3899 - DNA, 564 bp, Neisseria meningitidis
atgaaaaaaatcatcttcgccgcactcgcagccgccgccatcagtactgcctccgccgccacctacaaagtggacgaatatcacgccaacgcccgtttcgccatcgaccatttcaacaccagcaccaacgtcggcggtttttacggtctgaccggttccgtcgagttcgaccaagcaaaacgcgacggtaaaatcgacatcaccatccccattgccaacctgcaaagcggttcgcaacactttaccgaccacctgaaatcagccgacatcttcgatgccgcccaatatccggacatccgctttgtttccaccaaattcaacttcaacggcaaaaaactggtttccgttgacggcaacctgaccatgcacggcaaaaccgcccccgtcaaactcaaagccgaaaaattcaactgctaccaaagcccgatggagaaaaccgaagtttgtggcggcgacttcagcaccaccatcgaccgcaccaaatggggcatggactacctcgttaacgttggtatgaccaaaagcgtccgcatcgacatccaaatcgaggcagccaaacaataa

SEQ ID NO: 3900 - protein, 187 aa, Neisseria meningitidis
MKKIIFAALAAAAISTASAATYKVDEYHANARFAIDHFNTSTNVGGFYGLTGSVEFDQAKRDGKIDITIPIANLQSGSQHFTDHLKSADIFDAAQYPDIRFVSTKFNFNGKKLVSVDGNLTMHGKTAPVKLKAEKFNCYQSPMEKTEVCGGDFSTTIDRTKWGMDYLVNVGMTKSVRIDIQIEAAKQ

SEQ ID NO: 3901 - DNA, 564 bp, Neisseria meningitidis
atgaaaaaaatcatcatcgccgcgctcgcagcagccgccatcggcactgcctccgccgccacctacaaagtggacgaatatcacgccaacgcccgtttctctatcgaccatttcaacaccagcaccaacgtcggcggtttttacggtctgaccggttccgttgagttcgaccaagcaaaacgcgacggtaaaatcgacatcaccatccccgttgccaacctgcaaagcggttcgcaacactttaccgaccacctgaaatcagccgacatcttcgatgccgcccaatatccggacatccgctttgtttccaccaaattcaacttcaacggcaaaaaactggtttccgttgacggcaacctgaccatgcacggcaaaaccgcccccgtcaaactcaaagccgaaaaattcaactgctaccaaagcccgatgttgaaaaccgaagtttgcggcggcgacttcagcaccaccatcgaccgcaccaaatggggcatggactacctcgttaacgttggtatgaccaaaagcgtccgcatcgacatccaaatcgaggcagccaaacaataa

SEQ ID NO: 3902 - protein, 187 aa, Neisseria meningitidis
MKKIIIAALAAAAIGTASAATYKVDEYHANARFSIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMLKTEVCGGDFSTTIDRTKWGMDYLVNVGMTKSVRIDIQIEAAKQ

SEQ ID NO: 3903 - DNA, 477 bp, Neisseria meningitidis
atgaaaaagttttattttgtgctgctggcgttgggtttggcagcgtgtgggcaagaacaatcgcagaaagctgatgcggagcagtatttttttgccaataaatatcaatttgcagatgagaaacaggctttttattttgaacgcgccgcccgtttccgtgtattgcaacaaggccttggcggggattttgagaggtttttaaaaggagaaatacctaatcaagaaaatcttgcaaagtatcgtgaaaatattactcaagcagtcgcttattatgcggacacgaatggagatgatgacccataccgcgtctgcaaacaggctgcgcaagatgcagaaatcctgatgaagagtatggtaacaagcggtggaggcggtacaactgatttagataaggaaagttatcaaaattaccgaaaatcaatgcaagaatgccgtaaaacaataacggaagctgaagccaatttgccgaaaaaataa

SEQ ID NO: 3904 - protein, 158 aa, Neisseria meningitidis
MKKFYFVLLALGLAACGQEQSQKADAEQYFFANKYQFADEKQAFYFERAARFRVLQQGLGGDFERFLKGEIPNQENLAKYRENITQAVAYYADTNGDDDPYRVCKQAAQDAEILMKSMVTSGGGGTTDLDKESYQNYRKSMQECRKTITEAEANLPKK

SEQ ID NO: 3905 - DNA, 993 bp, Neisseria meningitidis
atgtttaaaaaattcaaaccggtactgttgtcattttttgcacttgtatttgccttttggctgggaacaggtattgcctatgagattaatccgcgttggtttttgagcgatacggcaactgaagtacctgaaaatccgaatgcttttgtggcgaaacttgcccgcctgttccgaaatgccgacagggcggttgtcatcgtgaaggaatcgatgaggacggaggaaagccttgccggagctgtggatgacggtccgttgcagtcggagaaggattatctcgcgctcgctatccggctcagtcgtttgaaagaaaaggcgaaatggtttcacgtaacggagcaggaacatggggaagaggtttggctggattactatatcggcgagggcggtttggttgcggtttcgctttcgcaacgctcgccggaagcgtttgttaatgccgaatatctgtatcggaacgatcgtccgttttctgtaaatgtgtacggcggaacggctcacggggaaaattatgaaacgacaggagaatatcgggttgtttggcaaccggacggttcggtatttgatgcggcggggcgcgggaaaatcggggaagatgtttatgagcattgcctcgggtgttatcagatggcccaggtatatttggcgaaataccgggatgtcgcgaatgacgagcagaaggtttgggacttccgcgaagagagcaaccggattgcatcggactcgcgcgattatgtgttttatcagaatatgcgggaattgatgccccgggggatgaaggcgaacagtcttgtggtcggctatgatgcggacggtctgccgcaaaaagtctattggagtgtcgacaatggaaaaaaaccccaaagtgtcgaatattatttgaaaaacggaaatctttttattgcccaatcttcgacggtaaccttgaaaacggatggcgtaacggcggatatgcaaacctatcatgcgcaacaaacgttgtatttggatggg

SEQ ID NO: 3906 - protein, 331 aa, Neisseria meningitidis
MFKKFKPVLLSFFALVFAFWLGTGIAYEINPRWFLSDTATEVPENPNAFVAKLARLFRNADRAVVIVKESMRTEESLAGAVDDGPLQSEKDYLALAIRLSRLKEKAKWFHVTEQEHGEEVWLDYYIGEGGLVAVSLSQRSPEAFVNAEYLYRNDRPFSVNVYGGTAHGENYETTGEYRVVWQPDGSVFDAAGRGKIGEDVYEHCLGCYQMAQVYLAKYRDVANDEQKVWDFREESNRIASDSRDYVFYQNMRELMPRGMKANSLVVGYDADGLPQKVYWSVDNGKKPQSVEYYLKNGNLFIAQSSTVTLKTDGVTADMQTYHAQQTLYLDG

SEQ ID NO: 3907 - DNA, 1134 bp, Neisseria meningitidis; identical to SEQ ID NO: 3441

SEQ ID NO: 3908 - protein, 377 aa, Neisseria meningitidis; identical to SEQ ID NO: 3442

SEQ ID NO: 3909 - DNA, 1125 bp, Neisseria meningitidis; identical to SEQ ID NO: 3443

SEQ ID NO: 3910 - protein, 374 aa, Neisseria meningitidis; identical to SEQ ID NO: 3444

SEQ ID NO: 3911 - DNA, 2406 bp, Neisseria meningitidis
ttggctcgtttattttcactcaaaccactggtgctggcattgggcttctgtttcggcacgcattgcgccgccgataccgttgcggcggaagaggcggacgggcgtgtcgcagaaggcggtgcgcagggcgcgtccgaatccgcacaagcttccgatttgaccctcggttcgacctgcctgttttgcagtaacgaaagcggcagccccgagagaaccgaagccgccgtccaaggcagcggcgaagcatccgtccccgaagactatacgcgcattgttgccgacaggatggaaggacagtcgaaggttaaggtgcgcgcggaaggaagcgttatcatcgaacgggacggcgcagtcctcaataccgattgggcggattacgaccagtcgggcgacaccgttaccgtaggcgaccggttcgccctccaacaggacggtacgctgattcggggcgaaaccctgacctacaatctcgatcagcagaccggcgaagcgcacaacgtccgtatggaaaccgaacaaggcggacggcggctgcaaagcgtcagccgcaccgccgaaatgttgggcgaagggcgttacaaactgacggaaacccaattcaacacctgttccgccggagatgccggctggtatgtcaaggccgcctctgtcgaagccgatcggggaaaaggcataggcgttgccaaacacgccgccttcgtgttcggcggcgttccccttttctatacgccttgggcggacttcccgcttgacggcaaccgcaaaagcggactgctcgtcccgtccgtatctgccggttcggacggcgtttccctttccgtcccctattatttcaaccttgcccccaacttcgatgccactttcgcccccggcattatcggcgaacgcggcgcgacgtttgacggacaaatccgttacctgcgtcccgattacagcggacagaccgacctgacctggttgccgcacgataagaaaagcggcaggaacaaccgctatcaggcaaaatggcagcaccggcacgacatttccgacacgcttcaggcgggtgtcgatttcaaccaagtctccgacagcggctactaccgcgacttttacggcggcgaagaaatcgccggcaacgtcaacctcaaccgccgcgtatggctggattatggcggcagggcggcgggaggcagcctgaatgccggcctttcggttcagaaataccagacgctggcaaaccaaagcggctacaaagacgaaccttacgccatcatgccccgcctttctgccgattggcataaaaacgcaggcagggcgcaaatcggcgtgtccgcacaatttacccgcttcagccacgacggccgccaagacggcagccgactggtcgtgtatcccggtatcaaatgggatttcagcaacagctggggctacgtccgccccaaactcgggctgcacgccacttattacagcctcgacagtttcggcggcaaagcatcccgcagcgtcgggcgcgttttgcccgttgtcaatatcgacggcggcacaaccttcgaacgcaatacgcgcctgttcggcggcggagtcgtgcaaaccatcgagccgcgcctgttctacaactatattcctgccaaatctcaaaacgacctgcccaatttcgattcgtcggaaagcagcttcggctacgggcagcttttccgcgaaaacctctattacggcaacgaccgcatcaacgccgccaacagcctttccaccgccgtgcagagccgtattttggacggcgcgacgggggaggagcgtttccgcgccggtatcggtcagaaattctatttcaaggatgatgcggtgatgcttgacggcagcgtcggcaaaaatccgcgcagccgttccgactgggtggcattcgcctccggcggcataggcgggcgtttcaccctcgacagcagcatccactacaaccaaaacgacaaacgcgccgaacattacgccgtcggcgcaggctaccgccccgcccccggaaaagtgttgaacgcccgctacaaatacgggcgcaacgaaaaaatctacctgcaggcggacggttcctatttttacgacaaactcagccagctcgacctgtccgcacaatggccgctgacgcgcaacctgtctgccgtcgtccgctacaactacggttttgaagccaaaaaaccgatagaaatgcttgccggtgcagaatacaaaagcagttgcggctgctggggcgcgggcgtgtacgcccaacgctacgttaccggcgaaaacacctacaaaaacgccgtctttttttcacttcagttgaaagacctcagcagcgtcggcagaaaccccgcaggcaggatggatgtcgccgttcccggctacatccccgcccactctctttccgccggacgcaacaaacggccctga

SEQ ID NO: 3912 - protein, 801 aa, Neisseria meningitidis
LARLFSLKPLVLALGFCFGTHCAADTVAAEEADGRVAEGGAQGASESAQASDLTLGSTCLFCSNESGSPERTEAAVQGSGEASVPEDYTRIVADRMEGQSKVKVRAEGSVIIERDGAVLNTDWADYDQSGDTVTVGDRFALQQDGTLIRGETLTYNLDQQTGEAHNVRMETEQGGRRLQSVSRTAEMLGEGRYKLTETQFNTCSAGDAGWYVKAASVEADRGKGIGVAKHAAFVFGGVPLFYTPWADFPLDGNRKSGLLVPSVSAGSDGVSLSVPYYFNLAPNFDATFAPGIIGERGATFDGQIRYLRPDYSGQTDLTWLPHDKKSGRNNRYQAKWQHRHDISDTLQAGVDFNQVSDSGYYRDFYGGEEIAGNVNLNRRVWLDYGGRAAGGSLNAGLSVQKYQTLANQSGYKDEPYAIMPRLSADWHKNAGRAQIGVSAQFTRFSHDGRQDGSRLVVYPGIKWDFSNSWGYVRPKLGLHATYYSLDSFGGKASRSVGRVLPVVNIDGGTTFERNTRLFGGGVVQTIEPRLFYNYIPAKSQNDLPNFDSSESSFGYGQLFRENLYYGNDRINAANSLSTAVQSRILDGATGEERFRAGIGQKFYFKDDAVMLDGSVGKNPRSRSDWVAFASGGIGGRFTLDSSIHYNQNDKRAEHYAVGAGYRPAPGKVLNARYKYGRNEKIYLQADGSYFYDKLSQLDLSAQWPLTRNLSAVVRYNYGFEAKKPIEMLAGAEYKSSCGCWGAGVYAQRYVTGENTYKNAVFFSLQLKDLSSVGRNPAGRMDVAVPGYIPAHSLSAGRNKRP

SEQ ID NO: 3913 - DNA, 2409 bp, Neisseria meningitidis
ttggctcgtttattttcactcaaaccactggtgctggcattgggcctctgcttcggcacgcattgcgccgccgccgatgccgttgcggcggaggaaacggacaatccgaccgccggagaaagcgttcggagcgtgtccgaacccatacagcctaccagcctgagcctcggttcgacctgcctgttttgcagtaacgaaagcggcagccccgagagaaccgaagccgccgtccaaggcagcggcgaagcatccatccccgaagactatacgcgcattgttgccgacaggatggaaggacagtcgcaggtgcaggtgcgtgccgaaggcaacgtcgtcgtcgaacgcaaccggacgaccctcaataccgattgggcggattacgaccagtcgggcgacaccgttaccgcaggcgaccggttcgccctccaacaggacggtacgctgattcggggcgaaaccctgacctacaatctcgagcagcagaccggggaagcgcacaacgtccgcatggaaatcgaacaaggcggacggcggctgcaaagcgtcagccgcaccgccgaaatgttgggcgaagggcattacaaactgacggaaacccaattcaacacctgttccgccggcgatgccggctggtatgtcaaggcagcctctgtcgaagccgatcgggaaaaaggcataggcgttgccaaacacgccgccttcgtgttcggcggcgttcccattttctacaccccttgggcggacttcccgcttgacggcaaccgcaaaagcggcctgcttgttccctcactgtccgccggttcggacggcgtttccctttccgttccctattatttcaaccttgcccccaatctcgatgccacgttcgcgcccagcgtgatcggcgaacgcggcgcggtctttgacgggcaggtacgctacctgcggccggattatgccggccagtccgacctgacctggctgccgcacgacaagaaaagcggcaggaataaccgctatcaggcgaaatggcagcatcggcacgacatttccgacacgcttcaggcgggtgtcgatttcaaccaagtctccgacagcggctactaccgcgacttttacggcaacaaagaaatcgccggcaacgtcaacctcaaccgccgtgtatggctggattatggcggcagggcggcgggcggcagcctgaatgccggcctttcggttctgaaataccagacgctggcaaaccaaagcggctacaaagacaaaccgtatgccctcatgccgcgcctttcggtcgagtggcgtaaaaacaccggcagggcgcaaatcggcgtgtccgcacaatttacccgattcagccacgacagccgccaagacggcagccgcctggtcgtctatcccgacatcaaatgggatttcagcaacagctggggctatgtccgtcccaaactcggactgcacgccacctattacagcctcaaccgcttcggcagccaagaagcccgacgcgtcagccgcactctgcccattgtcaacatcgacagcggcgcaacttttgagcggaatacgcggatgttcggcggagaagtcctgcaaaccctcgagccgcgcctgttctacaactatattcctgccaaatcccaaaacgacctgcccaatttcgattcgtcggaaagcagcttcggctacgggcagctctttcgcgaaaacctctattacggcaacgacaggattaacaccgcaaacagcctttccgccgccgtgcaaagccgtattttggacggcgcgacgggggaagagcgtttccgcgccggcatcggtcagaaattctatttcaaggatgatgcggtgatgcttgacggcagcgtcggcaaaaaaccgcgcaaccgttccgactgggtggcatttgcctccggcagcatcggcagccgcttcatcctcgacagcagcatccactacaaccaaaacgacaaacgcgccgagaactacgccgtcggtgcaagctaccgtcccgcacagggcaaagtgctgaacgcccgctacaaatacgggcgcaacgaaaaaatctacctgaagtccgacggttcctatttttacgacaaactcagccagctcgacctgtccgcacaatggccgctgacgcgcaacctgtcggccgtcgtccgttacaactacggttttgaagccaaaaaaccgatagaggtgctggcgggtgcggaatacaaaagcagttgcggctgctggggcgcgggcgtgtacgcccaacgctacgttaccggcgaaaacacctacaaaaacgctgtctttttctcacttcagttgaaagacctcagcagtgtcggcagaaaccccgcagacaggatggatgtcgccgttcccggctatatcaccgcccactctctttccgccggacgcaacaaacgaccctga

SEQ ID NO: 3914 - protein, 802 aa, Neisseria meningitidis
LARLFSLKPLVLALGLCFGTHCAAADAVAAEETDNPTAGESVRSVSEPIQPTSLSLGSTCLFCSNESGSPERTEAAVQGSGEASIPEDYTRIVADRMEGQSQVQVRAEGNVVVERNRTTLNTDWADYDQSGDTVTAGDRFALQQDGTLIRGETLTYNLEQQTGEAHNVRMEIEQGGRRLQSVSRTAEMLGEGHYKLTETQFNTCSAGDAGWYVKAASVEADREKGIGVAKHAAFVFGGVPIFYTPWADFPLDGNRKSGLLVPSLSAGSDGVSLSVPYYFNLAPNLDATFAPSVIGERGAVFDGQVRYLRPDYAGQSDLTWLPHDKKSGRNNRYQAKWQHRHDISDTLQAGVDFNQVSDSGYYRDFYGNKEIAGNVNLNRRVWLDYGGRAAGGSLNAGLSVLKYQTLANQSGYKDKPYALMPRLSVEWRKNTGRAQIGVSAQFTRFSHDSRQDGSRLVVYPDIKWDFSNSWGYVRPKLGLHATYYSLNRFGSQEARRVSRTLPIVNIDSGATFERNTRMFGGEVLQTLEPRLFYNYIPAKSQNDLPNFDSSESSFGYGQLFRENLYYGNDRINTANSLSAAVQSRILDGATGEERFRAGIGQKFYFKDDAVMLDGSVGKKPRNRSDWVAFASGSIGSRFILDSSIHYNQNDKRAENYAVGASYRPAQGKVLNARYKYGRNEKIYLKSDGSYFYDKLSQLDLSAQWPLTRNLSAVVRYNYGFEAKKPIEVLAGAEYKSSCGCWGAGVYAQRYVTGENTYKNAVFFSLQLKDLSSVGRNPADRMDVAVPGYITAHSLSAGRNKRP

SEQ ID NO: 3915 - DNA, 2409 bp, Neisseria meningitidis
ttggctcgtttattttcactcaaaccactggtgctggcattgggcttctgtttcggcacgcattgcgccgccgccgatgccgttgcggcggaggaaacggacaatccgaccgccggaggaagcgttcggagcgtgtccgaacccatacagcctaccagcctgagcctcggttcgacctgcctgttttgcagtaacgaaagcggcagccccgagagaaccgaagccgccgtccaaggcagcggcgaagcatccatccccgaagactatacgcgcattgttgccgacaggatggaaggacagtcgcaggtgcaggtgcgtgccgaaggcaacgtcgtcgtcgaacgcaatcggacgaccctcaatgccgattgggcggattacgaccagtcgggcgacaccgttaccgcaggcgaccggttcgccctccaacaggacggtacgctgattcggggcgaaaccctgacctacaatctcgagcagcagaccggggaagcgcacaacgtccgtatggaaaccgaacacggcggacggcggctgcaaagcgtcagccgcaccgccgaaatgttgggcgaagggcattacaaactgacggaaacccaattcaacacctgttccgccggcgatgccggctggtatgtcaaggccgcttccgtcgaagccgatcgggaaaaaggcataggcgttgccaaacacgccgccttcgtgttcggcggcgttcccattttctacaccccttgggcggacttcccgcttgacggcaaccgcaaaagcggcctgctcgttccctcactgtccgccggttcggacggcgtttccctttccgttccctattatttcaaccttgcccccaatctcgatgccacgttcgcgcccggcgtgatcggcgaacgcggcgcggtctttgacgggcaggtacgctacctgcggccggattatgccggccagtccgacctgacctggctgccgcacgacaagaaaagcggcaggaataaccgctatcaggcgaaatggcagcaccggcacgacatttccgacacgcttcaggcgggtgtcgatttcaaccaagtctccgacagcggctactaccgcgacttttacggcaacaaagaaatcgccggcaacgtcaacctcaaccgccgtgtatggctggattatggcggcagggcggcgggcggcagcctgaatgccggcctttcggttctgaaataccagacgctggcaaaccaaagcggctacaaagacaaaccgtatgccctgatgccgcgcctttccgccgattggcgcaaaaacaccggcagggcgcaaatcggcgtgtccgcccaatttacccgcttcagccacgacagccgccaagacggcagccgcctcgtcgtctatcccgacatcaaatgggatttcagcaacagctggggttacgtccgtcccaaactcggactgcacgccacctattacagcctcaaccgcttcggcagccaagaagcccgacgcgtcagccgcactctgcccatcgtcaacatcgacagcggcatgaccttcgaacgcaatacgcggatgttcggcggcggagtcctgcaaaccctcgagccgcgcctgttctacaactatattcctgccaaatcccaaaacgacctgcccaatttcgattcgtcggaaagcagcttcggctacgggcagctttttcgtgaaaacctctattacggcaacgacaggattaacaccgcaaacagcctttccgccgccgtgcaaagccgtattttggacggcgcgacgggggaagagcgtttccgcgccggcatcgggcagaaattctacttcaaaaacgacgcagtcatgcttgacggcagtgtcggcaaaaaaccgcgcagccgttccgactgggtggcattcgcctccagcggcatcggcagccgcttcatcctcgacagcagcatccactacaaccaaaacgacaaacgcgccgagaactacgccgtcggtgcaagctaccgtcccgcacagggcaaagtgctgaacgcccgctacaaatacgggcgcaacgaaaaaatctacctgaagtccgacggttcctatttttacgacaaactcagccagctcgacctgtccgcacaatggccgctgacgcgcaacctgtcggccgtcgtccgttacaactacggttttgaagccaaaaaaccgatagaggtgctggcgggtgcggaatacaaaagcagttgcggctgctggggcgcgggcgtgtacgcccaacgctacgttaccggcgaaaacacctacaaaaacgctgtctttttctcacttcagttgaaagacctcagcagtgtcggcagaaaccccgcagacaggatggatgtcgccgttcccggctatatccccgcccactctctttccgccggacgcaacaaacggccctga

SEQ ID NO: 3916 - protein, 802 aa, Neisseria meningitidis
LARLFSLKPLVLALGFCFGTHCAAADAVAAEETDNPTAGGSVRSVSEPIQPTSLSLGSTCLFCSNESGSPERTEAAVQGSGEASIPEDYTRIVADRMEGQSQVQVRAEGNVVVERNRTTLNADWADYDQSGDTVTAGDRFALQQDGTLIRGETLTYNLEQQTGEAHNVRMETEHGGRRLQSVSRTAEMLGEGHYKLTETQFNTCSAGDAGWYVKAASVEADREKGIGVAKHAAFVFGGVPIFYTPWADFPLDGNRKSGLLVPSLSAGSDGVSLSVPYYFNLAPNLDATFAPGVIGERGAVFDGQVRYLRPDYAGQSDLTWLPHDKKSGRNNRYQAKWQHRHDISDTLQAGVDFNQVSDSGYYRDFYGNKEIAGNVNLNRRVWLDYGGRAAGGSLNAGLSVLKYQTLANQSGYKDKPYALMPRLSADWRKNTGRAQIGVSAQFTRFSHDSRQDGSRLVVYPDIKWDFSNSWGYVRPKLGLHATYYSLNRFGSQEARRVSRTLPIVNIDSGMTFERNTRMFGGGVLQTLEPRLFYNYIPAKSQNDLPNFDSSESSFGYGQLFRENLYYGNDRINTANSLSAAVQSRILDGATGEERFRAGIGQKFYFKNDAVMLDGSVGKKPRSRSDWVAFASSGIGSRFILDSSIHYNQNDKRAENYAVGASYRPAQGKVLNARYKYGRNEKIYLKSDGSYFYDKLSQLDLSAQWPLTRNLSAVVRYNYGFEAKKPIEVLAGAEYKSSCGCWGAGVYAQRYVTGENTYKNAVFFSLQLKDLSSVGRNPADRMDVAVPGYIPAHSLSAGRNKRP

SEQ ID NO: 3917 - DNA, 327 bp, Neisseria meningitidis; identical to SEQ ID NO: 3491

SEQ ID NO: 3918 - protein, 108 aa, Neisseria meningitidis; identical to SEQ ID NO: 3492

SEQ ID NO: 3919 - DNA, 327 bp, Neisseria meningitidis; identical to SEQ ID NO: 3493

SEQ ID NO: 3920 - protein, 108 aa, Neisseria meningitidis; identical to SEQ ID NO: 3494

SEQ ID NO: 3921 - DNA, 327 bp, Neisseria meningitidis; identical to SEQ ID NO: 3495

SEQ ID NO: 3922 - protein, 108 aa, Neisseria meningitidis; identical to SEQ ID NO: 3496

SEQ ID NO: 3923 - DNA, 1623 bp, Neisseria meningitidis
atgcaagtaaatattcagattccctgtatgctgtacagacgcgggagtgttaagccccccttgtttgaagctccgcggctcctgccgagcttcaccgaccccgttgtgcccaagctctctgctcccggcggctacattgtcgacatccccaaaggcaatctgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattatcgcgctggctgttaccgtggttactgcgggcgcgggagtcggagccgcactaggcttaaacggcgcagccgcagcagcggccgatgccgcctttgcctcactcgcttctcaggcttccgtatcgctcatcaacaataaaggcgatgtcggcaaaaccctgaaggaactgggcagaagccgcacggtaaaaaatctggttgtagcggcggcaacggcaggcgtatccaacaaactcggtgcctcttcccttgccacttggagcgaaaccccttgggtaaacaacctcaacgttaacctggccaatgcgggcagtgccgcgctgatcaacaccgctgttaacggcggcagcctgaaagacaatctggaggcaaatatcctggcggcattggtgaataccgcgcatggggaggcggcgagtaagatcaaaggactggatcagcactatgtcgcccacaaaatcgctcatgccgtagcgggctgtgcggctgcagcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaaggtcaaggaagttttagaaaaaaatcgtccttatatccctaataaaggtgctgtaccgaatatgagtacatacatgaaaaataatccttttggaaaacagctggctcaaatttcagaaaagacaacgcttccgacgcagcaagggcagtctgtcttcttggtaaaaagaaaccaagggttattaaaaaccggtgataggttttatttagatggccaacataaaaatcatttagaggtttttgataaaaatgggaactttaagtttgttctaaatatggatggttcgcttaaccaaatgaaaactggggcagcaaaaggtcgtaaattaaacttaaaatag

SEQ ID NO: 3924 - protein, 540 aa, Neisseria meningitidis
MQVNIQIPCMLYRRGSVKPPLFEAPRLLPSFTDPVVPKLSAPGGYIVDIPKGNLKTEIEKLAKQPEYAYLKQLQVAKNVNWNQVQLAYDKWDYKQEGLTRAGAAIIALAVTVVTAGAGVGAALGLNGAAAAAADAAFASLASQASVSLINNKGDVGKTLKELGRSRTVKNLVVAAATAGVSNKLGASSLATWSETPWVNNLNVNLANAGSAALINTAVNGGSLKDNLEANILAALVNTAHGEAASKIKGLDQHYVAHKIAHAVAGCAAAAANKGKCQDGAIGAAVGEIVGEALVKNTDFSDMTPEQLDLEVKKITAYAKLAAGTVAGVTGGDVNTAAQTAQNAVENNAVKAVVTAAKVVYKVARKGLKNGKINVRDLKQTLKDEGYNLADNLTTLFDETLDWNDAKAVIDIVVGTELNRANKGEAAQKVKEVLEKNRPYIPNKGAVPNMSTYMKNNPFGKQLAQISEKTTLPTQQGQSVFLVKRNQGLLKTGDRFYLDGQHKNHLEVFDKNGNFKFVLNMDGSLNQMKTGAAKGRKLNLK

SEQ ID NO: 3925 - DNA, 1095 bp, Neisseria meningitidis
atgagcatgaaacactttccagccaaagtactgaccacagccatccttgccactttctgtagcggcgcactggcagccacaagcgacgacgatgttaaaaaagctgccactgtggccattgttgctgcctacaacaatggccaagaaatcaacggtttcaaagctggagagaccatctacgacattggtgaagacggcacaattacccaaaaagacgcaactgcagccgatgttgaagccgacgactttaaaggtctgggtctgaaaaaagtcgtgactaacctgaccaaaaccgtcaatgaaaacaaacaaaacgtcgatgccaaagtaaaagctgcagaatctgaaatagaaaagttaacaaccaagttagcagacactgatgccgctttagcagatactgatgccgctctggatgaaaccaccaacgccttgaataaattgggagaaaatataacgacatttgctgaagagactaagacaaatatcgtaaaaattgatgaaaaattagaagccgtggctgataccgtcgacaagcatgccgaagcattcaacgatatcgccgattcattggatgaaaccaacactaaggcagacgaagccgtcaaaaccgccaatgaagccaaacagacggccgaagaaaccaaacaaaacgtcgatgccaaagtaaaagctgcagaaactgcagcaggcaaagccgaagctgccgctggcacagctaatactgcagccgacaaggccgaagctgtcgctgcaaaagttaccgacatcaaagctgatatcgctacgaacaaagctgatattgctaaaaactcagcacgcatcgacagcttggacaaaaacgtagctaatctgcgcaaagaaacccgccaaggccttgcagaacaagccgcgctctccggcctgttccaaccttacaacgtgggtcggttcaatgtaacggctgcagtcggcggctacaaatccgaatcggcagtcgccatcggtaccggcttccgctttaccgaaaactttgccgccaaagcaggcgtggcagtcggcacttcgtccggttcttccgcagcctaccatgtcggcgtcaattacgagtggtaa

SEQ ID NO: 3926 - protein, 364 aa, Neisseria meningitidis
MSMKHFPAKVLTTAILATFCSGALAATSDDDVKKAATVAIVAAYNNGQEINGFKAGETIYDIGEDGTITQKDATAADVEADDFKGLGLKKVVTNLTKTVNENKQNVDAKVKAAESEIEKLTTKLADTDAALADTDAALDETTNALNKLGENITTFAEETKTNIVKIDEKLEAVADTVDKHAEAFNDIADSLDETNTKADEAVKTANEAKQTAEETKQNVDAKVKAAETAAGKAEAAAGTANTAADKAEAVAAKVTDIKADIATNKADIAKNSARIDSLDKNVANLRKETRQGLAEQAALSGLFQPYNVGRFNVTAAVGGYKSESAVAIGTGFRFTENFAAKAGVAVGTSSGSSAAYHVGVNYEW

SEQ ID NO: 3927 - DNA, 1269 bp, Neisseria meningitidis
ttgactaacagggggggagcgaaattaaaaaccarttccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggargtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaaagcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaa

SEQ ID NO: 3928 - protein, 422 aa, Neisseria meningitidis
  VARIANT (1)...(422): Xaa = Any Amino Acid
LTNRGGAKLKTXSKSSERMSEVEYFSHFISDGKGKLLEIPQRRGKQDGVFVDWISFTFHEDTLLKVSGCPLFSDAEYMYVLSRKLEEILGFGITRKCKSRGNKFYESMYRLGSDDVDYGEVHFGXQRNTVLVELKGTGCSVASPGWELRLKQFLDDSIRTRITRIDLALDFFDGEYTPDQALLDHDNGFFDNSNQRPKSETIGTAWRNEDGSGKTFYVGRKKNSRFVRVYEKGRQLGDKESKWVRFEIQFNYGDIEIPLDILINQGSYFCGAFPICRKFKNMPVPERFDQRKKKLNLTFEHKLHYAKNAVGKLVNFMIEMGFDNSEIVESLKADSGFPKGLEPEKYALEMLRDGLKHGFIHEQPDIDLEIELDELGVIAFKNSDKFDREKRLFSPDYDVEKERKYQEYLSKVYHQNVDYDYF

SEQ ID NO: 3929 - DNA, 1269 bp, Neisseria meningitidis
ttgactaacagggggggagcgaaattaaaaaccaattccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggaggtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaacgcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaa

SEQ ID NO: 3930 - protein, 422 aa, Neisseria meningitidis
LTNRGGAKLKTNSKSSERMSEVEYFSHFISDGKGKLLEIPQRRGKQDGVFVDWISFTFHEDTLLKVSGCPLFSDAEYMYVLSRKLEEILGFGITRKCKSRGNKFYESMYRLGSDDVDYGEVHFGGQRNTVLVELKGTGCSVASPGWELRLKQFLDDSIRTRITRIDLALDFFDGEYTPDQALLDHDNGFFDNSNQRPKSETIGTAWRNEDGSGKTFYVGRKKNSRFVRVYEKGRQLGDKESKWVRFEIQFNYGDIEIPLDILINQGSYFCGAFPICRKFKNMPVPERFDQRKKTLNLTFEHKLHYAKNAVGKLVNFMIEMGFDNSEIVESLKADSGFPKGLEPEKYALEMLRDGLKHGFIHEQPDIDLEIELDELGVIAFKNSDKFDREKRLFSPDYDVEKERKYQEYLSKVYHQNVDYDYF

SEQ ID NO: 3931 - DNA, 863 bp, Neisseria meningitidis
atggacggcgcacaaccgaaaacaaatttttttgaacgcctgattgcccgactcgcccgcgaacccgattccgccgaagacgtattaaacctgcttcggcaggcgcacgaacaggaagtttttgatgccgacacactgacccggctggaaaaagtattggactttgccgagctggaagtgcgcgatgcgatgattacgcgcagccgcatgaacgtattgaaagaaaacgacagcatcgaacgcatcaccgcctacgtcatcgataccgcccattcgcgcttccccgtcatcggcgaagacaaagacgaagttttgggcattttgcacgccaaagacctgctcaaatatatgttcaaccccgagcagttccacctgaaatccgtcttgcgccctgccgttttcgtgcccgaaggcaaatctttgaccgcccttttaaaagagttccgcgaacagcgcaaccatatggcaatcgtcatcgacgaatacggcggcacgtcgggtttggtcacctttgaagacatcatcgagcaaatcgtcggtgacatcgaagacgagtttgacgaagacgaaagcgccgacgacatccactccgtttccgccgaacgctggcgcatccacgcggctaccgaaatcgaagacatcaacgcctttttcggtacggaatacggcagcgaagaagccgacaccatcggcggcttggtcattcaggaattgggacacctgcccgtgcgcggcgaaaaagtccttatcggcggtttgcagttcaccgtcgcccgcgccgacaaccgccgcctgcacacgctgatggcgacccgcgtgaagtaagcagagcctgcccgcaccgccgtttctgcacagtttag

SEQ ID NO: 3932 - protein, 274 aa, Neisseria meningitidis
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIGGLVIQELGHLPVRGEKVLIGGLQFTVARADNRRLHTLMATRVK

SEQ ID NO: 3933 - DNA, 825 bp, Neisseria meningitidis
atggacggcgcacaaccgaaaacgaatttttttgaacgcctgattgcccgactcgcccgcgaacccgattccgccgaagacgtattaaacctgcttcggcaggcgcacgagcaggaagtttttgatgcggatacgcttttaagattggaaaaagtcctcgatttttccgatttggaagtgcgcgacgcgatgattacgcgcagccgtatgaacgttttaaaagaaaacgacagcatcgagcgcatcaccgcctacgttatcgataccgcccattcgcgcttccccgtcatcggcgaagacaaagacgaagttttgggcattttgcacgccaaagacctgctcaaatatatgtttaaccccgagcagttccacctcaaatccattctccgccccgccgtcttcgtccccgaaggcaaatcgctgaccgcccttttaaaagagttccgcgaacagcgcaaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttcmgaacgctggcgcatccatgcagctaccgaaatcgaagacatcaacaccttcttcggcacggaatacagcakcgaagaagccgacaccattggcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaa

SEQ ID NO: 3934 - protein, 274 aa, Neisseria meningitidis
  VARIANT (1)...(274): Xaa = Any Amino Acid
MDGAQPKTNFFERLIARLAREPDSAEDVLNLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGEIEDEFDEDDSADNIHAVSSERWRIHAATEIEDINTFFGTEYSXEEADTIGGLVIQELGHLPVRGEKVLIGGLQFTVARADNRRLHTLMATRVK

SEQ ID NO: 3935 - DNA, 825 bp, Neisseria meningitidis
atggacggcgcacaaccgaaaacaaatttttttgaacgcctgattgcccgactcgcccgcgaacccgattccgccgaagacgtattgaccctgttgcgccaagcgcacgaacaggaagtatttgatgcggatacgcttttaagattggaaaaagtcctcgatttttctgatttggaagtgcgcgacgcgatgattacgcgcagccgtatgaacgttttaaaagaaaacgacagcatcgaacgcatcaccgcctacgttatcgataccgcccattcgcgcttccccgtcatcggtgaagacaaagacgaagttttgggtattttgcacgccaaagacctgctcaaatatatgttcaaccccgagcagttccacctcaaatcgatattgcgccctgccgtcttcgtccccgaaggcaaatcgctgaccgcccttttaaaagagttccgcgaacagcgcaaccatatggcaatcgtcatcgacgaatacggcggcacgtcgggtttggtaacttttgaagacatcatcgagcaaatcgtcggcgacatcgaagatgagtttgacgaagacgaaagcgcggacaacatccacgccgtttccgccgaacgctggcgcatccacgcggctaccgaaatcgaagacatcaacgcctttttcggcacggaatacagcagcgaagaagccgacaccatcggcggcctggtcattcaggaattgggacacctgcccgtgcgcggcgaaaaagtccttatcggcggtttgcagttcaccgtcgcccgcgccgacaaccgccgcctgcatacgctgatggcgacccgcgtgaagtaa

SEQ ID NO: 3936 - protein, 274 aa, Neisseria meningitidis
MDGAQPKTNFFERLIARLAREPDSAEDVLTLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGDIEDEFDEDESADNIHAVSAERWRIHAATEIEDINAFFGTEYSSEEADTIGGLVIQELGHLPVRGEKVLIGGLQFTVARADNRRLHTLMATRVK

SEQ ID NO: 3937 - DNA, 801 bp, Neisseria meningitidis
atgaaaaaatggattgccgccgcccttgcctgttccgcactcgcgctgtctgcctgcggcggtcagggcaaagatgccgccgcgcctgccgccaaccccggcaaagtgtaccgcgtggcttccaacgccgagtttgccccctttgaatctttagactcgaaaggcaatgtcgaaggtttcgacgtggatttgatgaacgcgatggcgaaggcgggcaattttaaaatcgaattcaaacaccagccgtgggacagccttttccccgccttgaacaacggcgatgcggacgttgtgatgtcgggcgtaaccattaccgacgaccgcaaacagtctatggatttcagcgacccgtattttgaaatcacccaagtcgtcctcgttccgaaaggcaaaaaagtatcttcttccgaagatttgaaaaagatgaacaaagtcggcgtggttaccggccacacgggcgatttctccgtttccaaactcttgggcaacgacaatccgaaaatcgcgcgcttcgaaaacgtccccctgattatcaaagaactggaaaacggcggcttggattccgtggtcagcgacagcgcggtcatcgccaattatgtgaaaaacaacccggccaaaggaatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatctacgccaaatattttgccaaagagggcggacaggctgcgaaataa

SEQ ID NO: 3938 - protein, 266 aa, Neisseria meningitidis
MKKWIAAALACSALALSACGGQGKDAAAPAANPGKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKKMNKVGVVTGHTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEGGQAAK

SEQ ID NO: 3939 - DNA, 801 bp, Neisseria meningitidis
atgaaaaaatggattgccgccgcccttgcctgttccgcgctcgcgctgtctgcctgcggcggtcagggcaaagataccgccgcgcctgccgccaaccccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttaaacaacggcgatgcggacgttgtgatgtcgggcgtaaccattaccgacgaccgcaaacagtctatggacttcagcgacccgtattttgaaatcacccaagtcgtcctcgttccgaaaggcaaaaaagtatcttcttccgaagatttgaaaaacatgaacaaagtcggcgtggtaaccggctacacgggcgatttctccgtatccaaactcttgggcaacgacaatccgaaaatcgcgcgctttgaaaacgttcccctgattatcaaagaactggaaaacggcggcttggattccgtggtcagcgacagcgcggtcatcgccaattatgtgaaaaacaatccggccaaagggatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatttacgccaaatattttgcaaaagaagacggacaggccgcaaaataa

SEQ ID NO: 3940 - protein, 266 aa, Neisseria meningitidis
MKKWIAAALACSALALSACGGQGKDTAAPAANPDKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKNMNKVGVVTGYTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEDGQAAK

SEQ ID NO: 3941 - DNA, 801 bp, Neisseria meningitidis
atgaaaaaatggattgccgccgcccttgcctgttccgcgctcgcgctgtctgcctgcggcggtcagggtaaagatgccgccgcgcccgccgcaaatcccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttgaacaacggcgatgcggacgttgtgatgtcgggcgtaaccattaccgacgaccgcaaacagtctatggacttcagcgacccgtattttgaaatcacccaagtcgtcctcgttccgaaaggcaaaaaaatatcttcttccgaagatttgaaaaacatgaacaaagtcggcgtggtaaccggctacacgggcgatttctccgtatccaaactcttgggcaacgacaacccgaaaatcgcgcgctttgaaaacgttcccctgattatcaaagaactggaaaacggcggcttggattccgtggtcagcgacagcgcagtcatcgccaattatgtgaaaaacaatccgaccaaagggatggacttcgttaccctgcccgacttcaccaccgaacactacggcatcgcggtacgcaaaggcgacgaagcaaccgtcaaaatgctgaacgatgcgttgaaaaaagtacgcgaaagcggcgaatacgacaaaatctacgccaaatattttgcaaaagaagacggacaggccgcaaaataa

SEQ ID NO: 3942 - protein, 266 aa, Neisseria meningitidis
MKKWIAAALACSALALSACGGQGKDAAAPAANPDKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKISSSEDLKNMNKVGVVTGYTGDFSVSKLLGNDNPKIARFENVPLIIKELENGGLDSVVSDSAVIANYVKNNPTKGMDFVTLPDFTTEHYGIAVRKGDEATVKMLNDALKKVRESGEYDKIYAKYFAKEDGQAAK

SEQ ID NO: 3943 - DNA, 1635 bp, Neisseria meningitidis
atcgcatcgcaaaaccttcgattcgacaatcgattcctccaaaaaatggtcaacggcgtgaatattttgccggccgccgattgggtagccttgggcgccaaaggccgcaacgtggtggttgaccgcgctttcggcggcccgcacatcaccaaagacggcgtaaccgtcgccaaagaaatcgaactgaaagacaagtttgaaaatatgggcgcgcaaatggtaaaagaagtcgcgtccaaaaccaacgacgtagccggcgacggtacgactaccgccaccgtattggcacaatccatcgttgccgaaggcatgaaatacgttaccgccggcatgaacccgaccgatctgaaacgcggcatcgacaaagccgttgccgctttggttgaagagctgaaaaacatcgccaaaccttgcgatacttccaaagaaatcgcccaagtcggctcgatttccgccaactccgacgaacaagtcggcgcgattatcgccgaagcgatggaaaaagtcggcaaagaaggcgtgattaccgttgaagacggcaaatctttggaaaacgagctggacgtggttgaaggtatgcagttcgaccgcggctacctgtccccttactttatcaacgacgcggaaaaacaaatcgccggtctggacaatccgtttgttttgctgttcgacaaaaaaatcagcaacatccgcgacctgctgcccgtgttggaacaagtggcgaaagccagccgcccgctgttgattatcgctgaagacgtagaaggcgaagccttggcgactttggtcgtgaacaacatccgcggcatcctgaaaaccgttgccgtcaaagcccccggcttcggcgaccgccgcaaagcgatgctgcaagacatcgccatcctgaccggcggcgtagtgatttccgaagaagtcggcctgtctttggaaaaagcgactttggacgacttgggtcaaaccaaacgcatcgaaatcggtgaagaaaacactaccgtcatcgacggcttcggcgacgcagcccaaatcgaagcgcgtgttgccgaaatccgccaacaaatcgaaaccgcgaccagcgattacgacaaagaaaaactgcaagagcgcgttgccaaactggcaggaggcgtggcagtgatcaaagtcggcgcggcgaccgaagtcgaaatgaaagagaaaaaagaccgcgtggaagacgcgctgcacgctacccgcgcagccgttgaagaaggcgtggttgcaggcggcggcgtagccctgttgcgcgcccgtgccgctttggaaaacctgcacaccggcaatgccgaccaagacgcaggcgtacaaatcgtattgcgcgccgttgagtctccgctgcgccaaatcgttgccaacgcaggcggagaacccagcgtggtggtgaacaaagtgttggaaggcaaaggcaactacggttacaacgcaggctccggcgaatacggcgacatgatcggaatgggcgtactcgaccctgccaaagtaacccgttccgcgctgcaacacgccgcgtctatcgccggtctgatgctgacgaccgactgcatgattgccgaaatccctgaagaaaaaccggctgtgcccgatatggggggaatgggcggtatgggcggcatgatgtaa

SEQ ID NO: 3944 - protein, 544 aa, Neisseria meningitidis
IASQNLRFDNRFLQKMVNGVNILPAADWVALGAKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQTKRIEIGEENTTVIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIGMGVLDPAKVTRSALQHAASIAGLMLTTDCMIAEIPEEKPAVPDMGGMGGMGGMM

SEQ ID NO: 3945 - DNA, 1635 bp, Neisseria meningitidis
atggcagcaaaagacgtacagttcggcaatgaagtccgtcaaaaaatggtaaacggcgtgaacattctggcaaacgccgtccgcgtaaccttgggccccaaaggtcgcaacgtagtcgttgaccgcgcattcggcggcccgcacatcaccaaagacggcgtaaccgtcgccaaagaaatcgaactgaaagacaagtttgaaaatatgggcgcgcaaatggtgaaagaagttgcgtccaaaaccaacgacgtggcaggcgacggtacgactaccgccaccgtactggcgcaatccatcgttgccgaaggtatgaaatatgttaccgcaggtatgaatccgaccgacctgaaacgcggtatcgataaagccgtcgccgctttggttgacgaactgaaaaacatcgccaaaccttgcgacacttctaaagaaatcgcccaagtcggctctatttccgccaactccgacgaacaagtcggcgcgattatcgccgaagcgatggaaaaagtcggcaaagaaggcgtgattaccgttgaagacggcaagtctttggaaaacgagctggacgtagttgaaggtatgcagttcgaccgcggctacctgtctccttacttcatcaacgatgcggaaaaacaaatcgctgctttggacaatccgtttgtattgttgttcgacaaaaaaatcagcaacatccgcgacctgctgcctgttttggaacaagtggcaaaagccagccgtccgctgttgattatcgctgaagacgtagaaggcgaagccttggcgactttggtcgtgaacaacatccgaggcatcctgaaaaccgttgccgtcaaagcccctggcttcggcgaccgccgcaaagcgatgttgcaagacatcgccatcctgaccggcggcgtggtgatttccgaagaagtcggtctgtctttggaaaaagcgactttggacgacttgggtcaagccaaacgcatcgaaatcggtaaagaaaacaccaccatcatcgacggctttggcgacgcagcccaaatcgaagcgcgtgttgccgaaatccgccaacaaatcgaaaccgcaaccagcgattacgacaaagaaaaactgcaagagcgcgtggctaaattggcaggcggcgtggcagtcatcaaagtcggtgccgcgaccgaagtcgaaatgaaagagaaaaaagaccgcgtggaagacgcgctgcacgctacccgcgcagccgttgaagaaggcgtggttgcaggcggcggcgtagccctgttgcgtgcccgtgctgctttggaaaacctgcacaccggcaatgccgaccaagacgcaggcgtacaaatcgtcttgcgcgccgttgagtctccgctgcgccaaatcgttgccaacgcaggcggcgaacccagcgtggttgtgaacaaagtattggaaggcaaaggcaactacggttacaacgctggcagcggcgaatacggcgatatgatcgaaatgggcgtactcgaccccgccaaagtaacccgttctgcgctgcaacacgccgcatctatcgccggcttgatgctgaccactgattgcatgatcgctgaaatccccgaagacaaaccggctgtgcctgatatgggcggcatgggtggtatgggcggcatgatgtaa

SEQ ID NO: 3946 - protein, 1635 aa, Neisseria meningitidis
ATGGCAGCAAAAGACGTACAGTTCGGCAATGAAGTCCGTCAAAAAATGGTAAACGGCGTGAACATTCTGGCAAACGCCGTCCGCGTAACCTTGGGCCCCAAAGGTCGCAACGTAGTCGTTGACCGCGCATTCGGCGGCCCGCACATCACCAAAGACGGCGTAACCGTCGCCAAAGAAATCGAACTGAAAGACAAGTTTGAAAATATGGGCGCGCAAATGGTGAAAGAAGTTGCGTCCAAAACCAACGACGTGGCAGGCGACGGTACGACTACCGCCACCGTACTGGCGCAATCCATCGTTGCCGAAGGTATGAAATATGTTACCGCAGGTATGAATCCGACCGACCTGAAACGCGGTATCGATAAAGCCGTCGCCGCTTTGGTTGACGAACTGAAAAACATCGCCAAACCTTGCGACACTTCTAAAGAAATCGCCCAAGTCGGCTCTATTTCCGCCAACTCCGACGAACAAGTCGGCGCGATTATCGCCGAAGCGATGGAAAAAGTCGGCAAAGAAGGCGTGATTACCGTTGAAGACGGCAAGTCTTTGGAAAACGAGCTGGACGTAGTTGAAGGTATGCAGTTCGACCGCGGCTACCTGTCTCCTTACTTCATCAACGATGCGGAAAAACAAATCGCTGCTTTGGACAATCCGTTTGTATTGTTGTTCGACAAAAAAATCAGCAACATCCGCGACCTGCTGCCTGTTTTGGAACAAGTGGCAAAAGCCAGCCGTCCGCTGTTGATTATCGCTGAAGACGTAGAAGGCGAAGCCTTGGCGACTTTGGTCGTGAACAACATCCGAGGCATCCTGAAAACCGTTGCCGTCAAAGCCCCTGGCTTCGGCGACCGCCGCAAAGCGATGTTGCAAGACATCGCCATCCTGACCGGCGGCGTGGTGATTTCCGAAGAAGTCGGTCTGTCTTTGGAAAAAGCGACTTTGGACGACTTGGGTCAAGCCAAACGCATCGAAATCGGTAAAGAAAACACCACCATCATCGACGGCTTTGGCGACGCAGCCCAAATCGAAGCGCGTGTTGCCGAAATCCGCCAACAAATCGAAACCGCAACCAGCGATTACGACAAAGAAAAACTGCAAGAGCGCGTGGCTAAATTGGCAGGCGGCGTGGCAGTCATCAAAGTCGGTGCCGCGACCGAAGTCGAAATGAAAGAGAAAAAAGACCGCGTGGAAGACGCGCTGCACGCTACCCGCGCAGCCGTTGAAGAAGGCGTGGTTGCAGGCGGCGGCGTAGCCCTGTTGCGTGCCCGTGCTGCTTTGGAAAACCTGCACACCGGCAATGCCGACCAAGACGCAGGCGTACAAATCGTCTTGCGCGCCGTTGAGTCTCCGCTGCGCCAAATCGTTGCCAACGCAGGCGGCGAACCCAGCGTGGTTGTGAACAAAGTATTGGAAGGCAAAGGCAACTACGGTTACAACGCTGGCAGCGGCGAATACGGCGATATGATCGAAATGGGCGTACTCGACCCCGCCAAAGTAACCCGTTCTGCGCTGCAACACGCCGCATCTATCGCCGGCTTGATGCTGACCACTGATTGCATGATCGCTGAAATCCCCGAAGACAAACCGGCTGTGCCTGATATGGGCGGCATGGGTGGTATGGGCGGCATGATGTAA

SEQ ID NO: 3947 - DNA, 1635 bp, Neisseria meningitidis
atggcagcaaaagacgtacaattcggcaatgaagtccgccaaaaaatggtaaacggcgtgaacattttggcaaacgccgtgcgcgtaaccttgggtcccaaaggccgcaacgtggtggttgaccgcgctttcggcggcccgcacatcaccaaagacggcgtaaccgtcgccaaagaaatcgaactgaaagacaagtttgaaaatatgggcgcgcaaatggtgaaagaagtcgcgtccaaaaccaacgacgtggcgggcgacggtacgactaccgccaccgtattggcgcaatccatcgttgccgaaggtatgaaatacgttaccgccggtatgaacccgaccgacctgaaacgcggtatcgacaaagccgtcgccgctttggttgaagagctgaaaaacatcgccaaaccttgcgacacttctaaagaaatcgcccaagtcggctctatttccgccaactctgacgaacaagtcggcgcgattattgccgaagcgatggaaaaagtcggcaaagaaggcgtgattaccgttgaagacggcaaatctttggaaaacgagctggacgtggttgaaggtatgcaattcgaccgcggctacctgtctccttacttcatcaacgatgcggaaaaacaaatcgccggcttggacaatccgtttgtattgctgttcgacaaaaaaatcagcaatatccgcgacctgctgcctgttttggaacaagtggccaaagccagccgtccgctgttgattatcgctgaagacgtagaaggcgaagccttggcgactttggtcgtgaacaacatccgcggcattctgaaaaccgttgccgttaaagctccgggcttcggcgaccgccgcaaagcgatgctgcaagacatcgctatcctgaccggcggcacagtgatttccgaagaagtcggcctgtctttggaaaaagcgactttggacgacttgggtcaggccaaacgcatcgaaatcggtaaagaaaacaccaccatcatcgacggcttcggcgacgcagcccaaatcgaagcgcgtgttgccgaaatccgccaacaaatcgaaaccgcaaccagcgattacgacaaagaaaaactgcaagagcgcgttgccaaactggcaggcggcgtggcagtaatcaaagtcggtgccgcgaccgaagtggaaatgaaagagaaaaaagaccgcgtggaagacgcgctgcacgctacccgcgcagccgttgaagaaggcgtggttgcaggcggcggcgtagccctgttgcgcgcccgtgccgctctggaaaacctgcacaccggcaatgcagaccaagacgcaggcgtacaaatcgtcttgcgcgccgttgagtctccgctgcgccaaatcgttgccaacgcaggcggcgaacccagcgtggttgtgaacaaagtgttggaaggcaaaggcaactatggttacaacgctggcagcggcgaatacggcgacatgatcgaaatgggcgtactcgaccccgccaaagtaacccgttccgcgctgcaacacgccgcgtctatcgccggcctgatgctgaccacagactgcatgattgctgaaatccctgaagacaaaccggctatgcctgatatgggcggcatgggtggtatgggcggcatgatgtaa

SEQ ID NO: 3948 - protein, 544 aa, Neisseria meningitidis
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGTVISEEVGLSLEKATLDDLGQAKRIEIGKENTTIIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIEMGVLDPAKVTRSALQHAASIAGLMLTTDCMIAEIPEDKPAMPDMGGMGGMGGMM

SEQ ID NO: 3949 - DNA, 1500 bp, Neisseria meningitidis
gtgttcaaaaaataccaatacttcgctttggcggcactgtgtgccgccttgctggcaggctgcgaaaaggcaggcagctttttcggtgcggacaaaaaagaagcatccttcgtagaacgcatcgaacacaccaaagacgacggcagtgtcagtatgctgctgcccgactttgcccaactggttcaaagcgaaggcccggcagtcgtcaatattcaggcagcccccgccccgcgcacccaaaacggcagcggcaatgccgaaaccgattccgacccgcttgccgacagcgacccgttctacgaatttttcaaacgcctcgtcccgaacatgcccgaaatcccccaagaagaagcagatgacggcggattgaacttcggttcgggcttcatcatcagcaaaaacggctacatcctgaccaatacccacgtcgttgccggtatgggcagtatcaaagtcctgctcaacgacaagcgcgaatataccgccaaactcatcggttcggatgtccaatccgatgtcgcccttctgaaaatcgacgcaacggaagagctacccgtcgtcaaaatcggcaatcccaaaaatttgaaaccgggcgaatgggtcgctgccatcggcgcgcccttcggctttgacaacagcgtgaccgccggcatcgtgtccgccaaaggcagaagcctgcccaacgaaagctacacacccttcatccaaaccgacgttgccatcaatccgggcaattccggcggcccgctgttcaacttaaaaggacaggtcgtcggcatcaattcgcaaatatacagccgcagcggcggattcatgggcatctcctttgccatcccgattgacgttgccatgaatgtcgccgaacagctgaaaaacaccggcaaagtccaacgcggacaactgggcgtgattattcaggaagtatcctacggtttggcacagtcgttcggtctggataaagccagcggcgcattgattgccaaaatccttcccggcagccccgcagaacgtgccggcctgcaggcgggcgacatcgtcctcagcctcgacggcggagaaatacgttcttccggcgaccttcccgtcatggtcggcgccattacgccgggaaaagaagtcagcctcggcgtatggcgcaaaggcgaagaaatcacaatcaaagccaagctgggcaacgccgccgagcataccggcgcatcatccaaaacagatgaagccccctacaccgaacagcaatccggtacgttctcggtcgaatccgcaggcattacccttcagacacataccgacagcagcggcaaacacctcgtcgtcgtacgggtttccgacgcggcagaacgcgcaggcttaaggcgcggcgacgaaatcctcgcggtcgggcaagtccccgtcaatgacgaagccggtttccgcaaagctatggacaaggcaggcaaaaacgtccccctgctggtcatgcgccgtggcaacacgctgttcatcgcattaaacctgcaataa

SEQ ID NO: 3950 - protein, 499 aa, Neisseria meningitidis
VFKKYQYFALAALCAALLAGCEKAGSFFGADKKEASFVERIEHTKDDGSVSMLLPDFAQLVQSEGPAVVNIQAAPAPRTQNGSGNAETDSDPLADSDPFYEFFKRLVPNMPEIPQEEADDGGLNFGSGFIISKNGYILTNTHVVAGMGSIKVLLNDKREYTAKLIGSDVQSDVALLKIDATEELPVVKIGNPKNLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKASGALIAKILPGSPAERAGLQAGDIVLSLDGGEIRSSGDLPVMVGAITPGKEVSLGVWRKGEEITIKAKLGNAAEHTGASSKTDEAPYTEQQSGTFSVESAGITLQTHTDSSGKHLVVVRVSDAAERAGLRRGDEILAVGQVPVNDEAGFRKAMDKAGKNVPLLVMRRGNTLFIALNLQ

SEQ ID NO: 3951 - DNA, 1500 bp, Neisseria meningitidis
gtgttcaaaaaataccaatacctcgctttggcagcactgtgtgcagcctcgctggcaggctgcgacaaggcaggcagcttcttcgtggcggacaaaaaagaagcatccttcgtagaacgcatcgaacacaccaaagacgacggcagcgtcagtatgctgctgcccgactttgcccaactggttcaaagtgaaggtccggcagtcgtcaatattcaggcagcccccgccccgcgcacccaaaacggcagcggcaatgccgaaaacgattccgacccgattgccgacaacgacccgttctacgaatttttcaaacgcctcgtcccgaatatgcccgaaatcccccaagaagaagcagatgacggcggattgaacttcggttcgggcttcatcatcagcaaagacggctacatcctgaccaatacccacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcatcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcaggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataa

SEQ ID NO: 3952 - protein, 499 aa, Neisseria meningitidis
VFKKYQYLALAALCAASLAGCDKAGSFFVADKKEASFVERIEHTKDDGSVSMLLPDFAQLVQSEGPAVVNIQAAPAPRTQNGSGNAENDSDPIADNDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLQAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 3953 - DNA, 1500 bp, Neisseria meningitidis
  misc_feature (1)...(1500): n = A,T,C or G
gtgttcaaaaaataccaatacctcgctttggcagcactgtgtgccgcctcgctggcaggctgcgacaaagccggcagctttttcggtgcggacaaaaaagaagcatcctttgtagaacgcatcaaacacaccaaagacgacggcagcgtcagtatgctgctgcccgactttgtccaactggttcaaagcgaaggcccggcagtcgtcaatattcaggcagcccccgccccgcgcacccaaaacggcagcagcaatgccgaaaccgattccgacccgcttgccgacagcgacccgttctacgaatttttcaaacgcctcgtcccgaacatgcccgaaatcccccaagaagaagcagatgacggnggattgaacttcggttcgggcttcatcatcagcaaagacggctatattctgaccaatacgcacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcntcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcgggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataa

SEQ ID NO: 3954 - protein, 499 aa, Neisseria meningitidis
  VARIANT (1)...(499): Xaa = Any Amino Acid
VFKKYQYLALAALCAASLAGCDKAGSFFGADKKEASFVERIKHTKDDGSVSMLLPDFVQLVQSEGPAVVNIQAAPAPRTQNGSSNAETDSDPLADSDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGXVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLRAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 3955 - DNA, 1527 bp, Neisseria meningitidis
atgaaaacacgcagcctcatttcccttttatgcctccttctctgttcatgttcttcatggttgcccccactggaagaacggacggaaagccgtcattttaatacttccaaacctgtcctcctggacaacatcctgcaaatccggcacacccctcataacaacgggctatccgacatctacctgctcgacgacccccacgaagcctttgccgcccgcgccgcccttatcgaatctgccgaacacagcctcgatttgcaatactacatttggcgcaacgacatttccggcaggctgctgttcaacctcatgtaccttgccgcagaacgcggcgtgcgcgtacgcctgctgttggacgacaacaacacgcgcggcttggacgatctcctgctcgccctcgacagccatcccaatatctaagtgcgcctgttcaaccccttcgtcctacgcaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgacctggacatcctcgccaccggcagcgtcgtcggcgaagtatcgcacgacttcgaccgctactgggcaagccattccgcccacaacgccacgcgcatcatccgcagcggcaacatcggcaagggtcttcaagcactcggatacaacgacgaaacatccagacacgcgctcctgcgctaccgcgaaaccgtcgaacagtcgcccctctaccaaaaaatacagacgggacgcatcgactggcagagcgtccaaacccgcctgatcagcgacagccctgcaaaaggactcgaccgcgaccgccgcaaaccgccgattgccgggaggctgcaagacgcgctcaaacagcccgaaaaaagcgtctatctggtttcaccctatttcgtccctacaaaatccggcacagacgcactggcaaaactggtgcaggacggcatagacgttaccgtcctgaccaactcgctacaggcgaccgacgttgccgccgtccattccggctacgtcaaataccgaaaaccgctgctcaaagccggcatcaaactctacgagctgcaacccaaccatgccgtccccgccacaaaagacaaaggcctgaccggcagctccgtaaccagcctgcatgccaaaaccttcattgtggacggcaaacgcatcttcatcggctcattcaacctcgacccccgttccgcacggctcaataccgaaatgggcgtcgtcatcgaaagccccaaaatcgcagaacagatggagcgcaccctcgccgataccacacccgaatacgcctaccgcgttaccctcgacaaacacaaccgcctgcaatggcacgatcccgccacccgaaaaacctacccgaacgaacccgaagccaaactttggaaacgcatcgccgcaaaaatcctatccctgctgcccatcgaaggtttattatag

SEQ ID NO: 3956 - protein, 507 aa, Neisseria meningitidis
MKTRSLISLLCLLLCSCSSWLPPLEERTESRHFNTSKPVLLDNILQIRHTPHNNGLSDIYLLDDPHEAFAARAALIESAEHSLDLQYYIWRNDISGRLLFNLMYLAAERGVRVRLLLDDNNTRGLDDLLLALDSHPNIVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDSPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPEYAYRVTLDKHNRLQWHDPATRKTYPNEPEAKLWKRIAAKILSLLPIEGLL

SEQ ID NO: 3957 - DNA, 1527 bp, Neisseria meningitidis
atgaaaacacgcagcctaatttcccttttatgcctccttctctgttcatgttcttcatggttgcccccactggaagaacggacggaaagccgtcatttcaatacttccaaacccgtccgcctggacaacatcctgcaaatccggcacacccctcataccaacgggctatccgatatctatctgttgaacgacccccacgaagcctttgccgcccgcgccgcccttatcgaatctgccgaacacagcctcgatttgcaatactacatctggcgcaacgacatttccggcaggctgctgttcaacctcgtgtaccttgccgcagaacgcggtgtgcgcgtacgcctgctgttggacgacaacaacacgcgcggattggacgacctcctgcttgccctcgacagccatcccaatatcgaagtgcgcctgttcaaccccttcgtcttacgaaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgatttggacatcctcgccaccggcagcgtcgtcggcgaagtatcgcacgacttcgaccgctactgggcaagccattccgcccacaacgccacgcgcatcatccgcagcggcgacatcggcaagggtcttcaagcactcggatacaacgacgaaacgtccagacacgcgctcctgcgctaccgcgaaaccgtcgaacagtcgcccctctaccaaaaaatacagacaggatgcatcgactggcagagcgtccgaacccgcctcatcagcgacgaccctgcaaaaggactcgaccgcgaccgccgcaaaccgccgattgccgggcggctgcaagacgcgctcaaacagcccgaaaaaagcgtctatctggtttcaccctatttcgttcccacaaaatccggcacagacgcactggcaaaactggtgcaggacggcatagacgttaccgttctgaccaactcgctgcaggcgaccgacgttgccgccgtccattccggctatgtcaaataccgaaaaccgctgctcaaagccggcatcaaactctacgagctgcaacccaaccatgccgtccccgccacaaaagacaaaggcctgaccggcagctccgtaaccagcctgcacgccaaaaccttcattgtggacggcaaacgcatcttcatcggttcgttcaacctcgacccccgttccgcgcgtctcaacaccgaaatgggcgttgttatcgaaagccccaaaatcgcagaacagatggagcgcacccttgccgataccacacccgcctacgcctaccgcgttaccctcgacaggcacaaccgcctgcaatggcacgatcccgccacccgaaaaacctacccgaacgaacccgaagccaaactttggaaacgcatcgccgcaaaaatcctatccctgctgcccatagaaggtttattatag

SEQ ID NO: 3958 - protein, 508 aa, Neisseria meningitidis
MKTRSLISLLCLLLCSCSSWLPPLEERTESRHFNTSKPVRLDNILQIRHTPHTNGLSDIYLLNDPHEAFAARAALIESAEHSLDLQYYIWRNDISGRLLFNLVYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGDIGKGLQALGYNDETSRHALLRYRETVEQSPLYQKIQTGCIDWQSVRTRLISDDPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPAYAYRVTLDRHNRLQWHDPATRKTYPNEPEAKLWKRIAAKILSLLPIEGLL

SEQ ID NO: 3959 - DNA, 1527 bp, Neisseria meningitidis
atgaaaacacgcagcctaatttcccttttatgcctccttctctgttcatgttcttcatggttgcccccactggaagaacggacggaaagccgtcatttcaatacttccaaacccgtccgcctggacaacatcctgcaaatccggcacacccctcataccaacgggctatccgatatctatctgttgaacgacccccacgaagcctttgccgcccgcgccgcccttatcgaatctgccgaacacagcctcgatttgcaatactacatctggcgcaacgacatttccggccgactgctgttcaacctcgtgtaccttgccgcagaacgcggtgtgcgcgtacgcctgctgttggacgacaacaacacgcgcggattggacgacctcctgctcgccctcgacagccatcccaatatcgaagtgcgcctgttcaaccccttcgtcttacgaaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgacctggacatcctcgccaccggcagcgtcgtcggcgaagtatcgcacgacttcgaccgctactgggcaagccattccgcccacaacgccacgcgcatcatccgcagcggcaacatcggcaagggtcttcaagcactcggatacaacgacgaaacgtccagacacgcgctcctgcgctaccgcgaaaccgtcgaacagtcgcccctctaccaaaaaatacagacaggacgcatcgactggcagagcgtccaaacccgcctcatcagcgacgaccctgcaaaaggactcgaccgcgaccgccgcaaaccgccgattgccgggcggctgcaagacgcgctcaaacagcccgaaaaaagcgtctatctggtttcaccctatttcgtccccacaaaatccggcacagacgcactggcaaaactggtgcaggacggcatagacgttaccgtcctgaccaactcgctacaggcgaccgacgttgccgccgtccattccggctatgtcaaataccgaaaaccgctgctcaaagccggcatcaaactctacgagctgcaacccaaccatgccgtccctgccacaaaagacaaaggcctgaccggcagctccgtaaccagcctgcatgccaaaaccttcattgtggacggcaaacgcatcttcatcggctcattcaacctcgacccccgttccgcacggctcaatactgaaatgggcgttgttatcgaaagccccaaaatcgcagaacagatggagcgcacccttgccgatacctcacccgaatacgcctaccgcgttaccctcgacaggcacaaccgcctgcaatggcacgatcccgccacccgaaaaacctacccgaacgaacccgaagccaaactttggaaacgcatcgccgcaaaaatcctatccctgctgcccatagaaagtttattatag

SEQ ID NO: 3960 - protein, 508 aa, Neisseria meningitidis
MKTRSLISLLCLLLCSCSSWLPPLEERTESRHFNTSKPVRLDNILQIRHTPHTNGLSDIYLLNDPHEAFAARAALIESAEHSLDLQYYIWRNDISGRLLFNLVYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDDPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTSPEYAYRVTLDRHNRLQWHDPATRKTYPNEPEAKLWKRIAAKILSLLPIESLL

SEQ ID NO: 3961 - DNA, 2379 bp, Neisseria meningitidis
atgaataaaaatattaaatctttaaatttacgggaaaaagacccgtttttaagtcgtgaaaaacagcgttatgaacatcctttgcccagtcgggaatggataatcgaattgttggagcgcaaaggtgtgccttcaaaaatcgaatcgcttgcacgcgagctgtcgattacggaagacgagtatgtcttttttgaacgccgtctgaaggcgatggcgcgggacggtcaggttttaatcaaccgccgaggcgcagtttgcgcggcggacaagctggatttggtcaaatgccgcgtcgaggcgcataaggacggtttcggcttcgccgtgccgctcatgccgatggacgaaggggatttcgttttatacgaacgccagatgcgtggtgtcatgcacggcgacaccgttaccgtccgtcctgcgggtatggaccgcaggggccgccgcgaagggacgtttctggatattgtcgaacgcgcgcaaagcaaagttgtcggccgtttctatatggataggggcgtggcgattttggagccggaagacaagcgtctgaaccaaagcatcgtgttggaaccggacggcgtggcgcgtttcaaacccgaatccggtcaggttatcgtcggcaaaattgaggtttatcccgagcaaaaccggcctgcagtggcaaaaatcattgaagttttgggcgattatgccgacagcgggatggaaatcgaaattgccgtgcgcaagcatcatttgccgcaccgattcagtgaagcgtgtgccaaatccgcgaaaaaaattcccgaccatgtacgcaaaagcgatttgaaaggccgcgtcgatttgtgcgaccttcctttggtaacgatagacggcgaaacggcgcgcgatttcgacgacgcggtgtttgccgaaaaagtcggacgcaattaccgcctggtcgtggcgattgcggatgtcagccattatgtccgccctgacgatgcgattgatgcagatgctcaagaacgcagtaccagcgtgtatttcccgcgccgtatgattccgatgctgccggaaaacctgtccaacggcatctgctcgctcaatcccgatgtcgagcgtttgtgtatggtgtgcgatatggtcgttacctatgcgggcaatatcaaagaataccgcttctatcccgccgtgatgcgctctcatgcccgcctgacctacaaccaagtttggaaatggctttcagacggcatcgggaatccgcacaaagcccaaatcgacacgctttacaagctgtttaaaattttgcagaaaaaacgtctggcgcgcggggcggtggagtttgaaagcgtcgaaacccagatgattttcgacgacaacggcaaaatcgaaaaaattgtccccgtcgtccgcaacgatgcccacaagctgattgaagaatgtatgctggcggcgaatgtttgcgcggcggattttctgttgaaaaacaaacatacggctttgttccgcaaccatttgggccccacgcccgaaaaactcgccaccctgcgcgagcagctcggtctgttggggcttcaacttggcggcggcgacaacccgtcgccgaaagactatgccgcgcttgccgaacaattcaaaggcaggccggatgccgaattgctgcaagtcatgatgttgcgctccatgcagcaggcggtttacgaaccgcattgcgaagggcatttcggtttggcttatgaagcatacgcccactttacctcgcccatccgccgctatcccgacctgaccgtccaccgtgccatcaaagccgtattgaaccggaaaacctacacgccaaacaaaagctggcaggctttgggcgtgcatacttcgttttgcgaacgccgtgccgacgatgctggccgcgatgtggaaaactggctgaaaacttattatatgcgcgataaggtcggtgaaatatttgaaggcaaaatctcccggggtgtggcaaattttggaatatttgtcactttggacgatatccatatcgacggtctggtacatatcagcgatttgggcgaagattatttcaacttccgccccgaaatcatggcaatcgaaggcgaacgcagcggcatccgtttcaatatgggggacagggttgccgtccgggtcgcgcgtgccgatttggatgatggaaaaatcgactttgtcctaattgccggagaaagcggcaggcggcggaaggtcaaattatccgcatctgccaaaccggcaggggcggcggggaaagggaaatcgaaaaccaccgccgagaaaaaaacagcccgatgcggcaaagtaaggggaaggggcgtgcctgccgttgccgaatcggggaaaaaggcaaagaaaccggttccgattaaggtcaaaaaacggaaaggcaaatcataa

SEQ ID NO: 3962 - protein, 792 aa, Neisseria meningitidis
MNKNIKSLNLREKDPFLSREKQRYEHPLPSREWIIELLERKGVPSKIESLARELSITEDEYVFFERRLKAMARDGQVLINRRGAVCAADKLDLVKCRVEAHKDGFGFAVPLMPMDEGDFVLYERQMRGVMHGDTVTVRPAGMDRRGRREGTFLDIVERAQSKVVGRFYMDRGVAILEPEDKRLNQSIVLEPDGVARFKPESGQVIVGKIEVYPEQNRPAVAKIIEVLGDYADSGMEIEIAVRKHHLPHRFSEACAKSAKKIPDHVRKSDLKGRVDLCDLPLVTIDGETARDFDDAVFAEKVGRNYRLVVAIADVSHYVRPDDAIDADAQERSTSVYFPRRMIPMLPENLSNGICSLNPDVERLCMVCDMVVTYAGNIKEYRFYPAVMRSHARLTYNQVWKWLSDGIGNPHKAQIDTLYKLFKILQKKRLARGAVEFESVETQMIFDDNGKIEKIVPVVRNDAHKLIEECMLAANVCAADFLLKNKHTALFRNHLGPTPEKLATLREQLGLLGLQLGGGDNPSPKDYAALAEQFKGRPDAELLQVMMLRSMQQAVYEPHCEGHFGLAYEAYAHFTSPIRRYPDLTVHRAIKAVLNRKTYTPNKSWQALGVHTSFCERRADDAGRDVENWLKTYYMRDKVGEIFEGKISRGVANFGIFVTLDDIHIDGLVHISDLGEDYFNFRPEIMAIEGERSGIRFNMGDRVAVRVARADLDDGKIDFVLIAGESGRRRKVKLSASAKPAGAAGKGKSKTTAEKKTARCGKVRGRGVPAVAESGKKAKKPVPIKVKKRKGKS

SEQ ID NO: 3963 - DNA, 1926 bp, Neisseria meningitidis
acagttctggatattgtcgaacgcgcgcaaagcaaagtggtcggccgtttctatatggataggggcgtggcgattttggagccggaagacaagcgtctgaaccaaagcatcgtattggaaccggacggcgtggcgcgtttcaaacctgaatccggtcaggtcatcgtcggcgaaattgaggtttatcctgagcaaaaccggccggcagtggcaaaaatcatcgaagttttgggcgattatgccgacagcggcatggagattgaaattgccgtgcgcaagcatcatttgccgcaccaattcagtgaagcgtgtgccaaagctgcgaaaaaaattcccgtccatgtacgcaaaagcgatttgaaaggccgcgtcgatttgcgcgacctgcctttggtaacgatagacggcgaaacggcgcgcgatttcgacgacgcggtgtttgccgaaaaagtcggacgcaattaccgtctggtcgtggcgattgcggatgtcagccattatgtccgccctgacgatgtgattgatgcagatgctcaagaacgcagtaccagcgtatatttcccgcgccgtgtgattccgatgctgccggaaaacctgtctaacggcatttgctcgctcaatcccgatgtcgagcgtttgtgtatggtgtgcgatatggtcgttacctatgcgggcaatatcaaagaataccgcttctaccccgccgtaatgcgctctcatgcccgcctgacctacaaccaagtttggaaatggatttcagacggcatcgaccatccgtacaaagcccaaatcgacaccctttacaaactcttcaaaatccttcagaaaaagcgtttcgaacgcggcgcggtggagtttgaaagcgtcgaaacccagatgattttcgatgacaacggcaaaatcgaaaaaatcgtccccgttgtccgcaacgatgcccacaagctgattgaagaatgtatgctggcggcgaatgtttgcgcagcggatttcctgttgaaaaacaagcatacggctttgttccgcaaccatttgggccccacgcccgaaaaactcgccaccctgcgcgagcagctcggtctgttggggcttcaacttggcggcggcgacaacccgtcgccgaaagactatgccgcgcttgtcgaacaattcaaaggcagacctgatgccgaattgctgcaagtcatgatgttgcgctccatgcagcaggcggtttacgaaccgcattgcgacggacactttggtcttgcctacgaagcatacgcccacttcacctcgcccatccgccgctatcccgacctgaccgtacaccgcgccatcaaagccgtgttgaatcagcaaacctacacgccaaaaaaaagctggcaggctttgggcgtgcatacctcgttctgtgagcgccgtgccgacgacgccagccgcgacgtggaaaactggctgaaaacctattatatgcgcgataaggtcggcgaagtattcgaaggtaaaatctccggcatgaccagttttggtatctttgtaacactggacggcatccacattgacggcttggtgcatatcagcgatttgggcgaagactatttcaacttccgccccgaaatcatggcaatcgaaggcgaacgcagcggcatccgtttcaacatgggggacagggttgccgtccgggtcgcccgtgccgatttggatgacggaaaaatcgattttgtcctgattgccggggggagcggcagggggcggaaagttaaatcatccgcgtctgccaaaccggcagggacggcggggaaagggaagccgaaaaccgccgccgagaaaaaaacagcccgaggcggcaaagtaaggggaaggggcgcgtctgccgccgcagaatcgaggaaaaaggcaaagaaaccggttccgattaaggtaaaaaaacggaaaggcaaatcataa

SEQ ID NO: 3964 - protein, 641 aa, Neisseria meningitidis
TVLDIVERAQSKVVGRFYMDRGVAILEPEDKRLNQSIVLEPDGVARFKPESGQVIVGEIEVYPEQNRPAVAKIIEVLGDYADSGMEIEIAVRKHHLPHQFSEACAKAAKKIPVHVRKSDLKGRVDLRDLPLVTIDGETARDFDDAVFAEKVGRNYRLVVAIADVSHYVRPDDVIDADAQERSTSVYFPRRVIPMLPENLSNGICSLNPDVERLCMVCDMVVTYAGNIKEYRFYPAVMRSHARLTYNQVWKWISDGIDHPYKAQIDTLYKLFKILQKKRFERGAVEFESVETQMIFDDNGKIEKIVPVVRNDAHKLIEECMLAANVCAADFLLKNKHTALFRNHLGPTPEKLATLREQLGLLGLQLGGGDNPSPKDYAALVEQFKGRPDAELLQVMMLRSMQQAVYEPHCDGHFGLAYEAYAHFTSPIRRYPDLTVHRAIKAVLNQQTYTPKKSWQALGVHTSFCERRADDASRDVENWLKTYYMRDKVGEVFEGKISGMTSFGIFVTLDGIHIDGLVHISDLGEDYFNFRPEIMAIEGERSGIRFNMGDRVAVRVARADLDDGKIDFVLIAGGSGRGRKVKSSASAKPAGTAGKGKPKTAAEKKTARGGKVRGRGASAAAESRKKAKKPVPIKVKKRKGKS

SEQ ID NO: 3965 - DNA, 2376 bp, Neisseria meningitidis
  misc_feature (1)...(2376): n = A,T,C or G
atgaataaaaatattaaatctttaaatttacgggaaaaagacccgtttttaagtcgtgaaaaacagcgttatgaacatcctttgcccagtcgggaatggataatcgagctgcttgaacgtaaaggcgtaccatccaagattgaagctttggtacgcgaattgtcgattaaggaagaagagtacgaatttttcgaacgtcgtctgaaggcgatggcgcgggacggtcaggttttaatcaaccgtcggggcgcggtttgcgcggcggacaaattggatttggtcaaatgccgtgtcaaggcgcacaaagaccgcttcggtttcgccgtgccgctcacgcccgccaaagacggtgattttgtcttgtacgaacgccagatgcgcggcattatgcacggcgatattgtcactgttcgtcctgccggcatggacggtaggggccgccgcgaagggacggttctggatattgtcgaacgcgcgcaaagcaaagtggtcggccgtttctanatggataggggcgtggcgattttggagccggaagacaagcgtctgaaccaaagcatcgtattggaaccggacggcgtggcgcgtttcaaacctgaatccggtcaggtcatcgtcggcgaaattgaggtttatcctgagcaaaaccggccggcagtggcaaaaatcatcgaagttttgggcgattatgccgacagcggcatggagattgaaattgccgtgcgcaagcatcatttgccgcaccaattcagtgaagcgtgtgccaaagccgcgaaaaaaattcccgaccatgtacgcaaaagcgatttgaaaggccgcgtcgatttgcgcgacctgcctttggtaacgatagacggcgaaacggctcgagattttgacgatgcggtgtttgccgagaaaatcggacgcaattaccgtctggtcgtggcgattgccgatgtcagccattatgtccgccccgatgacgctatcgacacggacgctcaggaacgcagcaccagtgtttacttcccgcgccgcgtgattcccatgttgccggaaaacctgtccaacggcatctgctcgctcaatcctcatgtcgagcgtttgtgtgtggtgtgcgatatggttatcacttacgcgggcaatatcaaagaataccgcttctaccccgccgtgatgcgctctcatgcccgcctgacctacaaccaagtttggaaatggctttcaggcggcatcgagcatccgttcaaaacccaaatcgacacgctttacaaactcttcaaaatccttcagaaaaagcgtttcgaacgcggggcggtggagtttgacagcatcgaaacccaaatgcttttcgacgacaacggtaaaattgaaaaaatcgtccccgttgtccgcaacgatgcccacaagctgattgaagaatgtatgttggcggcaaacgtttgcgcagcggattttctgttgaaaaacaagcataccgcattgttccgcaaccatttggggcccacgcccgaaaaactcgccgccttgcgcgagcagctcggtctgttggggcttcaacttggcggcggcgacaacccgtcgccgaaagactatgccgcgcttgccggacagttcaaaggcaggccggatgccgaattgctgcaagtcatgatgttgcgctccatgcaacaggcggtttacgaaccgcattgcgacggacactttggtcttgcctacgaagcatacgcccacttcacctcgcccatccgccgctatcccgacctgaccgtacaccgcgccatcaaagccgtgttgaatcagcaaacctacacgccaaaaaaaagctggcaggctttgggcgtgcatacctcgttctgtgagcgccgtgccgacgacgccagccgcgacgtggaaaactggctgaaaacctattatatgcgcgataaggtcggcgaagtattcgaaggtaaaatctccggcatgaccagttttggtatctttgtaacactggacggcatccacattgacggcttggtgcatatcagcgatttgggcgaagactatttcaacttccgccccgaaatcatggcaatcgaaggcgaacgcagcggcatccgtttcaacatgggggacagggttgccgtccgggtcgcccgtgccgatttggatgacggaaaaatcgattttgtcctgattgccggggggagcggcagggggcggaaagttaaatcatccgcgtctgccaaaccggcagggacggcggggaaagggaagccgaaaaccgccgccgagaaaaaaacagcccgaggcggcaaagtaaggggaaggggcgcgtctgccgccgcagaatcgaggaaaaaggcaaagaaaccggttccgattaaggtaaaaaaacggaaaggcaaatcataa

SEQ ID NO: 3966 - protein, 791 aa, Neisseria meningitidis
  VARIANT (1)...(791): Xaa = Any Amino Acid
MNKNIKSLNLREKDPFLSREKQRYEHPLPSREWIIELLERKGVPSKIEALVRELSIKEEEYEFFERRLKAMARDGQVLINRRGAVCAADKLDLVKCRVKAHKDRFGFAVPLTPAKDGDFVLYERQMRGIMHGDIVTVRPAGMDGRGRREGTVLDIVERAQSKVVGRFXMDRGVAILEPEDKRLNQSIVLEPDGVARFKPESGQVIVGEIEVYPEQNRPAVAKIIEVLGDYADSGMEIEIAVRKHHLPHQFSEACAKAAKKIPDHVRKSDLKGRVDLRDLPLVTIDGETARDFDDAVFAEKIGRNYRLVVAIADVSHYVRPDDAIDTDAQERSTSVYFPRRVIPMLPENLSNGICSLNPHVERLCVVCDMVITYAGNIKEYRFYPAVMRSHARLTYNQVWKWLSGGIEHPFKTQIDTLYKLFKILQKKRFERGAVEFDSIETQMLFDDNGKIEKIVPVVRNDAHKLIEECMLAANVCAADFLLKNKHTALFRNHLGPTPEKLAALREQLGLLGLQLGGGDNPSPKDYAALAGQFKGRPDAELLQVMMLRSMQQAVYEPHCDGHFGLAYEAYAHFTSPIRRYPDLTVHRAIKAVLNQQTYTPKKSWQALGVHTSFCERRADDASRDVENWLKTYYMRDKVGEVFEGKISGMTSFGIFVTLDGIHIDGLVHISDLGEDYFNFRPEIMAIEGERSGIRFNMGDRVAVRVARADLDDGKIDFVLIAGGSGRGRKVKSSASAKPAGTAGKGKPKTAAEKKTARGGKVRGRGASAAAESRKKAKKPVPIKVKKRKGKS

SEQ ID NO: 3967 - DNA, 1383 bp, Neisseria meningitidis
atgacccctttcacactgaaaaaaaccgtcctgctgctcggcactgcctttgccgccgcatctgtccacgcatccggctaccacttcggcacacagtcggtcaacgcgcaaagcacggcaaatgccgccgacgcgtcgaccatcttctacaatcccgccggcctgaccaaactcgacagcagccagatttccgtcaacgccaacatcgtgctgcccagcattcattatgaagcagattccgccaccgactttaccgggcttcccgtccaaggttctaaaaacggcaaaatcaccaaaaccacggtcgcaccccacatttacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaacgccattccttcggcgcaggcatcatcgcccaacataattccgccgaactgcgcaaatatgccgactgaggaatcccaaaaaaagcgcaaatgctgcaagcaacaccttctaatcctactgccgctgctcaaatcaaggccgacggacacgccgatgtcaaaggcagcgattggggcgtcggctaccaactggcgtggatgtgggacatcaacgaccgcgcgcgcgtgggcgtgaactaccgttccaaagtttcacacacgctcaaaggcgatgccgaatgggcggcagacggcgcggcggcgaaacaacagtggaatgacaatatgctcacaccgctcggttacacggcgaatgaaaaagccagtgtcaaaatcgtaacgcctgagtctttgtccgtacacggcatgtacaaagtgtccgacaaagccgacctgttcggcgacgtaacttggacgcgccacagccgcttcaataaggcggaactgttttttgaaaaagaaaaaaatattgctaatggcaaaaaatccgaccgcaccaccatcacccccaactggcgcaacacctacaaagtcggcttgggcggttcttatcaaatcagcgaaccgctgcaactgcgcgtcggcatcgcttttgacaaaccgcctgtccgcaacgccgactaccgcatgaacagcctgcccgacggcaaccgcatctggttctccgccggcatgaaataccatatcggcaaaaaccacgtcgtcgatgccgcctacacccacatccacatcaacgacaccagctaccgcacggcgaaggcaagcggcaacgatgtggacagcaaaggtgcgtcttgcgcacgtttcaaaaaccacgccgacatcatcggcctgcaatacacctacaaattcaaataa

SEQ ID NO: 3968 - protein, 459 aa, Neisseria meningitidis
MTPFTLKKTVLLLGTAFAAASVHASGYHFGTQSVNAQSTANAADASTIFYNPAGLTKLDSSQISVNANIVLPSIHYEADSATDFTGLPVQGSKNGKITKTTVAPHIYGAYKVNDNLTVGLGVYVPFGSATEYEKDSVLRHNINKLGLTSIAVEPVAAWKLNERHSFGAGIIAQHNSAELRKYADGIPKKAQMLQATPSNPTAAAQIKADGHADVKGSDWGVGYQLAWMWDINDRARVGVNYRSKVSHTLKGDAEWAADGAAAKQQWNDNMLTPLGYTANEKASVKIVTPESLSVHGMYKVSDKADLFGDVTWTRHSRFNKAELFFEKEKNIANGKKSDRTTITPNWRNTYKVGLGGSYQISEPLQLRVGIAFDKPPVRNADYRMNSLPDGNRIWFSAGMKYHIGKNHVVDAAYTHIHINDTSYRTAKASGNDVDSKGASCARFKNHADIIGLQYTYKFK

SEQ ID NO: 3969 - DNA, 1401 bp, Neisseria meningitidis
atgaccccttccgcactgaaaaaaaccgtcctgctgctcggcactgcctttgccgccgcatccgtccacgcatccggctaccacttcggcacacagtcggtcaacgcgcaaagcacggcaaatgccgccgccgcagaagccgccgacgcatcgaccatcttctacaaccctgccggcctgaccaaactcgacagcagccagatttccgtcaacgccaacatcgtgctgcccagcattcattatgaggcggattccgccaccgactttaccgggcttcccgtccaaggttcgaaaagcggcaaaatcaccaaaaccacggtcgcgccccacatctacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaccgccattccttcggcgcaggcatcatcgcccaacatacttccgccgaactgcgcaaatatgccgactgggggattaagagtaaagcagagatattgacggcaaaaccgcccaaacctaacggtgtagccgaagctgcaaaaattcaggccgacggacacgccgatgtcaaaggcagcgattggggcttcggctaccaactggcgtggatgtgggacatcaacgaccgtgcgcgcgtgggcgtgaactaccgttccaaagtctcgcacacgctcaaaggcgatgccgaatgggcggcagacggcgcggcggcgaaagcaatgtggagtacgatgcttgcagcaaacggctacacggcgaatgaaaaagcccgcgttaaaatcgttacgcctgagtctttgtccgtacacggtatgtacaaagtgtccgataaagccgacctgttcggcgacgtaacttggacgcgccacagccgcttcgataaggcggaactggtttttgaaaaagaaaaaaccgtcgtcaaaggcaaatccgaccgcaccaccatcacccccaactggcgcaacacctacaaagtcggcttcggcggttcttatcaaatcagcgaaccgctgcaactgcgcgccggcatcgcttttgacaaatcgcccgtccgcaacgccgactaccgcatgaacagcctacccgacggcaaccgcatctggttctccgccggtatgaaataccatatcggtaaaaaccacgtcgtcgatgccgcctacacccacatccacatcaacgacaccagctaccgcacggcgaaggcaagcggcaacgatgtggacagcaaaggcgcgtcttccgcacgtttcaaaaaccacgccgacatcatcggtctgcaatacacctacaaattcaaataa

SEQ ID NO: 3970 - protein, 466 aa, Neisseria meningitidis
MTPSALKKTVLLLGTAFAAASVHASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 3971 - DNA, 1395 bp, Neisseria meningitidis
atgaccccttccgcactgaaaaaaaccgtcctactgctcggcactgcctttgccgccgcatccgcacaagcctccggctaccacttcggcacacagtcggtcaacgcgcaaagcacggcaaatgccgccgccgcagaagccgccgacgcatcgaccatcttctacaaccctgccggcctgaccaaactcgacagcagccagatttccgtcaacgccaacatcgtgctgcccagcattcattatgaggcggattccgccaccgactttaccgggcttcccgtccaaggttcgaaaagcggcaaaatcaccaaaaccacggtcgcgccccacatctacggcgcatacaaagtcaacgacaatctgaccgtaggcttgggcgtgtacgtccccttcggttctgccaccgaatacgaaaaagattccgtgttgcgccacaacatcaacaaactcggtctgaccagcatcgccgtcgaacctgtcgccgcgtggaaactcaacgaacgccattccttcggcgcaggcatcatcgcccaacatacttccgccgagctgcgcaaatatgccgactgggggattatggaaaaagcgaaagcactaaaagaaacaccccccaatccaactaaagccgcccaaatcaaagccgacggacacgccgatgtcaaaggcagcgattggggcttcggctaccaactggcgtggatgtgggacatcaacgaccgtgcgcgcgtgggcgtgaactaccgttccaaagtctcacacacgctcaaaggcgatgccgaatgggcggcagacgacgcaatggcgaaacagttatgggatgcaaacaaactcgcactgctcggctacacgccaagcgaaaaagcccgcgttaaaatcgttacgcccgagtctttgtccgtacacggtatgtacaaagtgtccgacaaagccgacctgttcggcgacgtaacttggacgcgccacagccgcttcgataaggcggaactggtttttgaaaaagaaaaaaccatcgtcaacggcaaatccgaccgcaccaccatcacccccaactggcgcaacacctacaaagtcggcttcggcggttcttatcaaatcagcgaaccgctgcaactgcgcgccggcatcgcttttgacaaatcgcccgtccgcaacgccgactaccgcatgaacagcctgcccgacggcaaccgcatctggttctccgccggcatgaaataccatatcggcaaaaaccacgtcgtcgatgccgcctacacccacatccacatcaacgacaccagctaccgcacggcgaaggcaagcggcaacgatgtggacagcaaaggcgcgtcttccgcacgtttcaaaaaccacgccgacatcatcggcctgcaatacacctacaaattcaaataa

SEQ ID NO: 3972 - protein, 464 aa, Neisseria meningitidis
MTPSALKKTVLLLGTAFAAASAQASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIMEKAKALKETPPNPTKAAQIKADGHADVKGSDWGFGYQLAWMWDINDRARVGVNYRSKVSHTLKGDAEWAADDAMAKQLWDANKLALLGYTPSEKARVKIVTPESLSVHGMYKVSDKADLFGDVTWTRHSRFDKAELVFEKEKTIVNGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 3973 - DNA, 1860 bp, Neisseria meningitidis
atgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaattacaatagcggcatcctcgccgtcgataatatgcccgttgtcaaaaaatatattacagagaagtatggggctgatttaaagcaggcggttaaaagtcaattacaggatttatacaaaacaagaccggaagcttgggcagaaaataaaaaacggactgaggaggcgtatatagcacagtttggaacaaaatttagtacgctcaaacagacgatgcccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatacgctggaaacttccgataatgcccgcatccgcctgaacacgaaagatgaaaaactgaccgtccataaggattatgcgggcggcgcggatttcctgttcggctacgacgtgcgggagtcggacgaacccgccctgacctttgaagacaaagtcagcggacaatccggcgtggttttggaacgccggccggaaaatctgaaaacgctcgacgggcgcaaactgattgcggcaaaaacggcggattccggttcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgtttgggctgcgtgccgccgacaggggcgacgacgtgtatgccgccgatccgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagccgactggcaatcggcgtgatgggcggcagggccggccagcacgcatcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgcacgcatcggatatggcaaaaggacggacggcgacaaagaagccgcattgtcgctcaaatggctgttttga

SEQ ID NO: 3974 - protein, 619 aa, Neisseria meningitidis
MFRAQLGSNTRSTKIGDDADFSFSDKPKPGTSHYFSSGKTDQNSSEYGYDEINIQGKNYNSGILAVDNMPVVKKYITEKYGADLKQAVKSQLQDLYKTRPEAWAENKKRTEEAYIAQFGTKFSTLKQTMPDLINKLVEDSVLTPHSNTSQTSLNNIFNKKLHVKIENKSHVAGQVLELTKMTLKDSLWEPRRHSDIHTLETSDNARIRLNTKDEKLTVHKDYAGGADFLFGYDVRESDEPALTFEDKVSGQSGVVLERRPENLKTLDGRKLIAAKTADSGSFAFKQNYRQGLYELLLKQCEGGFCLGVQRLAIPEAEAVLYAQQAYAANTLFGLRAADRGDDVYAADPSRQKLWLRFIGGRSHQNIRGGAAADGWRKGVQIGGEVFVRQNEGSRLAIGVMGGRAGQHASVNGKGGAAGSDLYGYGGGVYAAWHQLRDKQTGAYLDGWLQYQRFKHRINDENRAERYKTKGWTASVEGGYNALVAEGIVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 3975 - DNA, 1860 bp, Neisseria meningitidis; identical to SEQ ID NO: 453

SEQ ID NO: 3976 - protein, 619 aa, Neisseria meningitidis; identical to SEQ ID NO: 454

SEQ ID NO: 3977 - DNA, 702 bp, Neisseria meningitidis
atgttcagacggcatcggcatttgaaaaatatgcagattaaaaaaatcatgaaatggcttcccgtcgccctgtcgcttttgggcgcgttgggttatacgggatatgacagtgaggcggtgcggacggcggttgccgtactcgacgtactcggcactgcaggggacgtgggtttcgacgcgcccgttcgccgacgggcatcggcgaaatccggccacagctacacaggcacggtgtccaaagtctatgacggcgatacccttcacgtcatcgacggcgacggcgcgaaacataaaattcggatggcgtatatcgacgcaccggagatgaaacaggcttacggtacacgttcgcgcgacaacctgcgcgcggcggcggagggtaggaaagtcagtgtacgtgtgtttgaaaccgaccgctatcagcgcgaagtggcgcaggtatccgccggcaaaaccgatttgaacctgatgcaggtgcaggacggggcggcgtggcattataaaagttatgctaaagaacagcaggataaggcggattttgccgactatgccgacgctcaaattcaggcggaaagggaacgcaaaggattgtggaaagctaaaaatccgcaagcgccgtgggcgtaccgccgggcaggcaggagcggcgggggcaataaggattggatggattccgtgggcgaatggttgggcatttggtaa

SEQ ID NO: 3978 - protein, 233 aa, Neisseria meningitidis
MFRRHRHLKNMQIKKIMKWLPVALSLLGALGYTGYDSEAVRTAVAVLDVLGTAGDVGFDAPVRRRASAKSGHSYTGTVSKVYDGDTLHVIDGDGAKHKIRMAYIDAPEMKQAYGTRSRDNLRAAAEGRKVSVRVFETDRYQREVAQVSAGKTDLNLMQVQDGAAWHYKSYAKEQQDKADFADYADAQIQAERERKGLWKAKNPQAPWAYRRAGRSGGGNKDWMDSVGEWLGIW

SEQ ID NO: 3979 - DNA, 702 bp, Neisseria meningitidis
atgttcagacggcatcggcatttgaaaaatatgcagattaaaaaaatcatgaaatggcttcccgtcgccctgtcgcttttgggtgcgttgggttatacggggtacggcagcgaggcggtgcggacggcggttgccgtactcgacgtactcggcgcggcaggggacgcgggttccgacgcgcccgcccgccgccgagcatcggcgaaatccggccaccgctacacaggcacggtgtccaaagtctatgacggcgacacccttcacgttatcgacggcgacggcgcgaaacacaaaatccggatggcgtatatcgacgcgccggagatgaaacaggcttacggcacgcgttcgcgcgacaacctgcgcgcggcggcggaaggcaggaaagtcagcgtgcgcgtgttcgataccgaccgctaccagcgcgaagtggcgcaggtttctgtcggcaaaaccgatttgaacctgatgcaggtgcaggacggggcggcgtggcattataaaagttatgctaaagaacagcaggataaggcggattttgccgattatgccgacgctcaaattcaggcggaaagggaacgcaaaggattgtggaaagctaaaaatccgcaagcgccgtgggcgtaccgccgagcaggcaggagcggcgggggcaataaggattggatggatgccgtgggcgaatggttgggcatttggtaa

SEQ ID NO: 3980 - protein, 233 aa, Neisseria meningitidis
MFRRHRHLKNMQIKKIMKWLPVALSLLGALGYTGYGSEAVRTAVAVLDVLGAAGDAGSDAPARRRASAKSGHRYTGTVSKVYDGDTLHVIDGDGAKHKIRMAYIDAPEMKQAYGTRSRDNLRAAAEGRKVSVRVFDTDRYQREVAQVSVGKTDLNLMQVQDGAAWHYKSYAKEQQDKADFADYADAQIQAERERKGLWKAKNPQAPWAYRRAGRSGGGNKDWMDAVGEWLGIW

SEQ ID NO: 3981 - DNA, 702 bp, Neisseria meningitidis
atgttcagacggcatcggcatttgaaaaatatgcagattaaaaaaatcatgaaatggcttcccgtcgccttgtcgcttttgggtgcgttgggttatacggggtacggcagcgaggcggtgcggacggcggttgccgtactcgacgtactcggcgcggcaggggacgcgggttccgacgcgcccgcccgccgccgagcatcggcgaaatccggccaccgctacacaggcacggtgtccaaagtctatgacggcgacacccttcacgttatcgacggcgacggcgcgaaacacaaaatccggatggcgtatatcgacgcgccggagatgaaacaggcttacggcacgcgttcgcgcgacaacctgcgcgcggcggcggaaggcaggaaagtcagcgtccgcgtgttcgacaccgaccgctaccagcgcgaagtggcgcaggtttctgtcggcaaaaccgatttgaacctgatgcaggtgcaggacggggcggcgtggcattataaaagttatgctaaagaacagcaggataaggcggattttgccgattatgccgacgctcaaattcaggcggaaagggaacgcaaaggattgtggaaagctaaaaatccgcaagcgccgtgggcgtaccgccgggcaggcaggagcggcgggggcaataaggattggatggatgccgtgggcgaatggttgggcatttggtaa

SEQ ID NO: 3982 - protein, 233 aa, Neisseria meningitidis; identical to SEQ ID NO: 3980

SEQ ID NO: 3983 - DNA, 747 bp, Neisseria meningitidis
ctgaaagtcgtattgggcagttttcaaggccctttggatctgctgctctaccttatccgcaagcagaacatcgatgttctcgatattccgatggtggaaattaccgggcagtatctgcactatattgcccaaatggaagcctatcagtttgatttggcggcggaatatcttttgatggcggcaatgctgattgaaatcaaatcgcgcctgctgctgccgcgtaccgaagccgtcgaagacgaagaggccgacccgcgtgccgagttggtgcgccgtctgcttgcctacgagcaaatgaaactggcggcgcagggtttggacgcgctgccgcgtgcgggacgggatttcgcgtgggcttacctgccgctggaaattgcagccgagacgaagctgcccgaggtttacatcgccgatttgatgcaggcatggttgggcattctttctcgggcaaaacatacgcgcagccacgaagtaatccaagaaaccctttccgtgcgcgcgcaaatgacggcaatcctgcgccgtttgaacgaacacgggatatgcaggtttcacgccctgttcaatcccgaacagggcgcggcttacgtgatcgtcaacttcatcgccctgttggagcttgccaaagaaggattggtcggaatcgtacaggaagacggtttcggagaaatccgaatcagcctcaatcatgagggggcgcattcagacggcattttcggcacacggggcgggcgcgatgtgttctaa

SEQ ID NO: 3984 - protein, 248 aa, Neisseria meningitidis
LKVVLGSFQGPLDLLLYLIRKQNIDVLDIPMVEITGQYLHYIAQMEAYQFDLAAEYLLMAAMLIEIKSRLLLPRTEAVEDEEADPRAELVRRLLAYEQMKLAAQGLDALPRAGRDFAWAYLPLEIAAETKLPEVYIADLMQAWLGILSRAKHTRSHEVIQETLSVRAQMTAILRRLNEHGICRFHALFNPEQGAAYVIVNFIALLELAKEGLVGIVQEDGFGEIRISLNHEGAHSDGIFGTRGGRDVF

SEQ ID NO: 3985 - DNA, 747 bp, Neisseria meningitidis
ttgaaagtcgtattgggcagcttccaaggccctttggatctactgctgtatctgatccgcaaacagaatatcgacgtactggatattccgatggtgaagattaccgagcagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgaacagatgaagctggcggcgcagggtttggacgcgctgccccgagccggacgggatttcgcgtgggcttacctgccgctggaaattgccgtcgaagccaagctgcccgaagtctatattaccgacttgacgcaagcgtggctgggtattttgtctcgggcaaaacacacgcgcagccacgaagtaatcaaagaaaccatctccgtgcgcgcgcaaatgacggcaatcctgcgccgtttgaacggacacggaatatgcaggtttcacgacctgttcaatcccaaacagggcgcggcttacgtggtcgtcaacttcatcgcactgttggagcttgccaaagaaggattggtcagaatcgtgcaggaagacggtttcggagaaatccgaatcagcctcaatcatgagggggcgcattcagacggcatttccggcacacgaggcgggcgcgatgtgttctaa

SEQ ID NO: 3986 - protein, 248 aa, Neisseria meningitidis
LKVVLGSFQGPLDLLLYLIRKQNIDVLDIPMVKITEQYLHYIAQIETYQFDLAAEYLLMAAMLIEIKSRLLLPRTETVEDEEADPRAELVRRLLAYEQMKLAAQGLDALPRAGRDFAWAYLPLEIAVEAKLPEVYITDLTQAWLGILSRAKHTRSHEVIKETISVRAQMTAILRRLNGHGICRFHDLFNPKQGAAYVVVNFIALLELAKEGLVRIVQEDGFGEIRISLNHEGAHSDGISGTRGGRDVF

SEQ ID NO: 3987 - DNA, 747 bp, Neisseria meningitidis
ctgaaagtcgtattgagcagttttcaaggccctttggatctgctgctctaccttatccgcaagcagaacatcgatgttctcgatattccgatggtgaagattaccgaacagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgagcagatgaagctggcggcacaagggttggatgcgcttcctcgtgcgggccgggatttcgcatgggcatacctgccactggaaattgccgtcgaagccaagctgcccgaagtctatattaccgacttgacgcaggcgtggctgagtattttgtctcgggcaaaacatacgcgcagccacgaagttatcaaagaaaccatctccgtgcgcgcgcaaatgacggcaatcctgcgccgtttgaacaaacacgggatatgcaggtttcacgacctgttcaatcccgaacagggcgcggcttacgtggtcgtcaacttcatcgcactgttggagcttgccaaagaaggtttggtcggaatcgtacaggaagtcggtttcggagaaatccgaatcagcctcaatcatgagggggcgcattcagacggcatttccggcacacggggcgggcgcgatgtgttctaa

SEQ ID NO: 3988 - protein, 248 aa, Neisseria meningitidis
LKVVLSSFQGPLDLLLYLIRKQNIDVLDIPMVKITEQYLHYIAQIETYQFDLAAEYLLMAAMLIEIKSRLLLPRTETVEDEEADPRAELVRRLLAYEQMKLAAQGLDALPRAGRDFAWAYLPLEIAVEAKLPEVYITDLTQAWLSILSRAKHTRSHEVIKETISVRAQMTAILRRLNKHGICRFHDLFNPEQGAAYVVVNFIALLELAKEGLVGIVQEVGFGEIRISLNHEGAHSDGISGTRGGRDVF

SEQ ID NO: 3989 - DNA, 624 bp, Neisseria meningitidis
atgaacagaagaaccttcctcctcggcgcaggcgcgttgcttcttaccgcctgcggcagaaaatccgcccgaacccacgccaaaattcccgaaggaagcaccgtgcttgccttgggcgattcgctcaccttcggctacggagcaaaccccggcgaatcctaccccgcgcaactgcaaaaactgacgggttggaatattgtcaacggcggcgtatcgggcgatacgtccgcgcaagccctatcgcgcctgcccgcgctgttggcacgcaaacccaagcttgtgattgtcggcataggcggcaacgactttctgcgcaaagttcccgaggagcagacccgcgccaatatcgcgaaaatcatcgaaaccgtgcaaaaggaaaacattcccgccgtcctcgtcggcgtgccgcacatcacactgggcgcgttgttcgggcatttgagcgaccatccgctgtatgaggatttgtccgaggaatacggcattccgttgttcggcggcgcgtgggcggaaattttgggcaataataatctgaaatccgaccaaatccacgccaacggcaaaggctatcggaaattcgccgaaaatttgaatcaatttttgagaaaacatgggtttagataa

SEQ ID NO: 3990 - protein, 207 aa, Neisseria meningitidis
MNRRTFLLGAGALLLTACGRKSARTHAKIPEGSTVLALGDSLTFGYGANPGESYPAQLQKLTGWNIVNGGVSGDTSAQALSRLPALLARKPKLVIVGIGGNDFLRKVPEEQTRANIAKIIETVQKENIPAVLVGVPHITLGALFGHLSDHPLYEDLSEEYGIPLFGGAWAEILGNNNLKSDQIHANGKGYRKFAENLNQFLRKHGFR

SEQ ID NO: 3991 - DNA, 624 bp, Neisseria meningitidis
atgaacagaagaaccttcctcctcggcgcaggcgcgttgctgcttaccgcctgcggcagaaaatccgcccgaacccacgccaaaattcccgaaggaagcaccgtacttgccttgggcgattcgcttaccttcggctacggcgcaaaccctggcgaatcctaccccgcgcaactgcaaaaactgacgggttggaatattgtcaacggcggcgtatcgggcgatacatctgcccaagccctgtcgcgcctgcccgcgctgttggcacgcaaacccaagcttgtgattgtcggcataggcggcaacgactttctgcgcaaagttcccaaggagcagacccgcgccaatatcgcgaaaatcatcgaaaccgtgcagaaggaaaacatccccgccgtcctcgtcggcgtgccgcacatcacactgggtgcgttgttcgggcatttgagcgatcatccgctgtatgaggatttgtccgaggaatacggcattccgctgttcggcggcgcgtgggcggaaattttgggcgataataatctgaaatccgaccaaatccacgccaacggcaaaggctatcggaaatttgccgaagatttgaatcaatttttgagaaaacaggggtttagataa

SEQ ID NO: 3992 - protein, 207 aa, Neisseria meningitidis
MNRRTFLLGAGALLLTACGRKSARTHAKIPEGSTVLALGDSLTFGYGANPGESYPAQLQKLTGWNIVNGGVSGDTSAQALSRLPALLARKPKLVIVGIGGNDFLRKVPKEQTRANIAKIIETVQKENIPAVLVGVPHITLGALFGHLSDHPLYEDLSEEYGIPLFGGAWAEILGDNNLKSDQIHANGKGYRKFAEDLNQFLRKQGFR

SEQ ID NO: 3993 - DNA, 624 bp, Neisseria meningitidis
atgaacagaagaaccttcctcctcggcgcaggcgcgttgctccttaccgcctgcggcagaaaatccgcccgaacccacgccaaaattcccgaaggaagcaccgtacttgccttgggcgattcgcttaccttcggctacggcgcaaaccccggcgaatcctaccccgcgcaactgcaaaaactgacgggttggaatattgtcaacggcggcgtatcgggcgatacatccgcccaagccctgtcgcgcctgcccgcgctgttggcacgcaaacccaagcttgtgattgtcggcataggcggcaacgactttctgcgcaaagttcccaaggagcagacccgcgccaatatcgcgaaaatcatcgaaaccgtgcagaaggaaaacatccccgccgtcctcgtcggcgtgccgcacattaccttgggcgcgttgttcgggcatttgagcgatcatccgctgtatgaggatttgtccgaggaatacggcattccgctgttcggcggcgcgtgggcggaaattttgggcgataataatctgaaatccgaccaaatccacgccaacggcaaaggctatcggaaatttgccgaagatttgaatcaatttttgagaaaacaggggtttagataa

SEQ ID NO: 3994 - protein, 207 aa, Neisseria meningitidis; identical to SEQ ID NO: 3992

SEQ ID NO: 3995 - DNA, 1053 bp, Neisseria meningitidis
atgatgaacacgccgcatccgcgcccgaaaatcgccgtcatcggcgcaggctgggccggcttgtccgccgccgtcaccttggcgcggcacgccgacgttaccctgtttgaagccggccggcaggcgggcggaagggcgcgcacactggccggaaataccgacggtttcggttttttggacaacgggcagcacattttgctcggcgcataccggggcgtgttgcgcctgatgaaaaccatcggttcagacccccgtgccgcctttttgcgcgtaccgctgcactggcatatgcacggcggtttgcagttccgcgccctccccctgcccgcgccgctgcatattttgggcggcgtgctgcttgcccggcgcgtaccgtccgcattcaaagccaaactgcttgccgatatgtccgatttgcagaagtccgcacgcctcggacagcccgacacgacagttgcacaatggctgaaacagcggaacgtgccgcgtgccgccgtaatgcagttttggcagcccttggtctggggcgcgctcaacacgcctttggaaaccgcaagcctgcgcgtgttgtgcaacgttttgtccgacggcgtgctgacgaaaaaatccggcagcgactatctcctacccaaacaggatttgggcgcaatcgtcgccgaacccgccttggcggagcttcaacggctcggcgcggacatccgcctcgaaacgcgcgtatgccgtctgaacaccctcccggacggaaaagtcctcgtcaacggcgaagccttcgatgccgccatacttgccaccgcgccctaccacgccgccgcgctcctgcccgaaggcacgcccgaacacgttcagacggcatatcaaaaccttcgctaccacgccatcaccaccgtctatctgcgctacgccgaacccgtccgcctgcccgccccgctgaccggcattgccgacggcacggcacaatggctgctttgcccggggcaggctccggactgcccccaaaacgaagtctccgccgtcattagcgtttccgaccgcgtcggcgcgtttgcaaaccga

SEQ ID NO: 3996 - protein, 351 aa, Neisseria meningitidis
MMNTPHPRPKIAVIGAGWAGLSAAVTLARHADVTLFEAGRQAGGRARTLAGNTDGFGFLDNGQHILLGAYRGVLRLMKTIGSDPRAAFLRVPLHWHMHGGLQFRALPLPAPLHILGGVLLARRVPSAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALAELQRLGADIRLETRVCRLNTLPDGKVLVNGEAFDAAILATAPYHAAALLPEGTPEHVQTAYQNLRYHAITTVYLRYAEPVRLPAPLTGIADGTAQWLLCPGQAPDCPQNEVSAVISVSDRVGAFANR

SEQ ID NO: 3997 - DNA, 1314 bp, Neisseria meningitidis
atgatgaacacgccgcatccgcgcccgaaaatcgccgtcatcggcgcaggctgggcaggactgtccgccgccgtcaccttggcgcggcacgccgacgttaccctgtttgaagccggccggcaggcgggcggcagggcgcgcacactggccggaaataccgacggtttcggttttttggacaacgggcagcacattttgctcggcgcataccggggcgtgttgcgcctgatgaaaaccatcggttcggatccccgtgccgcctttttgcgcgtaccgctgcactggcatatgcacggcggtttgcagttccgcgccctccccctgcccgcgccgctgcatattttgggcggcgtgctgcttgcccggcgtgcaccgactgcattcaaagccaaactgcttgccgatatgtccgatttgcagaagtccgcacgcctcggacagcccgacacgacagtggcgcaatggctgaaacagcggaacgtgccgcgtgccgccgtgatgcagttttggcagcccttggtttggggcgcgctcaacacgcctttggaaaccgcaagcctgcgcgtgttgtgcaacgttttgtccgacggcgtgctgacgaaaaaatccggcagcgactatctcctacccaagcaggatttgggcgcaatcgtcgccgaacccgccttggcggatcttcaacggctcggcgcggacatccgcctcgaaacgcgcgtatgccgtctgaacaccctcccggacgggaaagtgctcgtcaacggcgaagctttcgatgccgccgtccccgccaccgcgccctaccacgccgccgcgctcctgcccgaaggcacgcccgaacacgttcagacggcatatcaaaaccttcgctaccacgccatcaccaccgtctatctgcgctacgccgaacccgtccgcctgcccgccccgctgaccggccttgccgacggcacggtgcaatggctgctttgccggggcaggctcggactgcctgaaaacgaagtgtccgccgtcatcagcgtttccgaccgcgtcggcgcgtttgcaaaccgggcgtgggcggacaaagcccacgccgacctcaaacgcatccttccgcatttgggcgaacccgaagccgtgcgcgtcatcaccgaaaaacgcgccacaaccgcagccgatgccccgccgccggacttgtcgtggttgcaccggcaccgcatcttccccgccggcgactacctccacccggactaccccgccacgctcgaagccgccgtacaatcaggtttcgcgtcggcggaagcctgcctgcaaagcctgagcgatgccgtctga

SEQ ID NO: 3998 - protein, 437 aa, Neisseria meningitidis
MMNTPHPRPKIAVIGAGWAGLSAAVTLARHADVTLFEAGRQAGGRARTLAGNTDGFGFLDNGQHILLGAYRGVLRLMKTIGSDPRAAFLRVPLHWHMHGGLQFRALPLPAPLHILGGVLLARRAPTAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALADLQRLGADIRLETRVCRLNTLPDGKVLVNGEAFDAAVPATAPYHAAALLPEGTPEHVQTAYQNLRYHAITTVYLRYAEPVRLPAPLTGLADGTVQWLLCRGRLGLPENEVSAVISVSDRVGAFANRAWADKAHADLKRILPHLGEPEAVRVITEKRATTAADAPPPDLSWLHRHRIFPAGDYLHPDYPATLEAAVQSGFASAEACLQSLSDAV

SEQ ID NO: 3999 - DNA, 1314 bp, Neisseria meningitidis
atgatgaacacgccgcatccgcgcccgaaaatcgccgtcatcggcgcaggctgggccggcttgtccgccgccgttaccttggcgcggcacgccgacgttaccctgtttgaagccggccggcaggcgggcggcagggcgcgcgcactggccggaaataccgacggtttcggttttttggacaacgggcagcatattttactcggcgcataccggggcgtgttgcgcctgatgaaaaccatcggttcagacccccatgccgcctttttgcgcgtaccgctgcactggcatatgcacggcggtttgcagttccgcgccctccccctgcccgcgcccctgcatattttgggcggcgtgctgcttgcccggcgcgtaccgtccgcattcaaagccaaactgcttgccgatatgtccgatttgcagaagtccgcacgcctcggacagcccgacacgacagtggcgcaatggctgaaacagcggaacgtgccgcgtgccgccgtaatgcagttttggcagcccttggtttggggcgcgctcaacacgcctttggaaaccgcaagcctgcgcgtgttgtgcaacgttttgtccgacggcgtgctgacgaaaaaatccggcagcgactatctcctacccaaacaggatttgggcgcaatcgtcgccgaacccgccttggcggagcttcaacggctcggcgcggacatccgcctcgaaacgcgcatatgccgtctgaacaccctcccggacgggaaagtgctcgtcaacggcgaacctttcgatgccgccgtccccgccaccgcgccctaccacgccgccgcgctcctgcccgaaggcacgcccgaacacgttcagacggcatatcaaaaccttcgctatcacgccatcaccaccgtctatctgcgctatgccgaacccgtccgcttgcctgccccgctgaccggacttgccgacggcacggtgcaatggctgctttgccggggcaggctcggactgcctgaaaacgaagtgtccgccgtcatcagcgtttccgaccgcgtcggcgcgtttgcaaaccgggcgtgggcggacaaagttcacgccgacctcaaacgcatccttccgcatttgggcgaacccgaagccgtgcgcgtcatcaccgaaaaacgcgccacaaccgcagccgatgccccgccgccggatttgtcgtggttgcaccggcaccgcatcttccccgccggcgactacctccacccagactaccccgccacgctcgaagccgccgtacaatcaggtttcgcgtcggcggaagcctgcctgcaaagcctgagcgatgccgtctga

SEQ ID NO: 4000 - protein, 437 aa, Neisseria meningitidis
MMNTPHPRPKIAVIGAGWAGLSAAVTLARHADVTLFEAGRQAGGRARALAGNTDGFGFLDNGQHILLGAYRGVLRLMKTIGSDPHAAFLRVPLHWHMHGGLQFRALPLPAPLHILGGVLLARRVPSAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALAELQRLGADIRLETRICRLNTLPDGKVLVNGEPFDAAVPATAPYHAAALLPEGTPEHVQTAYQNLRYHAITTVYLRYAEPVRLPAPLTGLADGTVQWLLCRGRLGLPENEVSAVISVSDRVGAFANRAWADKVHADLKRILPHLGEPEAVRVITEKRATTAADAPPPDLSWLHRHRIFPAGDYLHPDYPATLEAAVQSGFASAEACLQSLSDAV

SEQ ID NO: 4001 - DNA, 603 bp, Neisseria meningitidis
atgaatatgaaaaaattgatttccgcaatttgtgtttcaattgttttatcagcctgcaaccaacaatcaaaaacggcacaagccgaagaacctgtccaaagtatccaggctgctgattgtaccgccccaatggacatcacagttgaacaatatctcatcaatttggagcaagcatttaaaactcagaacgtctcaacaaaaatccataataaaaatattgtcaagaccgattgtggttatgaccttactttggtaatggattttggggcgattgcgctcaaactggacgagcagcaaaaaattagagctatctcagtaggctacattttaaaaaccgacggagagaaaggacaaaatctagtcaataatgccataaatggattacacagtattcaggcagttctgtctttaactaccacagacaaattgggcgaatcggaagcaggaaaacaactttttacagctttaaccgaagtcgtcaaagaatccaatcagacaggagcaacagcgcaaaaagacgttccggcagatggtattttatatagcgttgtttttgaaaaagaaacaaacaccattgcaataatcggcagaaaacaaccctaa

SEQ ID NO: 4002 - protein, 200 aa, Neisseria meningitidis
MNMKKLISAICVSIVLSACNQQSKTAQAEEPVQSIQAADCTAPMDITVEQYLINLEQAFKTQNVSTKIHNKNIVKTDCGYDLTLVMDFGAIALKLDEQQKIRAISVGYILKTDGEKGQNLVNNAINGLHSIQAVLSLTTTDKLGESEAGKQLFTALTEVVKESNQTGATAQKDVPADGILYSVVFEKETNTIAIIGRKQP

SEQ ID NO: 4003 - DNA, 930 bp, Neisseria meningitidis
ttgtacggtacaattaaagcaggcgtagaaacttcccgctctgtatttcaccagaacggccaagttactgaagttacaaccgctaccggcatcgttgatttgggttcgaaaatcggcttcaaaggccaagaagacctcggtaacggcctgaaagccatttggcaggttgagcaaaaagcatctatcgccggtactgactccggttggggcaaccgccaatccttcatcggcttgaaaggcggcttcggtaaattgcgcgtcggtcgtttgaacagcgtcctgaaagacaccggcgacatcaatccttgggatagcaaaagcgactatttgggtgtaaacaaaattgccgaacccgaggcacgcctcatttccgtacgctacgattctcccgaatttgccggcctcagcggcagcgtacaatacgcgcttaacgacaatgcaggcagacataacagcgaatcttaccacgccggcttcaactacaaaaacggtggcttcttcgtgcaatatggcggtgcctataaaagacatcatcaagtgcaagagggcttgaatattgagaaataccagattcaccgtttggtcagcggttacgacaatgatgccctgtacgcttccgtagccgtacagcaacaagacgcgaaactgactgatgcttccaattcgcacaactctcaaaccgaagttgccgctaccttggcataccgcttcggcaacgtaacgccccgagtttcttacgcccacggcttcaaaggtttggttgatgatgcagacataggcaacgaatacgaccaagtggttgtcggtgcggaatacgacttctccaaacgcacttctgccttggtttctgccggttggttgcaagaaggcaaaggcgaaaacaaattcgtagcgactgccggcggtgttggtctgcgtcacaaattctaa

SEQ ID NO: 4004 - protein, 309 aa, Neisseria meningitidis
LYGTIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLRHKF

SEQ ID NO: 4005 - DNA, 1029 bp, Neisseria meningitidis
atggacgttaccttgtacggtacaattaaagcaggcgtagaagtttctcgcgtaaaagatgctggtacatataaagctcaaggcggaaaatctaaaactgcaacccaaattgccgacttcggttctaaaatcggtttcaaaggtcaagaagacctcggcaacggcatgaaagccatttggcagttggaacaaaaagcctccatcgccggcactaacagcggctggggtaaccgccagtccttcatcggcttgaaaggcggcttcggtaccgtccgcgccggtaatctgaacaccgtattgaaagacagcggcgacaacgtcaatgcatgggaatctggttctaacaccgaagatgtactgggactgggtactatcggtcgtgtagaaagccgtgaaatctccgtacgctacgactctcccgtatttgcaggcttcagcggcagcgtacaatacgttccgcgcgataatgcgaatgatgtggataaatacaaacatacgaagtccagccgtgagtcttaccacgccggtctgaaatacgaaaatgccggtttcttcggtcaatacgcaggttcttttgccaaatatgctgatttgaacactgatgcagaacgtgttgcagtaaatactgcaaatgcccatcctgttaaggattaccaagtacaccgcgtagttgccggttacgatgccaatgacctgtacgtttctgttgccggtcagtatgaagctgctaaaaacaacgaggttggttctaccaagggtaaaaaacacgagcaaactcaagttgccgctactgccgcttaccgttttggcaacgtaacgcctcgcgtttcttacgcccacggcttcaaagctaaagtgaatggcgtgaaagacgcaaattaccaatacgaccaagttatcgttggtgccgactacgacttctccaaacgcacttccgctctggtttctgccggttggttgaaacaaggtaaaggcgcgggaaaagtcgaacaaactgccagcatggttggtctgcgtcacaaattctaa

SEQ ID NO: 4006 - DNA, 942 bp, Neisseria meningitidis
atggacgttaccctgtacggcaccattaaagcaggcgtagaaacttcccgctctgtatttcaccagaacggccaagttactgaagttacaaccgctaccggcatcgttgatttgggttcgaaaatcggcttcaaaggccaagaagacctcggtaacggcctgaaagccatttggcaggttgagcaaaaagcatctatcgccggtactgactccggttggggcaaccgccaatccttcatcggcttgaaaggcggcttcggtaaattgcgcgtcggtcgtttgaacagcgtcctgaaagacaccggcgacatcaatccttgggatagcaaaagcgactatttgggtgtaaacaaaattgccgaacccgaggcacgcctcatttccgtacgctacgattctcccgaatttgccggcctcagcggcagcgtacaatacgcgcttaacgacaatgcaggcagacataacagcgaatcttaccacgccggcttcaactacaaaaacggtggcttcttcgtgcaatatggcggtgcctataaaagacatcatcaagtgcaagagggcttgaatattgagaaataccagattcaccgtttggtcagcggttacgacaatgatgccctgtacgcttccgtagccgtacagcaacaagacgcgaaactgactgatgcttccaattcgcacaactctcaaaccgaagttgccgctaccttggcataccgcttcggcaacgtaacgccccgagtttcttacgcccacggcttcaaaggtttggttgatgatgcagacataggcaacgaatacgaccaagtggttgtcggtgcggaatatgacttctccaaacgcacttctgccttggtttctgccggttggttgcaagaaggcaaaggcgaaaacaaattcgtagcgactgccggcggtgtcggtctgcgccacaaattctaa

SEQ ID NO: 4007 - protein, 313 aa, Neisseria meningitidis
MDVTLYGTIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLRHKF

SEQ ID NO: 4008 - DNA, 830 bp, Neisseria meningitidis
tcggcaaagcagccggataccgctacgtatcttgaagtattgaaaatattacgatgcaaaaaagaaaatttaagtataatacagcaggattctttaacggattcttaacaatttttctaactgaccataaaggaaccaaaatatgaaaaaagcacttgccacactgattgccctcgctctcccggccgccgcactggcggaaggcgcatccggcttttacgtccaagccgatgccgcacacgcaaaagcctcaagctctttaggttctgccaaaggcttcagcccgcgcatctccgcaggctaccgcatcaacgacctccgcttcgccgtcgattacacgcgctacaaaaactataaagccccatccaccgatttcaaactttacagcatcggcgcgtccgccatttacgacttcgacacccaatcgcccgtcaaaccgtatctcggcgcgcgcttgagcctcaaccgcgcctccgtcgacttgggcggcagcgacagcttcagccaaacctccatcggcctcggcgtattgacgggcgtaagctatgccgttaccccgaatgtcgatttggatgccggctaccgctacaactacatcggcaaagtcaacactgtcaaaaacgtccgttccggcgaactgtccgtcggcgtgcgcgtcaaattctgatatgcgccttattctgcaaaccgccgagccttcggcggttttgttttctgccaccgcaactacacaagccggcggttttgtacgataatcccgaatgctgcggcttctgccgccctattttttgaggaatccgaaatgtccaaaaccatcatccacaccgaca

SEQ ID NO: 4009 - protein, 174 aa, Neisseria meningitidis
MKKALATLIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSIGLGVLTGVSYAVTPNVDLDAGYRYNYIGKVNTVKNVRSGELSVGVRVKF

SEQ ID NO: 4010 - DNA, 710 bp, Neisseria meningitidis
gtatcttgaggcattgaaaatattacaatgcaaaaagaaaatttcagtataatacggcaggattctttaacggattcttaaccatttttctccctgaccataaaggaatcaagatatgaaaaaagcacttgccgcactgattgccctcgccctcccggccgccgcactggcggaaggcgcatccggcttttacgtccaagccgatgccgcacacgccaaagcctcaagctctttaggttctgccaaaggcttcagcccgcgcatctccgcaggctaccgcatcaacgacctccgcttcgccgtcgattacacgcgctacaaaaactataaacaagtcccatccaccgatttcaaactttacagcatcggcgcgtccgccatttacgacttcgacacccaatcccccgtcaaaccgtatctcggcgcgcgcttgagcctcaaccgcgcctccgtcgactttaacggcagcgacagcttcagccaaacctccaccggcctcggcgtattggcgggcgtaagctatgccgttaccccgaatgtcgatttggatgccggctaccgctacaactacatcggcaaagtcaacactgtcaaaaatgtccgttccggcgaactgtccgccggcgtacgcgtcaaattctgatatacgcgttattccgcaaaccgccgagcctttcggcggttttgttttccgccgccgcaactacaca

SEQ ID NO: 4011 - protein, 175 aa, Neisseria meningitidis
MKKALAALIALALPAAALAEGASGFYVQADAAHAKASSSLGSAKGFSPRISAGYRINDLRFAVDYTRYKNYKQVPSTDFKLYSIGASAIYDFDTQSPVKPYLGARLSLNRASVDFNGSDSFSQTSTGLGVLAGVSYAVTPNVDLDAGYRYNYIGKVNTVKNVRSGELSAGVRVKF

SEQ ID NO: 4012 - DNA, 850 bp, Neisseria meningitidis
cacccatccgccgcgtgatgccgccaccaccatttaaaggcaacgcgcgggttaacggctttgccgtcggcaaagcagccggataccgctacgtatcttgaagtattaaaaatattacgatgcaaaaagaaaatttaagtataataaagcagaattctttaacggattcttaacaatttttctaactgaccataaaggaaccaaaatatgaaaaaagcacttgccacactgattgccctcgctctcccggccgccgcactggcggaaggcgcatccggcttttacgtccaagccgatgccgcacacgcaaaagcctcaagctctttaggttctgccaaaggcttcagcccgcgcatctccgcaggctaccgcatcaacgacctccgcttcgccgtcgattacacgcgctacaaaaactataaagccccatccaccgatttcaaactttacagcatcggcgcgtccgccatttacgacttcgacacccaatcgcccgtcaaaccgtatctcggcgcgcgcttgagcctcaaccgcgcctccgtcgacttgggcggcagcgacagcttcagccaaacctccaccggcctcggcgtattggcgggcgtaagctatgccgttaccccgaatgtcgatttggatgccggctaccgctacaactacatcggcaaagtcaacactgtcaaaaacgtccgttccggcgaactgtccgccggtgtgcgcgtcaaattctgatatgcgccttattctgcaaaccgccgagccttcggcggttttgttttctgccaccgcaactacacaagccggcggttttgtacgataatcccgaatgctgcggcttctgccgccctat

SEQ ID NO: 4013 - protein, 174 aa, Neisseria meningitidis
MKKALATLIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSTGLGVLAGVSYAVTPNVDLDAGYRYNYIGKVNTVKNVRSGELSAGVRVKF

SEQ ID NO: 4014 - DNA, 810 bp, Neisseria meningitidis
ccccgcctttgcggttttttccaaaccgtttgcaagtttcacccatccgccgcgtgatgccgccgtttaagggcaacgcgcgggttaacggatttgccgtcggcaaagcagccggatgccgccgcgtatcttgaggcattgaaaatattacgatgcaaaaagaaaatttcagtataatacggcaggattctttaacggattattaacaatttttctccctgaccataaaggaaccaaaatatgaaaaaagcacttgccgcactgattgccctcgcactcccggccgccgcactggcggaaggcgcatccggcttttacgtccaagccgatgccgcacacgccaaagcctcaagctctttaggttctgccaaaggcttcagcccgcgcatctccgcaggctaccgcatcaacgacctccgcttcgccgtcgattacacgcgctacaaaaactataaagccccatccaccgatttcaaactttacagcatcggcgcgtccgtcatttacgacttcgacacccaatcgcccgtcaaaccgtatttcggcgcgcgcttgagcctcaaccgcgcttccgcccacttgggcggcagcgacagcttcagcaaaacctccgccggcctcggcgtattggcgggcgtaagctatgccgttaccccgaatgtcgatttggatgccggctaccgctacaactacgtcggcaaagtcaacactgtcaaaaacgtccgttccggcgaactgtccgccggcgtgcgcgtcaaattctgatatacgcgttattccgcaaaccgccgagccttcggcggttttttg

SEQ ID NO: 4015 - protein, 174 aa, Neisseria meningitidis
MKKALAALIALALPAAALAEGASGFYVQADAAHAKASSSLGSAKGFSPRISAGYRINDLRFAVDYTRYKNYKAPSTDFKLYSIGASVIYDFDTQSPVKPYFGARLSLNRASAHLGGSDSFSKTSAGLGVLAGVSYAVTPNVDLDAGYRYNYVGKVNTVKNVRSGELSAGVRVKF

SEQ ID NO: 4016 - protein, 16 aa, Neisseria meningitidis
MKKALATLIALALPAA

SEQ ID NO: 4017 - protein, 15 aa, Neisseria meningitidis
LALPAAALAEGASGF

SEQ ID NO: 4018 - protein, 15 aa, Neisseria meningitidis
GASGFYVQADAAHAK

SEQ ID NO: 4019 - protein, 15 aa, Neisseria meningitidis
AAHAKASSSLGSAKG

SEQ ID NO: 4020 - protein, 15 aa, Neisseria meningitidis
GSAKGFSPRISAGYR

SEQ ID NO: 4021 - protein, 15 aa, Neisseria meningitidis
SAGYRINDLRFAVDY

SEQ ID NO: 4022 - protein, 16 aa, Neisseria meningitidis
FAVDYTRYKNYKAPST

SEQ ID NO: 4023 - protein, 15 aa, Neisseria meningitidis
YKAPSTDFKLYSIGA

SEQ ID NO: 4024 - protein, 15 aa, Neisseria meningitidis
YSIGASAIYDFDTQS

SEQ ID NO: 4025 - protein, 15 aa, Neisseria meningitidis
FDTQSPVKPYLGARL

SEQ ID NO: 4026 - protein, 15 aa, Neisseria meningitidis
LGARLSLNRASVDLG

SEQ ID NO: 4027 - protein, 15 aa, Neisseria meningitidis
SVDLGGSDSFSQTSI

SEQ ID NO: 4028 - protein, 15 aa, Neisseria meningitidis
SQTSIGLGVLTGVSY

SEQ ID NO: 4029 - protein, 15 aa, Neisseria meningitidis
TGVSYAVTPNVDLDA

SEQ ID NO: 4030 - protein, 15 aa, Neisseria meningitidis
VDLDAGYRYNYIGKV

SEQ ID NO: 4031 - protein, 15 aa, Neisseria meningitidis
YIGKVNTVKNVRSGE

SEQ ID NO: 4032 - protein, 14 aa, Neisseria meningitidis
VRSGELSVGVRVKF

SEQ ID NO: 4033 - protein, 25 aa, Neisseria meningitidis
FAVDYTRYKNYKAPSTDFKLYSIGA

SEQ ID NO: 4034 - DNA, 930 bp, Neisseria meningitidis; identical to SEQ ID NO: 4003

SEQ ID NO: 4035 - protein, 309 aa, Neisseria meningitidis; identical to SEQ ID NO: 4004

SEQ ID NO: 4036 - DNA, 1029 bp, Neisseria meningitidis; identical to SEQ ID NO: 4005

SEQ ID NO: 4037 - protein, 342 aa, Neisseria meningitidis
MDVTLYGTIKAGVEVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRFGNVTPRVSYAHGFKAKVNGVKDANYQYDQVIVGADYDFSKRTSALVSAGWLKQGKGAGKVEQTASMVGLRHKF

SEQ ID NO: 4038 - DNA, 1092 bp, Neisseria meningitidis
atggctagcatgactggtggacagcaaatgggtcgggattcaagcttggtaccgagctcggatccagacgttaccttgtacggtacaattaaagcaggcgtagaagtttctcgcgtaaaagatgctggtacatataaagctcaaggcggaaaatctaaaactgcaacccaaattgccgacttcggttctaaaatcggtttcaaaggtcaagaagacctcggcaacggcatgaaagccatttggcagttggaacaaaaagcctccatcgccggcactaacagcggctggggtaaccgccagtccttcatcggcttgaaaggcggcttcggtaccgtccgcgccggtaatctgaacaccgtattgaaagacagcggcgacaacgtcaatgcatgggaatctggttctaacaccgaagatgtactgggactgggtactatcggtcgtgtagaaagccgtgaaatctccgtacgctacgactctcccgtatttgcaggcttcagcggcagcgtacaatacgttccgcgcgataatgcgaatgatgtggataaatacaaacatacgaagtccagccgtgagtcttaccacgccggtctgaaatacgaaaatgccggtttcttcggtcaatacgcaggttcttttgccaaatatgctgatttgaacactgatgcagaacgtgttgcagtaaatactgcaaatgcccatcctgttaaggattaccaagtacaccgcgtagttgccggttacgatgccaatgacctgtacgtttctgttgccggtcagtatgaagctgctaaaaacaacgaggttggttctaccaagggtaaaaaacacgagcaaactcaagttgccgctactgccgcttaccgttttggcaacgtaacgcctcgcgtttcttacgcccacggcttcaaagctaaagtgaatggcgtgaaagacgcaaattaccaatacgaccaagttatcgttggtgccgactacgacttctccaaacgcacttccgctctggtttctgccggttggttgaaacaaggtaaaggcgcgggaaaagtcgaacaaactgccagcatggttggtctgcgtcacaaattctaa

SEQ ID NO: 4039 - protein, 363 aa, Neisseria meningitidis
MASMTGGQQMGRDSSLVPSSDPDVTLYGTIKAGVEVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRFGNVTPRVSYAHGFKAKVNGVKDANYQYDQVIVGADYDFSKRTSALVSAGWLKQGKGAGKVEQTASMVGLRHKF

SEQ ID NO: 4040 - DNA, 187 bp, Neisseria meningitidis
agatctcgatcccgcgaaattaatacgactcactatagggagaccacaacggtttccctctagaaataattttgtttaacttaaagaaggagatatacatatggctagcatgactggtggacagcaaatgggtcgggattcaagcttggtaccgagctcggatctgcaggttaccttgtacggtaca

SEQ ID NO: 4041 - protein, 29 aa, Neisseria meningitidis
MASMTGGQQMGRDSSLVPSSDLQVTLYGT

SEQ ID NO: 4042 - DNA, 54 bp, Neisseria meningitidis
gttggtctgcgtcacaaattctaactcgagcagatccggctgctaacaaagccc

SEQ ID NO: 4043 - protein, 7 aa, Neisseria meningitidis
VGLRHKF

SEQ ID NO: 4044 - DNA, 47 bp, Neisseria meningitidis
ggggtagatctgcaggttaccttgtacggtacaattaaagcaggcgt

SEQ ID NO: 4045 - DNA, 42 bp, Neisseria meningitidis
gggggggtgaccctcgagttagaatttgtgacgcagaccaac

SEQ ID NO: 4046 - DNA, 20 bp, Neisseria meningitidis
tcaagcttggtaccgagctc

SEQ ID NO: 4047 - DNA, 20 bp, Neisseria meningitidis
tttgttagcagccggatctg

SEQ ID NO: 4048 - DNA, 21 bp, Neisseria meningitidis
ctcaagacccgtttagaggcc

SEQ ID NO: 4049 - DNA, 33 bp, Neisseria meningitidis
agcggcttggaattcccggctggcttaaatttc

SEQ ID NO: 4050 - DNA, 30 bp, Neisseria meningitidis
caaacgaatgaattcaaataaaaaagcctg

SEQ ID NO: 4051 - DNA, 47 bp, Neisseria meningitidis
cctgttgcagcacatatggacgttaccttgtacggtacaattaaagc

SEQ ID NO: 4052 - DNA, 33 bp, Neisseria meningitidis
cgacaggctttttctcgagaccaatcttttcag

SEQ ID NO: 4053 - DNA, 47 bp, Neisseria meningitidis
cctgttgcagcggatccagacgttaccttgtacggtacaattaaagc

SEQ ID NO: 4054 - DNA, 33 bp, Neisseria meningitidis; identical to SEQ ID NO: 4052

SEQ ID NO: 4055 - DNA, 36 bp, Neisseria meningitidis
gttgcagcacatatggacgttaccctgtacggcacc

SEQ ID NO: 4056 - DNA, 44 bp, Neisseria meningitidis
ggggggatggatccagattagaatttgtggcgcagaccgacacc

SEQ ID NO: 4057 - DNA, 492 bp, Neisseria meningitidis
atgaattccctctttgtggacaatactgttttcattacacggctgaaagccgggcatatcggcaggttggttcaggcgttgtttgaggagtggcacggatttgaaccgtggtcttctgtggataagattcatgcctattacggcaggtgtttgaaggatgacgaactgccgctggcatttgcggctgtggatgattccggaatcctgttgggttcggctgcggtcaagcggcatgatatggaaagttttccacggtatgaatattggttgggggatgtctttgttttacctgaatatcgcggaaaaggcattggcaggaggctggtcgcccactgcataggcgcagcgcgttcgctggggataaagttcttgtatctttatacgcctgatgtgcaaatattttatgaatcattcggctgggtggttgtcgggcgacatttccataacggtgaatgggttacggttatgcgtttggatgtggataaggtttaa

SEQ ID NO: 4058 - DNA, 396 bp, Neisseria meningitidis
atgccgtctgatgtcggaatacggcttcagacagcatttaaatggaagttaaaaatgaaaaaaatattttattttctgatggttgttttttctacaagcgtatgggcaggggatgctgaagacaatctgctcagcatccaatccggttaccgcgccttattgcaaaagcaaaacaatctggacggaaaaatcatcgggatgcagtcggatttggaagatgcgcgccggcgtttgcagacggctcaggcagacatcgcccgtttggaagcggaaattcctgcagcaatggcgcaaaaagcccggcaggctgaagatttgaggcaaatcggagtgcgtttggaccatgcttggaatgcggtttacggcgcagggggaacgaaggcgtcggggaattga

SEQ ID NO: 4059 - DNA, 1395 bp, Neisseria meningitidis
atgaccgtcaaaacccgtttcgcccccagccccaccggctacctgcacatcggcggcgtgcgcaccgccttgttttcatgggcgtttgcccgccatcataaaggcgagttcctattacgtattgaagacaccgacttggcgcgttctaccgccgaatccgtcaacatcatcctcgacggcatgaaatgggtcggtctcaattacgacaacgccgacaacgtcgtttaccaaactcgccgtttcgaccgctacaaagaggtcattgccgaacttttagaaaaaggccatgcctactactgctattgcagcaaagaagagctggaagccatgcgtgagaaagccgaaaaagaaggctcggcgacttacgaccgccgctggcgtccggaagtaggtaaaaccctgcccgaaatcccgtccgacgtacaacccgttgtccgtttcaaaacgcctttggacggtgtgaccaaatggacagacttggtcaaaggcgaaatctccatccccaacgaagcactcgatgacctgattatcgcccgcgccgacggtacgccgacctacaacttctgcgttgtcgtagacgactacgacatgggcgttacccacgttatccgcggcgacgaccatgtgaacaacacgccgaaacaaatcaacatcttaaaagccatcgacgcgaacctgcccgaatacggccacctgccgatgattcttaacgaacaaggcaaaaaaatctccaaacgcagcggcgataccgttgccattaccgatttcggcgcaatgggcatcctgcccgaagcgatgctcaactatctggcacgcttgggctgggcgcacggcgacgatgaattcttcacaatggaacaattcatcgaatggtttgatttgaaagacgtttccccgtctccaagccgtatggacttgaaaaaactctactggatcaacggcgaacacatcaaaatcacacccaacggcaaactcgccgaactcgtcaaaccccgccttgcgttgcgcgatattcatgaaaccgaaaaacctgctttggaagatgtgttggaactggtcaaagaccgcccccaagacttgaacacgcttgccgacgagtgcttctacttctacgtcaaacaaacgcctgccgaagcagacgtgcagaaacactgggacgatgaagccgccgcccgtatgctgcgctttgccgaacgcctcgaagggctggaagactggaatgccgaagccatccacgacctcttcaaacccttctgcgacgaagaaggcattaaaatgggcaaactcggcatgcccctgcgccttgccgtctgcggtacggcgaaaacccccagcgtcgatgctgtgttggcattaatcggcaaagaagaagtgttgaaacgcatccgcgcttaa

SEQ ID NO: 4060 - DNA, 645 bp, Neisseria meningitidis
gtgaacaaacggctgttttgcagccgcaacggcttgcgctattacctgttgggcggtttctgtttgagtgtttttccgcttttgctggtgtttgcctcatccgtttgggcggtttatcggacgggtgggcaggttttgccgccgtatgtccgggcggatgccgcgctggtgttgggcgccgccgcgtgggacaaacgcccttctcctgttttccgcgaacgcatcaaccatgccatcgcactttatcagagccgcagggtaggcaaaatcgtgtttacgggaggccggaccaaaaaaggctatatgaccgaagccgaggtcgggcggcggtacgcactcaaacagggggttccggcgcgcaacatcctgtttgaaaacacttcgcgcaacacttatgaaaacctgaacaacatccgtccggttttgcgtgccaacggtattgccagcgtggtgattgtcagcgatccctaccatttggcgcgggcggcggaaatggcggaggatttgggtgtccgcgtttatatgtctgccacgccgaccacgcggtttgatgcgggaaataagaaaaaaatctttatgctgcaagagggatatgcgttatccctctaccgtttggaaaaatgggggcgggattttttcaattag

SEQ ID NO: 4061 - DNA, 354 bp, Neisseria meningitidis
atgcctgaaatcaaaattttccacaatccgcgttgcagcaaatcgcgtgccgccttgtccctattggaagaacgcggcattgctgccgaagtggtcaaatatttggatacgccgcccgacttgtccgaattgaaggatattttcaacaaattgggcttggcatcggcgcgcgggatgatgcgcgtgaaagatgatttgtataaggaattgggtttggacaaccccaatttggacaatgacgcgctgctgcgtgccatcgccgatcatcccgccctgttggagcgtccgattgttttggcaaacggtaaggcggctgtcggcagaccgctggaaaatatcgaagcggtattgtga

SEQ ID NO: 4062 - DNA, 483 bp, Neisseria meningitidis
atgaaatacttgaatcttgccgcaatcacccttgccgccacatttgccgcacataccgcctcggcagacgaactggccggatggaaagacaacaccccgcaaagcctgcaatcgctcaaagcccccgtacgcatcgtcaacctttgggcgacttggtgcggcccgtgccgaaaagagatgcctgccatgtccaaatggtacaaagcgcagaaaaaaggcagcgtcgatatggtcggcatcgcgctcgacacatccgacaatatcggcaacttcctcaaacaaactcctgtttcctacccgatttggcgttacaccggggcgaacagccgaaactttatgaaaacctacggaaacactgtcggcgtactgccctttaccgtcgtcgaagcaccgaaatgcggatacaggcagaccattaccggggaggtaaacgaaaaaagcctgaccgacgccgtcaaactcgcccattcaaaatgccgttaa

SEQ ID NO: 4063 - DNA, 651 bp, Neisseria meningitidis
atgatccgtttcgaacaagtttccaaaacctatcccggcggttttgaagccctgaaaaacgtcagcttccaaatcaacaaaggcgaaatgatatttatcgcgggacactccggttcgggcaaatccaccatcctcaaactgatttcgggcattaccaagccgagcaggggcaaaatcctgtttaacgggcaggacctcggcacattgtccgacaaccaaatcggctttatgcgccaacacatcggcatcgtgttccaagaccacaaaatcctctacgaccgcaacgtcctgcaaaacgtcatcctgccgcttcggattatcggctatccgccgcgcaaagccgaagagcgtgcccgcatcgccatcgaaaaagtcggcctgaaaggacgagaattggacgatcccgtaaccctctccggcggtgaacaacaacgcctgtgcatcgcccgcgccgtcgttcaccagcccggcctgctgattgccgacgaaccctccgccaacctcgaccgcgcctacgcgctcgatattatggaattgttcaaaaccttccacgaagcgggaactaccgtcatcgttgccgcacatgacgaaaccctgatggcggactacggacaccgcatcctgcgcctctcgaaaggacgactcgcatga

SEQ ID NO: 4064 - DNA, 918 bp, Neisseria meningitidis
atgagcatcatccactacctctcgctgcacgtcgaatccgcgcgcaccgcgctcaagcagctcctgcgccaacccttcggcacactgcttaccctcatgatgctcgccgtcgcgatgaccctgccgctgtttatgcatctgggcatccaaagcgggcaaagcgtgttgggcaaactcaacgagtcgccgcaaatcacaatctatatggaaacctccgccgcacaaagcgacagcgataccgtccgcagcctgctggcgcgcgacaaacggctcgacaacatccgcttcatcggcaaagaagacggtctggaagaattacagtccaatcttgaccaaaatctgatttccatgcttgacggcaaccccctgccggatgtctttatcgttacccccgacccggcaaccacgcccgcccaaatgcaggcaatctaccgagacattaccaaactgcctatggtcgaatccgcgtctatggataccgaatgggtgcaaacgctgtaccaaatcaacgagttcatccgcaaaattttgtggtttctttccctgacgctggggatggcgttcgtccttgtcgcacacaacaccatccgcctgcaaatcctcagccgcaaagaagaaatcgaaatcaccaaactcttgggcgcgcccgcgtcgtttatccgccgcccattcctttatcaagccatgtggcagagcatcctttccgccgccgtcagcttggggctttgcggttggctgctctctgccgtgcgcccattggtcgatgccattttcaaaccctacggacttaatatcggctggcggttcttctacgctggcgaactcgggctggtgttcggcttcgtcatcgcgttgggcgtattcggcgcgtggcttgccaccacccagcacctgctcggcttcaaagccaaaaaataa

SEQ ID NO: 4065 - DNA, 249 bp, Neisseria meningitidis
atgctgacctcggaacaagtaaaagccatgattgaaggcgtggcaaaatgcgaacatatcgaagtagaaggcgacggacaccattttttcgccgtcatcgtttcatcagaatttgaaggcaaggcacgcctcgcgcgccaccgcctgattaaagacggactcaaagcccaactggaaagtaacgaactgcacgcactttccatttcggttgccgccactccggcggaatgggcagccaaagcacaataa

SEQ ID NO: 4066 - DNA, 1212 bp, Neisseria meningitidis
atggcatttttaaaactgaccgaacaaaacgtgcagggcaaaaccgtcctcatccgcgccgatatgaacgtaccgttcaaagacggcaaaatcagcgacgacacccgtatccgcgcctcgctcgcgtccattaaatactgcgtggacaacggtgcgtccgttatcgtgatgacccatctcggccgcccgaccgaaggcgagttccaccccgaagacgatgtcgcccccgttgccgcgcacttgggcagcctgttgggcaaagacgtgaaagtattgaacgactggcgtgaaaacaaacccgccctgaacgcgggcgatgtcgtcatgctgcaaaacgtgcgcatcaacaaaggcgagaagaaaaacgatttggaactgggtaaagcctacgcttctttgtgcgacgtgttcgtcaatgacgcgttcggaaccgcccaccgcgcccaagcctcgaccgaagccgtcgcccaagccgcgcccgttgcctgcgccggcgtattgatggcgggcgaactcgacgctttgggcaaagccttgaaacagcccgcgcgcccgatggttgccatcgttgccggcagcaaagtgtccaccaagctgaccatcctcgaatcgctggcggacaaagtcgaccaactcatcgtcggcggcggtatcgcaaacaccttcctgttggcggaaggcaaagccatcggcaaatctttggcggaacacgatttggtggaagaatccaaaaaaattatggcgaaaatggcggcaaaaggcggttctgtgccgctgccgaccgatgtcgtcgttgccaaagcctttgccgccgatgcggaagctgtggtgaaagacattgccgccgatgcggaagctgtggtgaaagacattgccgacgttgccgaagacgagatgattttggacatcggtccgaaatccgctgccgcgcttgccgatttgcttaaagccgccggtacggtcgtttggaacgggccggtcggcgtgttcgagtttgaccaattcgcaggcggtacgaaagcccttgccgaagccattgcccaaagcaaagcgttctcgattgcgggcggcggcgacacgctggcggcgattgccaaattcggcgttaccgaacaaatcggctacatctccaccggcggcggcgcgttccttgagttcttggaaggcaaagagctgcctgccgtagccgctttggaaaaacgcggcgcgtaa

SEQ ID NO: 4067 - DNA, 1254 bp, Neisseria meningitidis
gtggacaaactgaaaatctccgcaaacggcccgctcaacggggaaataacggtctcgggcgcgaaaaacgcggcattgccgctgatgtgcgcgggtttgctgacatcgggtacgttgcgcctgaaaaacgtccctatgctggcagatgtgaaaaccacgcaaaagctgcttcaggggatgggcgcgcgcgtcctgaccgacaatatcagcgaatttgaaatcaacggcggtacggtaaacaatacctgcgccccttacgagttggtccgaacgatgcgcgcttcgattttggtgctgggcccgacgctggcgcgtttcggcgaggcgcaagtcagcctgccgggcggctgcgccatcggttcgcgccccgtcgatcagcatttgaaaggcttggaagcgatgggtgctgagattgttatcgaacacggttacgtcaaagccaaaggcaaactcaaaggtacgcgcgtggcgatggatgtcgttaccgtcggcggcacggaaaacctgctgatggcggcgacgctggcggaaggtacgacggttttggaaaactgcgccattgagcctgaagtggtcgatttggcggaatgcctggtcaaaatgggcgcgaaaatcagcggcatcggtacgtccacaatgattgtggaaggggtggacgagctgcaaggctgcgaacacagcgtcgtccccgaccggatcgaggcggggacgttcctgtgcgcggtggcgataaccggtggcagggtggttttgcggaatgccgcgccgaaaacgatggaagtggtgttggacaaactggttgaggcaggtgcggtgattgaggcgggcgacgattggatcgccatcgatatgcggcagcgtccgaaggcggtggacatccgcacggtcgtccaccccggcttccccacggatatgcaggcgcagtttatggcattgaatgccgtggcggagggaagctgccgcgtggtggaaacgatttttgaaaaccgctttatgcacgtccccgagttgaaccggatgggggcgaacatcacaaccgagggcaatacggcatttgtgcagggtgtggaacagctttccggcgcagtcgtcaaggcgacggatttgcgtgcgtccgccagcctcgttatcgccggtttggcggcgcgaggcgaaaccgtggtcgaacagatttaccacttggatcgcggttatgaaaatattgaaaaaaaactcggcagcgtcggcgcgaaaatcgagcgcgtatccggctga

SEQ ID NO: 4068 - DNA, 972 bp, Neisseria meningitidis
atgacagaatatcccggcatcgggtcgccgttgttttacggcgttttttttgcggcagtgctggtcatgattgccttggatatgttttcgctgaagaaaaacggcagccataaagtcggcgtcaaagaagccttggcatggagcggcttgtgggttgccgtatcctgcctgttcgcgggctggctgtattttgaactcgccggcaatcccggctacggcgcggcagtcgcaaaagaaaaagtattggaattctttaccggctacattttggaaaaatcgttggcagtcgacaatattttcgtgttcctgatgatattcggctacttcaaagtcgcaccacagtttcagcaccgcgtgctgctgtacggcgtattgggcgcattggtattgcgcaccgtcatgattttcgtcggcgcggcactggttcagcagtttgagtggattctgtatctgtttggcgcgttcctgctctatactggtatacacatgatgaagcccgaaggcgatgagaaagaggatttggcaaacagcaggctgctgaataccgtcaagaaagtcgttccggtcggcacggaatttcacggcgagaaattttttaccgtcgaaaacggcaaaaaaatcgccacgccgctgtttttggtgctggtcatgattgaattgagcgatgtcgtgtttgccgtggacagcatccccgccgtctttgccgttaccaccgatccgtttatcgtgctgacttccaatattttcgcaattctgggcttgcgggcgatgtatttcctgctggcggatgtggcggaacgctttatcttcctgaaatatggattggcattcgtgttgggttttatcggtgtgaaaatgctggtaatgcattgggtgcatatcccgatttccgtttcgctgtcggtcgtgttcggcgcattgggtgcatcggtgttgacttctttggtttatacgaaaaaaacaggccgataa

SEQ ID NO: 4069 - DNA, 450 bp, Neisseria meningitidis
atgagtatttatgccgtcgcgcacatcgttcatctgtattgcgctattgcctttgtcggcggcgtgttttttgaagtgctggttttgtccgtcctgcatacgggacgggtgtcgcgcgaggcgcggcgcgaagtggaaaaggcaatgtcttaccgcgccgtcagggtgatgccgtttgtggtcggactgctgttcgccagcggcatcgtgatggcggcaaaccgctatctttctatattgggcgaaccgtttgccacttccttcggtacgatgctgacgctgaaaatcctgttggcgttcagcgtattggcgcacttcgccatcgccgtcgtcaaaatggcgcgttccacactgacggtcggttggtcgaaatacatacacgccgtcgtctttacccatatgctgctgattgtctttttggcaaaagcgatgttttatatcagctggtaa

SEQ ID NO: 4070 - DNA, 1272 bp, Neisseria meningitidis
atgttccaatggctttatgatgtattgtggctgcttgcgccgatatggatacggcgttatttggacaaacgctccggaagtgccccggcatatcgggcgcatcgggacgagcgtttcggcaagccgtatccgaatcccgttaccggcgcggtttggatacacgccgtttcggtcggagaaacgcgtgccgcccagtccttgatacgcgagttgcggcggcgttttcccgatgcgccgctgctgatgacgcagatgaccccgacggggcgggaaaccgcgcaagttctgtttcccgatgcgcaatgccgctatcttccgtatgacaaaaaaacgtgggtacggcagtttttgcgcgaacaccgcccgatgttcggcattttgatggaaaccgaaatctggcccaacctgatgagggaatgccggcgcgcgggtgtgccgctgtttttggcgaatgcgcggctgtcggaaaaatcgttgaacggttatctgaaagtccgccgcctgatccgtcctgccgccgcttcgctgacggggtgtctggcgcagacagaggcggatgcggcgcggttggcgaaattgggcgcggcatccgtgcaggtgtgcggcaataccaaatacgacatcataccgtcggaacagatgaaaacgctggcggggcagtttgaaaaacgcatcggaggccggccggttgccgtgtgcggcagcacgcgcgtttatcggggtgaagacgaggcggaaaaactgctggcggcgtggcaacaatatcgcggcgatgcgctgctggtcgtcgtgccgcgccatcccgagcattttcagacggtatttgaaacggcaaaacgcttcgggtttaaggttcagcggcgcagcgacggtttgccggtcgaacctgatacgcaggtgtggataggcgacagtatgggcgagctgtatgcgtattacctgtgcgccgatgtcgcttttgtcggcggcagtctggtcgattcgggttgtcagaacatcatcgaaccgctttcctgcggcgttccgacgatattcggcttttcaacctacaatttttccgaagcctgccgacacgccttggcatcgggtgcggcggttcaagtcgaatcggcggatgcgtggcgggaagccgttgaaaaaaccttatcgtccgaggggggggggatgcagatgcaggcgcgcgtggacggctttatcgcacaacatcgcggagcgggcgcgagaatcgccgaggcggtgcgggaagcggtatgcggatatcgggggcgatag

SEQ ID NO: 4071 - DNA, 1449 bp, Neisseria meningitidis
atgaacggcgatattggtgtaatcggtttggcggttatggggcaaaacctgattttgaatatgaacgattgcggatttaaggtggttgcctacaaccgcacgactgccaaggtggacgaatttttaaacggcgcggcaaaaggaactaatattatcggcgcgtattctttgcaagatttggtcgataagctggaaaaaccgcgaaaaattatgatgatggttcgtgccggttcggtggttgacgaatttatcgaacaactgcttccgctgttggaagaaggcgacatccttatcgacggcggcaatgccaattaccccgacacgacacggcggacacattaccttgctgaaaaagggattttgtttgtcggcgcgggcgtgtccggcggggaagaaggggcgcggcgcgggccgtccattatgccgggcggggataagcgcgcttgggatgcggtcaagccgatttttcaggcgattgccgccaaaacgtcgcagggcgaaccgtgttgcgactgggtcggcaaagacggtgcggggcattttgtcaaaatggtgcataacggcatcgaatatggcgatatgcagttgatttgcgaagcgtaccagttcatgaaagacggcttggggctgtcttacgacgaaatgtaccgcgtgtttgccgagtggaacaaaaccgagctggattcttatctgattgaaatcacagcggcaattttgggctataaggacgaaggcggcgaaccgctggtcgagaaaatcctcgatacggcagggcaaaaaggtacaggcaaatggacgggcatcaatgctttggatttgggtattccgctgacgctgatttccgaagccgtattcgcccgctgcgtttcgtcgttcaaagaacagcgcgtgcagaccggcaaactgttcgcccgaaccgttacgcccgtcgaaggcggcaaacaagaatgggtcgaggcgttgagacaggccctgcttgcatctaaaatcatttcctacgcacaaggctttatgctgatccgcgaagcgggcgaaagctacggctgggatttggactacggcaacactgcgctgctgtggcgcgaggggtgcatcattcgcagcgcattcttaagcaatatccgcgacgcgtatgaaaacaatcccgatttggtgttcttgggtgcggatccgtatttcaaaaatattttggaaaactgcctgccggcgtggcgcaaggtggttgccaaggcggtcgaatgcggcatccctatgccctgcatggcttcggcgattacgttcttggacggctacacgaccgaacgtctgcctgccaacctcttgcaggcacagcgcgactacttcggcgcgcacacttacgagcgcaccgacaaaccgcgcggtgagtttttccataccaactggacgggcaagggcggagataccgcttcgacaacctacgatatttga

SEQ ID NO: 4072 - DNA, 237 bp, Neisseria meningitidis
atgaagaatagtttttgtggacagtttgcttgttgtgcaaatggcatcctacttttctttaccgaatggctgccgatgtctttaagaaccggaatactgtggaggtttgagaggaaagtgtgtttggaacttgtggaaatggtcaggtgtcggcacgaatgtcttatttctgcatatcggcagagtgcgcatccgaatttgtgtataagtggtggaaaaaatgagatttgcgggtaa

SEQ ID NO: 4073 - DNA, 924 bp, Neisseria meningitidis
atgctgcaaagaactttggcgaaatccatcagcgttaccggcgtcgggctgcattcgggcgaacgcgtcgcgctgaccctgcaccccgcgcctgaaaacagcgggatttccttccgccgtaccgatttggacggcgagatgggcgaacaaatcaagctgaccccttatttgatcaacgatacccgcctttcctccaccatcgttaccgacaaaggcgtgcgcgtcggcacgatcgaacacattatgtccgcgctgtccgcctacggcatcgacaatgcgctgattgagctgaacgcgcccgaaatcccgattatggacggctccagcctgccgtttatttaccttttgcaagatgcgggcgtggtcgatcaaaaggcgcaaaagcgttttttgaaaatcctcaagcctgtcgaaatcaaagaagcgggcaaatgggtgcgctttacgccgtatgacggctttaaggtaacgctgaccatcgaattcgaccatccggttttcaaccgcagctcgcccacttttgaaatcgatttcgccggcaaatcctacatcgacgaaatcgcgcgcgcgcgcactttcggctttatgcacgaagtggaaatgatgcgcgcccacaatctgggtttgggcggcaatttgaacaacgccatcgtgattgacgacacggatgtcctgaatcctgaaggcttgcgctatcccgatgagtttgtgcgccacaaaatccttgatgccatcggtgatttgtatatcgtcggacatccgattgtcggcgcatttgaaggctacaaatcgggacacgccatcaacaacgcactcttgcgcgcggttttggcagacgaaacggcttacgaccgggtggaatttgccgacagcgatgatttgcccgacgcatttcacgagctgaacatcagaacttgtggataa

SEQ ID NO: 4074 - DNA, 513 bp, Neisseria meningitidis
atgaacacccttcaaaaaggttttacccttatcgagctgatgattgtgattgccatcgtcggcattttggcggcagtcgcccttcctgcttatcaagactacacagcccgcgcacaagtttccgaagccattcttttggccgaaggtcaaaaatcagccgttaccgagtattacctgaatcacggcgaatggcccggcaacaacacttctgccggcgtggcaacctcctctgaaatcaaaggcaaatatgttaaaagcgttgaagtcaaaaacggcgtcgttaccgcccaaatggcttcaagcaacgtaaacaacgaaatcaaaggcaaaaaactctccctgtgggccaagcgtcaaaacggttcggtaaaatggttctgcggacagccggttacgcgcgacaaagccaaagccgccaacgacgacgttaccgccgccgccgccgccaacggtaagaagattgacaccaagcacctgccgtcaacctgccgcgacgcaagtgatgccagctaa

SEQ ID NO: 4075 - DNA, 423 bp, Neisseria meningitidis
gaagccattcttttggctgaaggtcaaaaatcagccgtcacagagtattacctgaatcacggcgaatggcccggcaacaacagttctgccggcgtggcaacctccgccgacatcaaaggcaaatatgttaaaagcgttgaagtcaaaaacggcgtcgttaccgcccaaatggcttcaagcaacgtaaacaacgaaatcaaaggcaaaaaactctccctgtgggccaagcgtcaagccggttcggtaaaatggttctgcggactgccggttacgcgcgccgacaacgccaaagacgacgccgttaccgccgccgccaccggcaccgacaaaatcgacaccaagcacctgccgtcaacctgccgcgatgattcatctgtcgtttgcatagaaacaccacctacggctttctataaaaatacctaa

SEQ ID NO: 4076 - DNA, 387 bp, Neisseria meningitidis
gaagccattcttttggctgaaggtcaaaaatcagccgtcaccgagtattacctgaatcacggcgaatggcccggcaacaacagttctgccggcgtggcaacctccgccaacatcaaaggcaaatatgttgagaaagttgaagtcaaaaacggcgtcgttaccgccacaatgctttcaagcggcgtaaacaaagaaatccaaggcaaaaaactctccctgtgggccaagcgtcaagacggttcggtaaaatggttctacggacagccggttaagcgcgacaacgccagcgccgacgccgtcaaagccgacaccgccgccaacggcaagcagatcgacaccaagcacctgccgtcaacagcatcgacaagaaaatcgacaccaaactag

SEQ ID NO: 4077 - DNA, 387 bp, Neisseria meningitidis
gaagctatccttttggtcgaaggtcaaaaatcagccgttaccgagtattacctgaatcacggcgaatggcccggcgacaacagttctgccggcgtggcaacctcctctgaaatcaaaggcaaatatgttaaaagcgttgaagtcaaaaacggcgtcgttaccgcccaaatggcttcaagcaacgtaaacaacgaaatcaaaggcaaaaaactctccctgtgggccaagcgtcaaaacggttcggtaaaatggttctgcggacagccggttacgcgcgacaaagccaaagacgacgccgtcaccgccgccaccggcaagggcaccgccaacatcaacaccaagcacctgccgtcaacagcaccgacaagaaaatcgacaccaaactag

SEQ ID NO: 4078 - DNA, 264 bp, Neisseria meningitidis
ggatttaatgatgccgccggcgtggcatcttcttcaacaatcaaaggcaaatatgttaaggaagttgaagtcaaaaacggcgtcgttaccgccacaatgctttcaaccggcgtaaacaacgaaatcaaaggcaaaaaactctccctgtgggccaagcgtcaagccggttcggtaaaatggttctgcggacagccggttacgcgcgccgacaacgccaaagacgacgttgccgccgccaccggcaccgacaaaatcgacaccaaa

SEQ ID NO: 4079 - DNA, 420 bp, Neisseria meningitidis
gaagctatccttttggccgaaggtcaaaaatcagccgtcacagagtattacctgaatcacggcgaatggcccggcaacaacacttctgccggcgtggcatcttcttcaacaatcaaaggcaaatatgttaaggaagttacagtcgcaaacggcgtcattaccgccacaatgctttcaagcggcgtaaacaaagaaatccaaggcaaaaaactctccctgtgggccaagcgtcaagacggttcggtaaaatggttctgcggacagccggttacgcgcaccgacgccaaagccgacaccgtcgccgccgccgccaagaccgccgacaacatcaacaccaagcacctgccgtcaacctgccgcgacgcttcatctgtcgtttgcatagaaacaccacctacggctttctataaaaatacctaa

SEQ ID NO: 4080 - DNA, 414 bp, Neisseria meningitidis
ggatttaatgatgccgccggcgtggcatcctcctccgacatcaaaggcaaatatgttgagaaagttgaagtcaaaaacggcgtcgttaccgccacaatgctttcaagcggcgtaaacaaagaaatcaaaggcaaaaaactctccctgtgggccaagcgtcaaaacggttcggtcaaatggttctgcggacagccggttacgcgcaacgacaccgccaccgccaccgccaccgacgtcgccgccgccaacggcaagaccgacgacaaaatcaacaccaagcacctgccgtcaacctgccgcgatgattcatctaccggttgcatagaaacaccacgcgccgatttcaaacactttcaaaaaatcagccgttaccgagtattgcccgaatcacggcaaatggcagaaaaacttcgt

SEQ ID NO: 4081 - DNA, 672 bp, Neisseria meningitidis
ggatttaatgatgccgccggcgtggcatcctcctctaaaatcaaaggaaaatatgttaaggaagttacagtcgcaaacggcgtcgttaccgccacaatgctttcaagcggcgtaaacaaagaaatccaaggcaaaaaactctccctgtgggccaagcgtcaaaacggttcggtaaaatggttctgcggacagccggttacgcgcgccggcaccgacgacaccgtcgccgccgacaacaccggcaacaagaaaaccaacaccaagcacctgccgtcaacctgccgcgacgcagcatctgccgtttgcacaaaaacacccgagtattacccgaatcacggcgaatggccgaaaaacaacacttctgccggcgtggcatcttcttcaacaatcaaaggcaaatatgttaaggaagttacagtcgcaaacggcgtcattaccgccacaatgctttcaagcggcgtaaacaaagaaatccaaggcaaaaaactctccctgtgggccaagcgtcaagacggttcggtaaaatggttctgcggacagccggttacgcgcaacgccgccaacgccaaagccggcaccgacgaagtcaccgccgccacacccgacaccgacaaaatcaacaccaagcacctgccgtcaacagcaccgacaagaaaatcgacaccaaactag

SEQ ID NO: 4082 - DNA, 275 bp, Neisseria meningitidis
atggcttcaagcggcgtaaacaaagaaatcaaaggcagaaaactctccctgtgggccaagcgtcaagccggttcggtaaaatggttctgcggacagccggttgagcgcgacaacgccaaagccgccaacgacgacgttaccgccgccgccgccgccaacggtaagaagattgacaccaagcacctgccgtcaacctgccgcgacgcagcatctgccgtttgcacaaaacacccgagtattgcccgaatcacggcgaatggccgaaaaacttcgtc

SEQ ID NO: 4083 - DNA, 330 bp, Neisseria meningitidis
atgggcggcctgattattgaagacttgcaagaaggcttcggaaaagaagcagttaaaggcaaagagattaccgtgcattacacaggttggctggaaaacggaaccaaattcgactccagcctcgaccgccgccagccgctgaccatcacgctcggtgtcggacaagtcatcaaaggctgggacgaaggcttcggcggcatgaaggaaggcggcaaacgcaagctgaccatcccttcggaaatgggctacggcgcacacggcgcgggcggcgtgattcccccgcacgccactttgatatttgaagtcgagctgctgaaagtgtacgaataa

SEQ ID NO: 4084 - DNA, 219 bp, Neisseria meningitidis
atgcttaaaaccctgacttttgccgcactgcatttcagcgtcgccttcagtgtaacctatgtactgacgggcagtataggcgtatcgggagcagttgcgctggtcgaacccctaatcaacaccgtcgttttctatttccatgaaaaagcatggaacctttacgaaaaaaataaaacagtcaaacaaacacagccgtttcagctgcaccgatgcagctga

SEQ ID NO: 4085 - DNA, 954 bp, Neisseria meningitidis
atgaatcataaaaagatcgttgttttggatgcggatactttgcccggccgggtttttcattttgattttccgcacgagcttgcggtttacggtacgacaggtgcggatgaaacggcagaacgggtgcgcgatgcacatattgtcattactaacaaagtgatgatttctgccgatattattgcggctaatccgcagttggagctgattgccgtcagtgcgaccggcgtgaacaatgtcgatattggggcggcgaaggcggccggtgttgcggtatgcaatgtccgcgcatacggaaacgaatcggttgcggaacacgcctttatgctgatgattgcgttaatgcggaatttgcctgcctatcagcgtgatgttgcggcaggattgtgggaaaagtcgccgtttttctgccattacggcgcgccgattcgggatttgaacggcaaaacgctggcggttttcggacgcggcaatatcggacggacgcttgccggatacgcgcaggcattcggtatgggggtggtgtttgccgaacacaaacacgcgtccgctgtgcgtgaaggctatgtttcctttgaagatgcggtacgggctgctgatgtgttgtcgctgcactgtccgctaaacgcccaaactgaaaatatgataggcgaaaacgaattgcggcagatgaagcctggcgcggttttaatcaattgtgggcgcggcgggctggtggatgaaaacgcgctgcttgccgcactcaaatacgggcagatcggtggggcaggtgtcgatgttttgacgaatgagccgcccaaaaacggcaatcccttgctgaatgcacgattacccaatctgattgttacgccgcataccgcgtgggcaagtcgtgaggctttggacaggctgtttgatatattgttggcgaacattcacgcctttgtgaaaggagaggcgcaaaaccgcgtggtttga

SEQ ID NO: 4086 - DNA, 2058 bp, Neisseria meningitidis
atgacacgcaaaatcttagttacctccgccctgccctatgccaacggcagcatccacctcggccacatggtcgaacacatccaaaccgacgtttgggtgcgctttcaaaaactgcgcggccacgcgtgccactactgctgcgccgacgacacccacggcacgcccgtaatgcttgccgcgcaaaaacaaggtatcgcgcccgaagacatgattgccaaagtgcgcgaagagcacctcgccgactttactggctttttcatcggttacgacaattattacagcacccattcccctgaaaacaaacagttttcccaagacatttaccgcgcgctgaaagccaacggcaagattgagagccgcgtcatcgagcagcttttcgaccccgaaaaacaaatgttcctgcccgaccgcttcgtcaaaggcgaatgcccgaaatgccacgcccaagaccaatacggcgacaactgcgaagtctgcggcacgacctattccccgaccgaactgattaacccgtattccgccgtttccggtacgaaacccgaattgcgcgaatccgaacacttcttcttcaaactgggcgaatgcgccgacttcctcaaagcatggacttccggcaacaacccgcacgacggcaagccccatctgcaagccgaagccctcaacaaaatgaaagaatggctgggcgaaggtgaagaaaccaccctgtccgactgggatatttcccgcgacgcgccgtatttcggttttgaaatccccgacgcgccgggcaaatacttctacgtctggctggacgcgcccgtcggctacatggcgtcgtttaaaaacctgtgcgaccgcatcggcgtcgattttgacgaatacttcaaagccgacagccaaaccgagatgtaccacttcatcggcaaagatattctctatttccacgccctgttctggcccgctatgctgcatttctccggccaccgcgccccgaccggcgtgtacgcacacggctttttgaccgtcgacggacaaaaaatgtccaaatcgcgcggcacgtttattaccgccaaatcctatctggaacaaggcctgaaccccgagtggatgcgctactacatcgccgccaaactcaacagcaaaatcgaagacatcgatttgaacctgcaagactttatcagccgcgtaaacagcgacctcgtcggcaaatacgtcaacatcgccgcccgcgcctcaggtttcatcgccaaacgctttgaaggccgtctgaaagatgttgccgacagcgaattgctggcaaaactgactgcgcaaagcgaagccattgccgaatgctacgaaagccgcgaatacgccaaagccctgcgcgacatcatggccttggcagacattgtcaacgaatacgttgatgccaacaagccgtgggaactcgccaaacaagaaggccaagacgaacgcctgcacgaagtatgcagcgaactcatcaacgccttcaccatgttgaccgcctacctcgcccccgtcttgccgcaaaccgccgcaaacgccgccaaattcctgaatttggaagccatcacttgggcaaatacacgcgataccttgggcaaacacgccatcaacaaatacgaacatttaatgcaacgagtggagcaaaaacaagtggacgatttaatcgaagccaacaaacaaagcatcgccgccgcagccgcacctgccgccgaagagggcaaatacgaaaaagtcgccgaacaggcgagtttcgacgactttatgaaaatcgacatgcgcgttgccaaagtattgaactgcgaagctgtcgaaggcagcaccaaacttttgaaattcgacctcgatttcggttttgaaaaacgcatcatcttctccggcatcgccgcgtcttacccgaaccctgccgaattgaacggccgcatggtcatcgccgtcgccaacttcgccccgcgcaaaatggcaaaattcggtgtatctgaaggcatgattttgagtgccgccacggcagacgggaaactgaagctcttggatgtggatacaggcgcgcagccgggcgacaaagtcggttaa

SEQ ID NO: 4087 - DNA, 1839 bp, Neisseria meningitidis
atgtgcggtatcgtcggcgccatccgcgcccatcacaacgtcgtcgattttctgaccgacggtctcaaacgcctcgaataccggggttatgactcatcaggcattgccgtcaacaccgacggcaaaatcaaacgtgtgcgccgcgtcggacgcgtgcagcttatggaggacgcggcacgcgaaaaaggcatcagcggcggcatcggcatcggacatacgcgttgggcgacacacggcggcgttactgagccgaacgcccacccgcacatcagcggcggtatgattgcggtcgtacacaacggcatcatcgaaaactttgaaagcgaacgcaaacgtttggaaggtttgggataccgttttgaatcgcaaacggataccgaagtcatcgcacacagcatcaatcacgaatacgcgcaaaacggcggcaggctgtttgaagcggtacaagaagcggtcaaacgtttccacggcgcatacgccatcgcggttattgcccaagacaagcctgatgaattagttgtggcgcgtatgggctgcccgcttttggtcgctttgggcgacgatgaaacctttatcgcttcggacgtatccgccgtcatcgcctttacgcgccgcgtggcgtacctcgaagacggcgacatcgcgctgctggcttcagacggcatcaaaaggctgaccgataaaaacggcctgcctgccgaacgcaaagtcaaggtatccgaactctcgctcgcctctttggaactgggactgtacagccactttatgcaaaaagaaatccacgagcagccccgcgcgattgcagacacggcggaggttttcctcgacggcggcttcatccccgaaaacttcggcaaagatgccaaaagcgtgtttgaaagcatccgcagcgtcaaaatccttgcctgcggcacgtcctattacgccgcgctgaccgccaaatattggttggaatccatcgcaaaaatcccgtccgacgtcgaaatcgccagcgaataccgataccgcagcgtgattgctgattccgaccaactggtcattaccatttcccaatccggcgaaacgctggacacgatggaggcgttgaaatacgccaaatccttgggacaccgccacagcctctccatttgcaacgtgatggaatccgccctgccgcgcgaaagcagcctcgtgctttatacccgtgccggtgcggaaatcggcgtcgcctcgaccaaagcgtttaccacgcaactggttgcgctgttcggtttggcggtaacgctggcgaaagtgcgcggtttggtttccgaagaagacgaagcgcgttacaccgaagaactccgccagcttcccggcagcgtgcagcacgctctgaacctcgaacctcaaattgccgcatgggcgcaacagtttgccaagaaaaccagcgcgctgtttttagggcgcggcatccattacccgattgccctcgaaggtgcgttgaagctgaaggaaatcacctacatccacgccgaagcctatcctgccggcgaactgaagcacgggccgcttgccctggtggacgaaaatatgcccgtcgtcgtcatcgcacccaacgacagcctgttggacaaagtcaaagccaatatgcaggaagtcggcgcgcgcggcggcgaacttttcgtctttgccgacctcgacagcaattttaatgccaccgaaggtgtgcacgttatccgcgcaccgcgccacgtcggcaaactgtcccccgtcgtgcatactatccccgtgcagctcctcgcctaccacaccgccctcgcacgcggtaccgatgtggacaagccgcgcaacctggcgaaatccgtaaccgtcgaataa

SEQ ID NO: 4088 - DNA, 528 bp, Neisseria meningitidis
atggaaatgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttccttaataaaatccacgtggttacaggcaaggaagagtccttgcttttgtctgaaaaagacggcgcgctttcgataaacacagggataggggaaatcccgatcaaactttccgacgacgggaaagagctgtatgtcgaacgtaggcagtatgtcaaaaccgatgcggcgatgaaggacaaaatcatcgcccatcagaaaaagtgcggacaaacagcacaggcataccgcgacgcgcgaaatgcgttgccgtcaaaccagacgtatcagcagcatctggcggcgatcgagcaattgaaacggcggtttgaagccgagtttgacgaattggaaaaagaaatcaaatgcaacggcagaagcccggcattgttgctttag

SEQ ID NO: 4089 - DNA, 1326 bp, Neisseria meningitidis
atgaaaaaatacctattccgcgccgccctgtacggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtctataccgttgtaccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattcctttcaggcaaaacagttttttgaacgctatttcacgccgtggcaggttgcaggcaacggaagccttgccggtacggttaccggctattacgaaccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccgattccccatcaccgcgcgcacaacagcaatcaaaggcaggtttgaaggaagccgcttcctcccctaccacacgcgcaaccaaatcaacggcggcgcgcttgacggcaaagccccgatactcggttacgccgaagaccctgtcgaacttttttttatgcacatccaaggctcgggccgtctgaaaaccccgtccggcaaatacatccgcatcggctatgccgacaaaaacgaacatccctacgtttccatcggacgctatatggcggataagggctacctcaaactcggacaaacctccatgcagggcattaagtcttatatgcggcaaaatccgcaacgcctcgccgaagttttgggtcaaaaccccagctatatctttttccgcgagcttgccggaagcagcaatgacggccctgtcggcgcactgggcacgccgctgatgggggaatatgccggcgcagtcgaccggcactacattaccttgggtgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagctcctacccaacggtatgaagcccgaataccgcccgtaa

SEQ ID NO: 4090 - DNA, 840 bp, Neisseria meningitidis
atgctggtcgcttttttaattatgttgcgcgagggtattgaagccgcgctcattgtcggcatcgttgccggttttctgaaacagtccggacattccaaactgatgcctaaggtctggttcggggtcgtccttgcttctttgatgtgtttggggctggggtacggcatccattcggcaacgggcgagattccccagaagcagcaggagttcgtcgtcggcattatcggtttggttgccgttgccatgctgacttatatgattttatggatgaaaaaggcggcgcgttcgatgaagcggcagcttcaggattctgtgcaggcggctttgaaccgtggcagcggtcaaggatgggccttggtcggtatggcgtttcttgccgtggcgcgcgaaggtctggagagtgtttttttcctgcttgccgtattcaaacagagcccgacgtggcagatgccggccggcgcggtagcgggggttttggctgccgccgtgattggcgcgttgatttatcagggcgggatgcgcctgaatctggcgaagtttttccgttggacgggggcgtttctgattgtcgttgccgccggcctgcttgccggctcgctgcgcgcgctgcatgaggcaggtatttggaacgcgcttcaggacattgtgttcgactcatcaaaatatttgcacgaagacagtccgttgggcgtgctgctcggcggatttttcggctataccgaccatccgacgcagggcgagaccttggtttggctgctgtaccttattcccgtcataacttggtttttgtgcggcagcaggccgtctgaaactttaacccgtaaagaggagctgaaatga

SEQ ID NO: 4091 - DNA, 1167 bp, Neisseria meningitidis; identical to SEQ ID NO: 2849

SEQ ID NO: 4092 - DNA, 1266 bp, Neisseria meningitidis; identical to SEQ ID NO: 3545

SEQ ID NO: 4093 - DNA, 330 bp, Neisseria meningitidis
atgtcattacccccatgcccgcaatgcgcctccgaatacacctatgaagacggcggacaatacatctgccccgaatgcgcccatgaatggaatgaaaccgaatccgccgccgaccttgcggctcaagtgcgcgatgccaacggcgcagtgctgcaaaacggcgataccgtcatcctcatcaaagacctcaaggtaaaaggcagctcgatggtgatcaaacaaggcacaaaagtcaaaggcatacgcctgcaagaaggcgatcacaacatcggctgcaaaatcgacggcagcgcgatgaatttaaaatccgaattcgtcaaaaaagcctga

SEQ ID NO: 4094 - DNA, 1371 bp, Neisseria meningitidis
atgccgcaaaacactttaaacatcgtcatcctcgccgccggcaaaggcacgcgcatgtattccaaaatgccaaaagtgctgcaccgcatcggcggcaagcccatggtcgggcgcgttatcgacaccgcagccgcactgaatccgcaaaacatctgcgtcgtcatcggccacggcaaagagcaagtcttggacaccgtcaaacgcgatgtcgtttgggttgaacaaaccgaacagctcggtaccggccacgccgtcaaaaccgccctgccccacctttccgccgaaggccgcacgctggtgttgtacggcgacgttcctttaattgacgttgaaaccctcgaaaccctgctcgaagccgcaggcaacgaagtcgggctgttgaccgacgttcccaacgacccgacaggcttggggcgtatcatccgcgacagcaacggcagcgtaaccgccatcgtcgaagaaaaagacgccgacgccgtccaaaaagccgtgaaagaaatcaataccggcatcctcgtcctgcccaacgccaaactcgaaaactggctgaacagcctttccagcaacaatgcacaaggcgaatactacctgaccgacctcatcgccaaagccgttgccgacggtattaaagttcatcccgtccaagtgcgcgcctcccacctcgccgccggcgtgaacaacaaactccagctcaccgaactcgaacgcatcttccaaaccgaacaggcgcaagaattgctcaaagcaggcgtaaccctgcgcgatccggcacgtttcgatttacgaggccgtctgaaacacgggcaagacgtcgtgattgatgtgaactgtatctttgaaggcgacatcgagctcggcgacaacgtcgaaatcggcgcaaactgcgtcatcaaaaacgccaaaatcggcgcaaacagcaaaatcgcccccttctcccacctcgaaagctgcgaagtcggcgaaaacaaccgaatcggcccgtacgcccgcctgcgtccgcaagcccgccttgcagacgacgtacacgtcggcaacttcgtcgaaatcaaaaacgccgccatcggcaaaggcaccaaagccaaccacctcacctacatcggcgacgccgaagtcggctgcaaaaccaacttcggcgccggtacgattattgccaactacgacggcgtgcacaaacacaaaaccgtcatcggcgacgaagtgcgcatcggttcaaactgcgtcctagtcgcccccgttaccctcggcaacaaagtaaccacaggcgcgggcagcacgattacccgcaatgtcgaagacaacaaactcgccctcgcccgcgcccgccaaaccgtcatcgaaggctgggtgcgtcctgaaaaagacaaacaataa

SEQ ID NO: 4095 - DNA, 273 bp, Neisseria meningitidis; identical to SEQ ID NO: 3725

SEQ ID NO: 4096 - DNA, 714 bp, Neisseria meningitidis
atgcaagaaaacccgaccgtgtggctgttcgacctcgacaacacgctgcacgatgccgacgcaggcatcttcacactcatcaaccgcgctatgacacgctatatggcacgccgcctcaaactctccgaatctgccgcgtccgacctgcgtcaagactattggcaccgctacggcgcaacgctcgccggactgcaaatccaccatcccgaaatcgacatcgccgaatttttgcgcgaaagccatccgatcgatgcaatcctgaccaggctgcacggcatgcctgaaacacaaaacaccctgagccgcctaaaagggcgcaaggcggttttttccaacggcccgtcgttttacgtccgtgccgttgtcaacgcactcggtttggaaaaccgtttcgacgcgcttttcggcacggatgatttcgggctgctgtacaaacccaatccgcaagcgtatctcaatgtctgccgcctgttggacgtaccgcccgaatgctgcattatggtggacgacagcgcggacaacctgcatcaggcaaaggcgctgggtatgaaaaccgtccggttcggtgcaaaatcccacgcgctgccctttatcgatgcctccgtaagcgatatggcgcaactggctcggtatgcagaaactttgtcagaacaccgccaaaatcattacaataccccctaccccccgaaaatacgaaagaaaagccatgcgtaa

SEQ ID NO: 4097 - DNA, 1002 bp, Neisseria meningitidis
atgaaacggaaaatttggctgctgccgctgctggcggtttcggcatacctgcaggcgcagacggaagtcaggctggcggtgcataagtcgttcagcctgcccaaagggttgattgcgcgcttcgagcgggcaaacgatgcgaaggtgtcgattattcaggcgggcggcgcgaacgaaatgctcaacaaactgattttgagccgcgccaacccgattgccgacgcggtgtatggtttggacaacgccaatatcggcaaggcgcgggaaatgggcattttggcggcggcgcaacccgaatccgcccccgtcgcggtcgggctgccttcggctttggcggtcgattacggctatgtgtccatcaattacgacaaaaaatggtttgaaggcaaaaagctgcccctgccgcaaaccctgcaggatttgacccgccccgaatataaaaacctattggtcgtgccgtcccccgccacgtcgtccccggggctgggcttcctgatggcgaacatcagcggtctgggcgaagaaagcgcgttcaaatggtgggcacagatgcggcagaacggcgtgaaggtcgccaaaggctggagcgaggcgtattacaccgacttttcgcacaacggcggcgcgtatccgctggtggtcggttatgccgccagcccggcggcggaagtgtatttttccaaaggcaaatacagcgagccgccgacgggcaacctgtttttaaaaggcggcgtattccgccaggtcgaaggcgcggcggtcttgaagggcgcgaaacagccggaattggcggcaaaactggtgcaatggctgcaaagtcgggaagtgcagcaggcggttccgtccgaaatgtgggtttaccccgccgtcaaaaacacgcgcctgcccgacgtgttccgcttcgcccaagccccgacgcacaccaccgcccccgcgcagcgcgatattgatgcgaaccagcgcggatgggtttcccgttggattagaacggttttgaaataa

SEQ ID NO: 4098 - DNA, 849 bp, Neisseria meningitidis; identical to SEQ ID NO: 2751

SEQ ID NO: 4099 - DNA, 486 bp, Neisseria meningitidis
atggacgcgctgcacaccatcgcccgaaacctgacgaaaaaacgtcaaaccgtaagctgtgccgaatcctgtacgggcggaatgcttgccgccgcattcacaagcgttgcaggcagttcgcaatggttcgaccagagttttgtaacatacagcaacaaagccaaagaagaccgcttgggcgtgttgcccgaaaccctgctcgaacacggcgcggtcagccgccaaaccgtctatgagatggcgcgcggcgcgaaagccgtggcgcaggcggattacgccgtcggtatttccggcatcgccggtccgggcggcggcagcgaaagcaaacccgtcggcacggtttggttcgggtttgcctttccgggcggaagttgcgaagcaatgcgccgttttgacggcaaccgcgaatccgtccgcgcgcaggcggtcgccttcgcgttggaacggttggcggggctgattgaaaacggcggcgatgctgtctaa

SEQ ID NO: 4100 - DNA, 1569 bp, Neisseria meningitidis
atgaaacaccgtactttcttttccctttgcgccaagttcggctgcctgcttgcgctgggtgcttgttcgcccaaaatcgtcgatgccggagccgcgaccgtgccgcacactttatccactttgaaaactgcggacaaccgccccgccagtgtttacttgaaaaaagacaaaccgacgctgattaaattttgggcgagctggtgtcctttgtgtctgtccgaattgggacagaccgaaaaatgggcgcaagatgcaaaattcagctccgccaacctgattaccgtcgcctccccgggctttttgcacgagaaaaaagacggcgacttccaaaaatggtatgccggtttgaattatcccaagctgcccgtcgtaaccgacaacggcggcacgatcgcccaaagcctgaatatcagcgtttacccctcgtgggcgttaatcggtaaagacagcgacgtgcagcgcatcgtcaaaggcagcatcaacgaagcgcaggcgttggcgttaatccgcgacccgaatgccgatttgggcagcttgaaacattcgttctacaaacccgacactcagaaaaaggattcaaaaatcatgaacacgcgcaccatttacctcgccggcggctgcttctggggcttggaagcctatttccaacgcatcgacggcgtggttgacgcggtatccggctacgccaacggcaacacgaaaaatccgagctatgaagacgtgtcctaccgccatacgggccacgccgaaaccgtcaaagtgacctacgatgccgacaaactcagcctagacgacatcctgcaatatttcttccgcgtcgttgatccgaccagcctcaacaaacagggcaacgacaccggtacgcaataccgcagcggcgtgtactacaccgaccccgccgaaaaagccgtcatcgccgccgccctcaaacgcgagcagcaaaaataccaactgcccctcgttgttgaaaacgagccgctgaaaaacttctacgatgccgaggaataccatcaggactacttgattaaaaaccccaacggctactgccacatcgacatccgcaaagctgacgaaccgctgccgggcaaaaccaagaccgccccgcaaggcaaaggcttcgacgcggcaacgtataaaaaaccgagtgacgccgaactcaaacgcaccctgaccgaagagcaataccaagttacccaaaacagcgcgaccgaatatgccttcagccacgaatacgaccatttgttcaaacccggcatttatgtggacgttgtcagcggcgaacctttgttcagctccgccgacaaatatgattccggctgcggctggccgagcttcacgcgcccgattgatgcaaaatccgttaccgaacacgatgatttcagctacaacatgcgccgcaccgaagtgcgcagccacgccgccgactcgcatttgggacacgtcttccccgacggcccgcgcgacaaaggcggactgcgctactgcatcaacggcgcgagcttgaaattcatcccgctggaacaaatggacgcggcaggctatggcgcgttgaaaggtaaagtgaaataa

SEQ ID NO: 4101 - DNA, 1266 bp, Neisseria meningitidis
atgttcagcttcttccgtcgcaagaaaaaacaggaaacgccggctctcgaggaggctcaaattcaggaaaccgcagcaaaagcagaatctgaacttgctcaaatagttgaaaatattaaagaagatgctgaatctttagcagaaagcgtcaaagggcaggtcgaatctgccgttgaaaccgtcagcggtgcggttgaacaggtaaaggaaaccgttgccgagatgctgtctgaagcagaggaagcggcggaaaaagcagcggaacaagtcgaagcggcaaaagaagccgttgccgaaaccgtcggcgaggctgtcgggcaagttcaagaagccgttgcgacaactgaagaacacaagctcggttgggcggcgcgtttgaaacaaggcctgaccaaatcgcgcgacaaaatggcgaaatcgctggcgggcgtgttcggcggcggacaaatcgacgaagatttatacgaagagctggaaaccgtgctgattaccagcgatatgggcatggaagccaccgaatacctgatgaaagacgtgcgcgaccgcgtcagcctcaaagggctgaaagacggcaacgaattgcgcggcgcgttgaaagaagccttgtacgacctgattaagcctctggagaaacctttggttttgcccgaaaccaaagagccgtttgtcatcatgcttgccggcatcaacggcgcgggcaaaaccacgtctatcggtaaactcgccaaatatttccaagcgcagggcaaatccgtattgctggcggcaggcgatactttccgtgccgccgcgcgtgagcagcttcaagcttggggcgagcgcaacaacgtaaccgtgatttcgcaaaccacgggcgattccgccgccgtgtgcttcgatgccgtccaagccgccaaagcgcgcggcatcgacattgtgctggccgacaccgccggccgcctgcccacgcagcttcatttgatggaagaaatcaaaaaagtgaaacgcgtgctgcaaaaagccatgcccgacgcgccgcacgaaatcatcgtcgtgcttgatgccaatatcgggcaaaacgccgtcaaccaagtcaaagcctttgacgacgcattggggctgaccggtttaatcgttaccaaactcgacggcacggcaaaaggcggcatcctcgccgcgcttgcctccgaccgccccgttcccgtccgctatatcggcgtgggcgaaggcatagacgacctgcgcccgtttgacgcgcgcgcgtttgtggacgcactgctggattga

SEQ ID NO: 4102 - DNA, 225 bp, Neisseria meningitidis
atgccgtccgaaaacagcagaccgatgccgtcattcccgcgcaggcgggaatccagaccttgggataacggcaatattcaaaggttatctgaaagtccgagattctggattcccactttcgtgggaatgacgggatgtaggttcgtgggaatgacgtggtgcaggtttccgtatggatggattcgtcattcccgcgcaggcgggaatctagaacgtaaaatctaa

SEQ ID NO: 4103 - DNA, 285 bp, Neisseria meningitidis
atgcagcctgcggtttatattttagcaagccaacgtaatggcacgttatacattggcgttacatctgatttggtgcaacgtatttaccaacatagggagcatttgattgagggatttacatcacggtacaacgttactatgctggtttggtatgaactgcatcctacgatggagagtgcaattactcgggaaaaacagttgaagaaatggaacagggcttggaaattgcaactgattgaagaaaataatgtttcttggcaggatttatggtttgatattatttag

SEQ ID NO: 4104 - DNA, 144 bp, Neisseria meningitidis
ttgcttttcttaacattcccctttggcagccaagtgaaagggcttttcaatcagcaattcggcgggcgcggaatcgggcggtttaccgaaccccggcgttcgcggcgcgccgccccgtcccgtgaaggcaaactcaaggaataa

SEQ ID NO: 4105 - DNA, 3167 bp, Neisseria meningitidis
atgaataaaacttggaaacggcaggttttccgccataccgcgctttataccgccatattgatgttttcccataccggcgggggggggggcaggcgcaagcgcaaacgcaaacgcaaacgcataaatacgctattgtaatgaacgcgcaaaatctgcccgaggtaaagtggggggatcaatatcagtcattgacgcacaaaagcaatgaacgcgaagttatccatacgagtggttttggtttggcaaaaaagagcattagtttctcattcaataataccgatgaagttgttgctgaaaaaaaagatactgtcgttttcggcgcggcgacctacctgccgccctacggaaaggtttccggttttgataccgctaagctgaccgagcgcaaaaatgcccttgatcagattggtacgaccaaaacggggctggtaggctacagctacgaaggtagcacatgctccagcggaggttgtcctacagttgcctatagaacccaatttaccttcggcaattccagtttggcaaaaaaggcaaacggcggcgggctggatatatacgaagacaaaagccgcgacaattcgcccatttacaaattgaaggatcatccttggttgggcgtgtctttcaatttgggcggagagagctccttcaaaccaaagagacaaggttctttggtatcttcttttagcgaggacgtgacgcagcaaaatggtgcgggcagccaacacaaagacaaaaacctcgtttatacgacagacgattacaagagtcagaataataaaaaccatcaggacaaacaccacgccgtcgccttttatctgaacgccaagctgcacctgctggataaaaaacacattaaaaatatcgtgcaaggtaaaacagttaatttgggtatcttgaaaacacgcatcgagccgacggaagcatggaaaagacggaatagtaacttttttaacggtagttggacgtatgaagagaaaggaacagtcagcgtcaaactcaaattgccggaagtcaaagcaggccgctgcatcaacgcaaataaccccaataagagtaccaaagccccttcccccgcactgactgcccccgcgctgtggttcggacctgtgcaaaatggtaaggtgcagatgtattccgcttcggtttccacctaccccgatagttcgagcagccgcatcttccttcaaaatctgaaaagaaaaaccgaccccaacaaacccggccgccattccctcgcagacttggctaagtcggatattgaaaatcgacagccgaatttcacagggcggcaaaccatcatccgattggatggcggcgtacagcagatcaaactgggtagaaacaatgatgaggtcgccaattttaatggaaatgacggcaaaaacgacactttcggcattgttagtgaagggagcttcatgcctgatgccagcgagtggaaaaaagtattgctgccttggacggttcgtgcttccaatgatgacggtcaatttaacacattcaacaaagaagaaaaagacggcaagccaaaatacagccaaaaataccgcagccgcgacaacggcaagcacgagcgcaatttgggcgacatcgtcaacagccccatcgtggcggtcggcgagtatttggctacttccgccaacgacgggatggtgcatatcttcaaacaaagcggcggggacaagcgcagctacaatctgaagctcagttatatcccgggtacgatgccgcgcaaggatattcaaaacaccgaatccacccttgccaaagagctgcgcgcctttgccgaaaaaagctatgtgggcgaccgctacggcgtggacggcggctttgtcttgcgcaaagtcgaacggaacgggaaagaccatgtgtttatgttcggcgcgatgggctttggcggcagaggcgcgtatgccttggatttaagcaaaatcgacagcggcaacggcaacctggcagacgtttccctgtttgatgtcaaacatgacaagaatggcaataacggcgtgaaattaggctacaccgtcggcacgccgcaaatcggcaaaacccacgacggcaaatacgccgctttcctcgcctccggttatgcgactaaagacattaccagcggcgacaataaaaccgcgctgtatgtgtatgatttggaaagcagcggcacgctgattaaaaaaatcgaagtacccggtggcaagggcgggctttcgtcccccacgctggtggataaagatttggacggcacggtcgatatcgcctatgccggcgatcgcggcggcagtatgtaccgctttgatttgagcaatcaagatcctaatcaatggtctgtacgcgccatttttgaaggcacaaaaccgattacttccgcgcccgctatttcccaactgaaagacaaacgcgtggttatcttcggcacgggcagtgatttgagtgaggatgatgtactcagtacgagcgaacaatatatttacggtatcttcgacgacgatacggtggcgaataacgtaaatgtaaaactcagcggtttgggaggcgggctgctcgagcaagagcttaagcaggaggataaaaccttattcctgaccgattacaagcgatccgacggatcgggcagcaaagggtgggtagtgaaattgaagggcggacagcgcgttaccgtcaaaccgaccgtggtattgcgtaccgcctttgtaaccatccataaatatacgggtacggacaaatgcggcgcggaaaccgccattttgggtatcaataccgccgacggcggcaagctgaccaagaaaagcgcgcgcccgattgtgccggccgagaatcaggctgtcgcgcaatattccggccataagaaaggcatcaacggcaaatccatccctataggttgtatgcaaaaaggcaatgaaatcgtctgcccgaacggatatgtttacgacaaaccggttaatgtgcgttatctggatgaaaagaaaacagacggattttcaacaacggcagacggcgatgcgggcggcagcggtatagaccccgccggcaagcgttccggcaaaaacaaccgctgcttctcccaaaaaggggtgcgcaccctgctgatgaacgatttggacagcttggacattaccggcccgacgtgcggtatgaaacgaatcagctggcgtgaagtcttctactga

SEQ ID NO: 4106 - DNA, 2151 bp, Neisseria meningitidis; identical to SEQ ID NO: 105

SEQ ID NO: 4107 - DNA, 1227 bp, Neisseria meningitidis
atgaataccgataacctgcacgacatcttggacgaaatggttcaagtgtattctcaaaaaaaacaaagccgatccgaaaccccggccgaaatcggcgcacacttccacccgctgctcgaccgcctgtgcgaaaccgcagaagcacaaaacgcgtccgacatccttatcagcaaaggattcccgccctcgttgaaaatcaacagcgcattaaccccgcagccgcaaaaggcgctgacgggcgaggaaaccgccgccatcgccgcatcgacgatgaacgccgaacaatcggaaatattccggcgcgacggcgaaatcaactactccgtccagtcgcgcagcggcacgcgctaccgcgccaacgcctaccacagccaaggcagcgcaggtttggttttgcggcgcatcaaccacgtcatcccgcaaatgcaggaattgggcctgcccgaaaaactcaaagacctcgccgtcgcaccgcgcgggctgctgattatcgtcgggcctaccggttcgggcaaatccaccacgatggcgactatgctcgaacaccgcaacaaaaccctgcccagccatatcgttaccatcgaagacccgattgaatttatctacaaaccgcgccgctgcatctttacccagcgcgaaatcggcgtcgacaccataaactggcagacggcggtacaaaacgctatgcgccaatcccccgacgtggtctgcatcggcgaagtccgcagcagggaaagtatggaatacgcgatgcagctcgcccaaaccggccacctgtgcatttttacgctccacgccaacaccgcgccgcagtcgctcgaacgcatactcaacttctaccccaaagaacagcacaaccaaatactgatcgacatcgccctcaacctgaccggcatcatctgccaacgcctcgccctcaaacaagacaaaacgggcaggacggcggttgtcgacttgctcatcaacacgcccgccatccaagacttcatcctgaagggcgacctgatgaacatcagtaaaatcatggaaaccgccaaaaccgacggaatgcagacgatggatcaaaaccttttcgaactgtaccgtcacggcatcatcagttacgaagaagccctgcgccagtccgtttccgccaacaacctgcgattgcacatccaactgcacaaagaaggcaaaacgcccgaactcctttacgacagggtcaacggtctcaacctcatttcctga

SEQ ID NO: 4108 - DNA, 1044 bp, Neisseria meningitidis
atgcagattaccgacttactcgccttcggcgctaaaaacaaagcatccgaccttcacctgagttcgggcatatcccctatgattcgggttcacggcgatatgcggcgcatcaaccttcccgaaatgagcgcggaagaggtcggtaatatggtaacttcggtgatgaacgaccaccagcggaaaatctaccagcaaaacttggaagtcgacttctcgttcgaactgcccaacgtcgcccgattccgcgtcaacgccttcaacatcggccgcggtcccgccgccgtattccgcaccattcccagcaccgtcttatcgctggaagaattgaaagccccgagcattttccaaaaaatcgcagaatcgccgcgcggcatggttttggttaccggccctaccggttcgggcaaatcgaccacgcttgccgcgatgatcaactacatcaacgaaacccagccggcacacatcctgaccatcgaagacccgattgaattcgtccaccaaagcaaaaaatccctgattaaccagcgcgagctgcaccagcacaccctcagcttcgccaacgcgctgcgttccgcattgcgcgaagaccccgacgttatccttgtcggcgagatgcgcgacccagaaaccatcggcttggcactgaccgccgccgaaaccggacacttggttttcggcacgctgcacacgaccggcgcagcaaaaaccgtcgaccgtattgtggacgtattcccggcgggagaaaaagaaatggtgcgctctatgctgtccgaatcgctgaccgccgtcatctcccaaaacctgctgaaaacgcacgacggcaacggccgtgtcgcctcgcacgaaatcctgattgccaaccccgccgtccgcaacctcatccgcgaaaacaaaatcacgcagattaactccgtcctgcaaaccgggcaggcgagcggtatgcagacaatggaccaatcgctgcaatcgctggtgcgccaagggctgatcgcaccggaagtcgcacgcagacgcgcgcaaaacagcgaaagtatgagtttctga

SEQ ID NO: 4109 - DNA, 687 bp, Neisseria meningitidis
atgacggtgttgcaagaacgttattgtgaggtgtccgaccgtatcggaaaattggttctgcaggcgggcagggagccgcattccgtcagcctgattgccgtcggtaagactttcccttcagacggcatccgcgaagtttacgccgccggacagcgtgatttcggcgagaactatattcaggagtggtacggcaaaacggaagagttggcggatttgaccgacatcgtgtggcacgtcatcggcgatgtgcagtccaacaaaaccaagtttgtcgccgaacgcgcgcattgggtgcataccgtatgccgtctgaaaaccgccgtccggctgagcgggcaacgtccttcctcaatgccgcctttgcaggtgtgtatcgaggtgaacattgcgggcgaggcggtgaagcacggtgtcgcgcccgaagaagcagtcgcgcttgctgtggaagtggcgaagctgccgaatatcgtcgtacgtggactgatgtgtgttgccaaagccaacagcagtgaaacggagttgaaggtgcaatttcaaacgatgcggaaactgcttgccgacctcaatgcggctggcgttaaggcagacgtgctgtctatggggatgtcggacgatatgcctgccgccattgagtgcggtgcgacacacgtccgtatcggcagcgcgattttcgggaaaaggggctga

SEQ ID NO: 4110 - DNA, 408 bp, Neisseria meningitidis; identical to SEQ ID NO: 857

SEQ ID NO: 4111 - DNA, 792 bp, Neisseria meningitidis
atgaatgtttattttctcggcggcggcaatatggcggctgccgttgcgggcggattggtcaaacaaggcggttaccgcatctatatagccaatcggggtgcggaaaaacgcgaacgtttggaaaaagagttgggggtcgaaacttcggcaaccctgccggagcttcattccgacgatgttttaatccttgccgtcaaaccgcaggatatggaagctgcgtgcaaaaatatccgcaccaacggcgcattggtgctttctgtcgcagccggattgtcggtcggtacgctcagccgttacctcgggggaacacgccgcattgtccgggttatgccgaatacacccggaaaaatcgggctgggcgtatctggtatgtatgccgaagcggaagtatcggaaacagaccgcaggattgccgatcgaatcatgaaatcagtcggtttgactgtttggttggatgatgaggaaaaaatgcacggcattaccggcatcagcggcagcggaccggcttatgtgttttatctgctggacgcattgcaaaatgccgccatccgacaagggtttgatatggcagaagcacgcgcgctcagtctggcaacgtttaaaggagcggttgcccttgccgagcagacgggtgaagatttcgagaagcttcaaaaaaatgtaacgtcaaaaggcgggacaacccacgaagccgtggaagctttcaggcggcatcgtgtcgccgaagccataagcgagggcgtttgtgcctgtgtgcgccgttcgcaggaaatggaacggcaatatcaataa

SEQ ID NO: 4112 - DNA, 417 bp, Neisseria meningitidis
atggcaaagctgacagaacaagatattttgaattggagcgggccggaagacgattatatgaatgacgaccatttggcttttttccgcgaattgctggtaaaaatgcaagacgaactcatcgaaaatgcttccgctacgacagggcatctccaagaacacgaatcagcccccgatcctgccgaccgtgccacacaggaagaagagtacgcattggaactccgtacccgcgatcgggaacgaaaacttctcagtaaaatacaggcgaccatccgcaatattgatgaaggggattatggattctgtgccgatacgggagagcctatcggtttgaagcggctgctggcacgcccgacagccactttatctgttgagtcccaagaacgccgagagaggatgaaaaaacagtttgccgactga

SEQ ID NO: 4113 - DNA, 357 bp, Neisseria meningitidis
atgtcggtgatggcgggacggcatccgtacggtgtccggtcgggtttgcggaggaacggcttgaaactttgggatattcattttagaatgactcgttttatcgtcgcaagatgcggtttattgtttgcaacccttaaaggaaaaaccatgaagaaaatgttcgtgctgttctgtatgctgttctcctgcgccttctcccttgcggcggtaaacatcaatgcggcttcgcagcaggagttggaggcgctgccaggcataggccctgcggtgctggcgaagctgaaggatcaggcttccgtcggcgcgcccgcaccaaaaggcccagccaaaccagtgctgcccgcggataaaaaataa

SEQ ID NO: 4114 - DNA, 159 bp, Neisseria meningitidis
atgccgtctgaacatgcgttcgggcggcgtttttataacaaaaacacttcatggcggttggttttatgcctatctaagtttttgtgtcgtgcatacctgaagatttcagacggcatcggtttatgctgtctgaaaagtgtattccgtttcagtttgtaa

SEQ ID NO: 4115 - DNA, 1122 bp, Neisseria meningitidis
atgagtaatcaagatttttatgcgacgctgggtgtggcaagaacagctaccgatgatgagattaaaaaagcctaccggaaattggcgatgaaataccatcccgaccgcaatcctgacaataaagaggcggaagagaagtttaaagaagtacaaaaggcgtatgaaactttgtccgacaaggaaaagcgcgctatgtacgaccagtatggtcatgcggcgtttgaaggcggcggacaggggggcttcggagggtttggcggatttggcggtgcgcagggttttgactttggggatattttcagccaaatgtttggaggcggttcggggcgcgcccagcctgattatcagggtgaggacgttcaagtcggtatcgaaatcacgcttgaagaagccgcaaaaggtgtgaagaaacgcatcaatattccgacttatgaagcgtgtgatgtctgtaacggcagtggcgcgaaaccggggacatccccggaaacctgcccgacttgcaaaggttcgggtacggtgcacatccagcaggcgattttccgtatgcagcagacttgtccgacctgccacggtgcgggcaaacacattaaagaaccttgcgtcaaatgccgtggcgcggggcggaataaggcggtcaagacggtggaagtcaatattcccgccggtatcgatgacgggcagcgtatccgtttgagcggcgaaggcgggccgggtatgcacggtgcgcctgccggcgacttgtatgtaaccgtccgcattcgggcgcataagattttccaacgcgacggtctggacttgcattgcgaactgccgatcagttttgccacggctgctttgggcggggagttggaagtgccgaccttggacggaaaggtcaagctcaccgtccccaaagaaacccaaaccggcaggaggatgcgcgtgaagggtaagggtgtcaaatctttacgcagcagcgcgaccggcgatttgtactgccatattgttgtcgaaacgcctgtcaatttgaccgaccgtcaaaaagagcttttggaagaatttgagcggatttctaccggcttggaaaaccaaacaccgcgcaagaaatcgtttttagacaagctgcgcgatttgtttgattga

SEQ ID NO: 4116 - DNA, 2019 bp, Neisseria meningitidis
atgaataaatctttatccagttcggtagaagaataccgcgagctgacgctccgaggcatgatactcggtgcattgatcactgtaatttttactgcgtccaatgtttacctcggtttgaaagtcgggctgacctttgcctcgtcgattccggcggcggtgatttcgatggcggttttaaagtttttcaaaggcagcaatattttggaaaacaacatggtgcagacccaagcctcggctgcgggtacgctttcgaccatcatcttcgtcctgcccggtttgctgatggcgggctactggagcggtttcccgttctggcagacgacgcttttatgtattgccggcgggattttgggggtgattttcaccattcctctgcgttacgcaatggtggtgaaaagcgatttgccttatccggaaggtgtggcggctgctgaaattttgaaagtgggcggtcatgaagaaggggataaccgtcagggcggcagcggcatcaaagagctggcggccggcggtgcgttggcgggattgatgagcttttgcgccggaggtctgcgcgtgattgccgacagcgcgagttattggtttaaaagcggtacggcgattttccagctgccgatgggcttttcactggcattgttgggcgcgggctatttggtcggactgacgggcggtatcgccatcctgttgggcatttcgattgcttggggcattgccgtgccgtatttctcctcacacattccgcaaccttccgatatggaaatggcggcgtttgcgatgaagctgtggaaggagaaagtgcgttttatcggtgcggggactattggcattgcggcggtttggacgctgttgatgctgctcaagccgatggtggaaggcatgaagatgtcgttcaagagttttggcggcggtgcgcccgctgcggaacgcgccgaacaggatttgtcgcctaaggctatgattttttgggtgctggcgatgatgtttgttttaggcgtgtcgttttaccactttatcggcgattcgcacattacgggcggcatggcttggcttttggtggtcgtttgcacgcttttggcttccgtcatcggctttttggtcgccgccgcctgcggttatatggcaggtttggtcggctcgtcttccagcccgatttccggcgtgggcatcgtgtccgtcgtcgttatttcactggttttgctgctggtaggcgaatccggaggtttgttggcggatgaggctaaccgcaaatttttgctggcactgactttgttttgcggctcggcagtaatctgcgtggcttcgatttccaatgacaacctgcaagacttgaaaaccggctacctgctcaaagccacgccttggcggcagcaagtcgccctgattatcggctgtatcgttggtgcgctggttatttcgcccgtgttggaactgctttacgaagcctacggctttaccggcgcaatgccgcgcgaaggcatggacgcggcgcaggctttggcagcccctcaagcgactttgatgacgaccatcgcgtcgggcattttcgcccacaaccttgaatgggtctatatctttaccggtatcgtgattggagcagtattaatcgtcgtcgatttggtgttgaaaaaatcatcaggcggcaaacttgccctgcccgtccttgcggtcggtatgggtatttatctgccgccgtccgtcaatatgcccatcgtggcaggcgcggtgttggcggcggtgttgaaacacatcatcggtaaaaaagcggaaaaccgcgaaggccgtctgaaaaacgccgagcgcatcggaaccttgttctccgccggcctgattgtcggtgaaagcctgatcggtgtgattatggcgtttattattgccttctccgtgaccaacggcggctcggatgcgccgctcgcgttgaatctgcaaaactgggatgccgccgcttcttggctgggtttggcgttcttcgttaccgggatgtttttctttgcacagcgcgtactgaaggcgggcaagtag

SEQ ID NO: 4117 - DNA, 1003 bp, Neisseria meningitidis
atgaaagataaaaagatgaacatcattgataccgccattcctgacgtaaaactgcttgagccccaagtcttcggcgacgcgcgcggcttttttatggaaaccttccgcgacgagtggtttaaaacccaagtctgcgaacgcaccttcgtgcaggaaaaccactccaaatccggcaaaggcgtattgcgcggcctgcactatcaaactgaaaacacacaaggcaaactcgtacgcgtggttgtcggcgaagtattcgacgtggccgtcgatatgcgtaaagactcccccactttcggcaaatgggtaggcgaaattctgtccgcagaaaacaaacgccaactgtgggtacccgaaggtttcgcacacggcttctatgtactgagcgatgaagccgagttcgtctataaatgcacggactattacaagcctgaagccgaacaggttttaatatggaacgacccgacagtcggcataggctggccgcttcaaaccgcgccgctgctgtcgcccaaagaccttgccggcaaaacgtgggcgcaagccgaaaagctccgccttccgctttaccgataaaaaatgccgtctgaacgtttcagacggcattttttccgacagcctacttgcccgccttcagtacgcgctgtgcaaagaaaaacatcccggtaacgaagaacgccaaacccagccaagaagcggcggcatcccagttttgcagattcaacgcgagcggcgcatccgagccgccgttggtcacggagaaggcaataataaacgccataatcacaccgatcaggctttcaccgacaatcaggccggcggagaacaaggttccgatgcgctcggcgtttttcagacggccttcgcggttttccgcttttttaccgatgatgtgtttcaacaccgccgccaacaccgcgcctgccacgatgggcatattgacggacggcggcagataaatacccataccgaccgcaaggacgggcagggcaagtttgccgcctga

SEQ ID NO: 4118 - DNA, 867 bp, Neisseria meningitidis
atgaaaggcatcatactggcaggcggcagcggcacgcgcctctaccccatcacgcgcggcgtatccaaacagctcctgcccgtgtacgacaaaccgatgatttattaccccttgtcggttttgatgctggcgggaatccgcgatattttggtgattaccgcgcctgaagacaacgcctctttcaaacgcctgcttggcgacggcagcgatttcggcatttccatcagttatgccgtgcaacccagtccggacggcttggcacaggcatttatcatcggcgaagaatttatcggcaacgacaatgtttgcttggttttgggcgacaatattttttacggtcagtcgtttacgcaaacattgaaacaggcggcagcgcaaacgcacggcgcaaccgtgtttgcttatcaggtcaaaaaccccgaacgtttcggcgtggttgaatttaacgaaaacttccgcgccgtttccatcgaagaaaaaccgcaacggcccaaatccgattgggcggtaaccggcttgtatttctacgacaaccgcgccgtcgagttcgccaaacagctcaaaccgtccgcacgcggcgaattggaaattaccgacctcaaccggatgtatttggaagacggctcgctctccgttcaaatattgggacgcggtttcgcgtggctggacaccggcacccacgagagcctgcacgaagccgcttcattcgtccaaaccgtgcaaaatatccaaaacctgcacatcgcctgcctcgaagaaatcgcttggcgcaacggttggctttccgatgaaaaactggaagaattggcgcgcccgatggcgaaaaaccaatacggccaatatttgctgcgcctgttgaaaaaataa

SEQ ID NO: 4119 - DNA, 1068 bp, Neisseria meningitidis
atgagaaaaatccttgttaccggcggcgcgggctttatcggttctgccgttgtccgtcatattatccgaaacacccgggacgctgtcgtcaatgtcgataagctgacttatgccggcaatttggaatctttgactgaggtagccgataatcctcgctatgcttttgaacaagtggatatttgcgaccgcgccgaactcgaccgcgtattcgcgcaataccggcctgatgccgtgatgcacttggcggcggaaagccatgtcgaccgctctatcggttcggcaggcgagtttatccaaaccaatatcgtcggcacattcaatctgcttgaagcagcccgcgcctactggcaacaaatgccgtctgaacagcacgaagccttccgtttccaccatatttccaccgatgaagtctatggcgatttaggcggcacggacgatttgtttaccgaaaccgcgccctacgcgccgtccagcccctactctgcctctaaagcgtccagcgaccacctcgtccgcgcgtggttgcgtacttacggcttgccgaccattgtaaccaactgctccaacaactacggtccttaccattttccggaaaaactcattcctttgatgattctgaacgcgcttgacggcaaaccgctgcctgtgtacggcgacggtatgcaaatccgcgactggctgtttgtcgaagaccacgcgcgcgcactgtatcaggttgttaccgaaggtgttgtcggcgaaacctacaatatcggcggccacaatgaaaaagccaatattgaagtcgtcaaaaccatctgcgccctgctggaagaactcgctcccgaaaaaccggccggtgtggcgcgttatgaagatttgattactttcgtacaagaccgccccggccatgacgtacgctacgccgtcgacgcagccaaaatcaggcgggatttgggctggctgcctttggaaaccttcgagtccggcctccgcaaaaccgtgcaatggtatctggacaacaaaacctggtggcaaaatgtattgaacggcagctatcgtttggaacgtttaggtactggaaaatag

SEQ ID NO: 4120 - DNA, 1020 bp, Neisseria meningitidis
atgaaaaaaattctcgttaccggcggcaccggttttatcggctcgcataccgttgtttctttgctgaaaagcggccatcaagtcgtgattttggataacctatgcaattccagcatcaatatcctgccacgcttgaaaacgattaccggccaagagattccgttttatcaaggcgatatccgcgatcgtgagattttgcgccgtatttttgcggaaaaccgcattgattcggtgattcattttgccggcttgaaagcggtgggtgaaagtgtggccgagccgatgaaatattatgataataatgtttccggcagcttggtgttggcggaagaaatggcgcgtgcgggcgtgtttagcattgtgttcagttcttcggcgacggtttatggcgatccgggcaaagtgccttataccgaggatatgccaccgggcgacaccaccagcccttacggcgcatcgaaatcgatggttgagcgcattctcactgacattcaaaaagccgatccgcgctggagcatgattttgttgcgttatttcaatccgattggcgcgcatgaaagcggcttgattggcgagcagccaaacggcatcccgaataatttgttgccttatatctgccaagtggcggcaggcaaactgccgcaattggcggtatttggcgatgactaccctacccccgacggcacggggatgcgtgactatattcatgtgatggatttggcagaaggccatgtcgcggctatgcaggcaaaaagtaatgtagcaggcacgcatttgctgaacttaggctccggccgcgcttcttcggtgttggaaatcatccgcgcatttgaagcagcttcgggtttgacgattccgtatgaagtcaaaccgcgccgtgccggtgatttggcgtgcttctatgccgacccttcctatacaaaggcgcaaatcggctggcaaacccagcgtgatttaacccaaatgatggaagactcatggcgctgggtgagtaataatccgaatggctacgacgattaa

SEQ ID NO: 4121 - DNA, 927 bp, Neisseria meningitidis
atgcatcaatattatgacgcagtaattttatcggttggaaatgggttgttaaaaaggttctttaagcagaatgcgcaattaaatattgcttcaaggccattgattattaccttgtttccaggtgtagtattcggtgatcaggcaagtattctatctcgtatgggggctgatattgttttatataataataagcatgattttagaattgcagaggaatataagaaacaatataaattaagttgtcaaaatatactttatggttatccaatttttcgccatgcttcgaaaggttgtcatggagagaaaatttactttattgaccaagttaaaatcccatttaaaaaagaagaaagaatttatacattaaaaaaattgattgccttggctgaaaaataccctgagaaagaatttactattttgctaagggttgcagataaagatattactgtgcatcaggataaacattcgtatatagagctggcaaagcagtttcagttgccgagtaatttgacaatagagcgaaaaagtaccgcgcaagccttccaagaaatggggtattgtttatcttattcatctactatgctttttgaagctgaatgtaagggtatccctgttggtgttgttgcagacttaggcttttctaaatcctatgcaaatcagcattttttaggtagtggggttttagtttattttgatcaaatagatttcacttccccaaaaatagcagatccggattggcttgattgctatgctactaaaaaggtgattacaactgatgagtttaataagctattaaagcaggttgtgccattgcaacatgattaccaagaatatttatctgcaggaattcgatatcaagctttggctaacacacacgccattccaaccaatagttttctcggcataaagccatgctctgacgcttaa

SEQ ID NO: 4122 - DNA, 735 bp, Neisseria meningitidis
atgaacgagaaaaatataaaacacagtcaaaactttattacttcaaaacataatatagataaaataatgacaaatataagattaaatgaacatgataatatctttgaaatcggctcaggaaaagggcattttacccttgaattagtacagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatttggtaatataccttataacataagtacggatataatacgcaaaattgtttttgatagtatagctgatgagatttatttaatcgtggaatacgggtttgctaaaagattattaaatacaaaacgctcattggcattatttttaatggcagaagttgatatttctatattaagtatggttccaagagaatattttcatcctaaacctaaagtgaatagctcacttatcagattaaatagaaaaaaatcaagaatatcacacaaagataaacagaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaa

SEQ ID NO: 4123 - DNA, 678 bp, Neisseria meningitidis
atgctaaagaaaataaaaaaagctctttttcagcctaaaaagttttttcaagattcaatgtggttgacaacatctccattttatcttacccccccacgtaacaatttatttgtcatatctaatttaggtcagcttaaccaagtccaaagcctaattaaaatacaaaaattaaccaataatttactagtaattttatatacttctaaaaacttaaaaatgcctaagttagttcatcaatcagctaacaagaatctatttgaatctatttatctatttgagcttcctagaagccctaataatataactcctaaaaaattactttatatttatagaagttacaaaaaaatccttaatattatacagcctgctcatctctatatgctgtcttttacaggccactactcctatctgattagtattgcaaaaaaaaagaatattacgactcatttaattgatgaagggactggaacatatgctcctttattagaatcattttcatatcatccaacaaaattagaacgttatttgattggaaataatcttaatattaaaggatatatagatcattttgacatattgcatgtcccctttcctgaatatgctaaaaaaatatttaatgcaaaaaaatataaccggttttttgcctggcgaaagggggatgtgctgcaaggcgattaa

SEQ ID NO: 4124 - DNA, 1050 bp, Neisseria meningitidis
atgcaaaacaacaacgaatttaaaattggtaatcgttcagtaggttacaaccacgaaccattgattatctgtgaaatcggcatcaatcatgaaggctctttaaaaacagcttttgaaatggttgatgctgcctataatgcaggcgctgaagttgttaaacatcaaacacacatcgttgaagacgaaatgtctgatgaggccaaacaagtcattccaggcaatgcagatgtctctatttatgaaattatggaacgttgcgccctgaatgaagaagatgagattaaattaaaagaatacgtagagagtaagggtatgatttttatcagtactcctttctctcgtgcagctgctttacgattacaacgtatggatattccagcatataaaatcggctctggcgaatgtaataactacccattaattaaactggtggcctcttttggtaagcctattattctctctaccggcatgaattctattgaaagcatcaaaaagtcggtagaaattattcgagaagcaggggtaccttatgctttgcttcactgtaccaacatctacccaaccccttacgaagatgttcgattgggtggtatgaacgatttatctgaagcctttccagacgcaatcattggcctgtctgaccataccttagataactatgcttgcttaggagcagtagctttaggcggttcgattttagagcgtcactttactgaccgcatggatcgcccaggtccggatattgtatgctctatgaatccggatacttttaaagagctcaagcaaggcgctcatgctttaaaattggcacgcggcggcaaaaaagacacgattatcgcgggagaaaagccaactaaagatttcgcctttgcatctgtcgtagcagataaagacattaaaaaaggagaactgttgtccggagataacctatgggttaaacgcccaggcaatggagacttcagcgtcaacgaatatgaaacattatttggtaaggtcgctgcttgcaatattcgcaaaggtgctcaaatcaaaaaaactgatattgaataa

SEQ ID NO: 4125 - DNA, 687 bp, Neisseria meningitidis
atggaaaaacaaaatattgcggttatacttgcgcgccaaaactccaaaggattgccattaaaaaatctccggaaaatgaatggcatatcattacttggtcatacaattaatgctgctatatcatcaaagtgttttgaccgcataattgtttcgactgatggcgggttaattgcagaagaagctaaaaatttcggtgtcgaagtcgtcctacgccctgcagagctggcctccgatacagccagctctatttcaggtgtaatacatgctttagaaacaattggcagtaattccggcacagtaaccctattacaaccaaccagtccattacgcacaggggctcatattcgtgaagctttttctctatttgatgagaaaataaaaggatccgttgtctctgcatgcccaatggagcatcatccactaaaaaccctgcttcaaatcaataatggcgaatatgcccccatgcgccatctaagcgatttggagcagcctcgccaacaattacctcaggcatttaggcctaatggtgcaatttacattaatgatactgcttcactaattgcaaataattgtttttttatcgccccaaccaaactttatattatgtctcatcaagactctatcgatattgatactgagcttgatttacaacaggcagaaaacattcttaatcacaaggaaagctaa

SEQ ID NO: 4126 - DNA, 1134 bp, Neisseria meningitidis
atgaaaagaattctttgcattacaggtaccagagccgacttcggcaagctaaaacctttattagcctatattgaaaatcacccagaccttgaattgcatttgattgtaactggtatgcatatgatgaaaacatatggcagaacctacaaggaagtaactcgagaaaactatcaacatacatatctgttttcaaatcaaatccaaggtgaaccaatgggtgccgttttaggcaataccattacgtttatctctcgtctatctgatgaaattgaacctgatatggtcatgattcacggcgaccgtttagaagcactagcaggcgcagctgtaggtgcattaagcagccgtttagtttgccatatcgaaggtggtgaactatctggtacagtagatgactccattcgtcattctattagtaaactttctcatatccacttggtagcaaatgaacaagctgtcactcgcctagtgcaaatgggagaaaaaagaaagcatattcacatcatcggctcccccgatttagatgttatggcctcttccaccctcccatccttagaagaagtcaaagaatattacggtttaccatacgaaaattatggtatttctatgtttcaccccgtgactacagaagcacatttaatgccacaatatgcggcccaatatttcaaagcattagaattaagtggccaaaatatcattagcatctaccctaataatgacactggcactgaaagtattctgcaagaattattaaaatatcaatctgataaatttattgcatttccttccattcgatttgaatattttttagtcttattgaaacatgctaaatttatggtcggcaactcaagtgcaggtattagagaagctcctctctacggtgtcccttcaattgatgttggtacacgccaaagtaaccgccatatgggaaaatctattattcatacagattatgaaactaaaaatatctttgatgcgattcaacaagcatgcagtttaggcaaatttgaagcagatgatacctttaatggcggagatactcgcaccagcacagaaagatttgctgaagtaatcaacaatcctgaaacgtggaatgtttctgctcaaaaacgttttatcgatttgaatctttaa

SEQ ID NO: 4127 - DNA, 1176 bp, Neisseria meningitidis
gtgtttaaagtgaaattttatattcgtcacgcagtattattattgtgtggaagtttaattgtaggatgctctgcgattccttcatcaggccccagcgcaaaaaaaattgtctctttagggcaacaatctgaagttcaaattcctgaagtggagctgattgatgtgaatcatacggttgctcagttattatataaggctcagataaatcagtcattcactcagtttggcgatggttatgcttcggctggtacgctaaatattggtgatgtattggatattatgatttgggaagcgccgccggcagtattgtttggtggtggcctttcttcgatgggctcgggtagtgcgcatcaaactaagttgccagagcagttggtcacggcacgtggtacggtttctgtgccgtttgttggcgatatttcggtggtcggtaaaacgcctggtcaggttcaggaaattattaaaggccgcctgaaaaaaatggccaatcagccacaagtgatggtgcgtttggtgcagaataatgcggcgaatgtgtcggtgattcgtgctgggaatagtgtgcgtatgccgctgacggcagccggtgagcgtgtgttggatgcggtggctgcggtaggtggttcaacggcaaatgtgcaggatacgaatgtgcagctgacacgtggcaatgtagtacgaactgttgccttggaagatttagttgcaaatccgcgacaaaatattttgctgcgtcgcggtgatgtggttaccatgattaccaatccctatacctttacgtctatgggtgcggtggggagaacacaagaaatcggtttttcagccagaggcttatcgctttctgaagccattggccgtatgggcggtttgcaagatcgccgttctgatgcgcgtggtgtgtttgtgttccgctatacgccattggtggaattgccggcagaacgtcaggataaatggattgctcaaggttatggcagtgaggcagagattccaacggtatatcgtgtgaatatggctgatgcgcattcgctattttctatgcagcgctttcctgtgaagaataaagatgtattgtatgtgtcgaatgcgccgttggctgaagtgcagaaatttttgtcgtttgtgttctcgccggttaccagtggcgcgaacagtattaataatttaactaattaa

SEQ ID NO: 4128 - DNA, 1164 bp, Neisseria meningitidis
atgtctgagcaacttcctgtggcagttgccactgaaaccaaagccgagcgtaaaaagccgaaaaagaaaagttggattaaaaagctaagccctttattttgggtaacggtgattatccctacggtaatttcgttggtgtatttcggcttcttcgcttccgatcgttttacgtcgcaatcgagctttgtggtgcgctcgcctaaaagccaatcttctctcaatggcctgggtgccattttgcagggcacaggttttgcccgtgcgcaagatgatatttacacggttggggagtatatgcgttcgcgctcgtctttggatgaactgcgtaaaatcttgccggtgcgtgagttttatgaaaccaaaggtgatgcgttcagccgctttaatgggtttgggttccgtggcgaggaagaggctttttatcaatactataaaaatcaggtgatgatcaattttgatacggtttcgggtatttccacgttgaatgtaacttcctttgatgcgctggaatctaagaaaatcaatgaggctttgttaaaacaaggtgaagcattgattaaccagttgaacgatcgtgcacgtgctgatacggtgcgctatgcggaagaagtagtgaaaacggcggcagagcgggtaaaggaagcctctcagaatctgacggattaccggattgccaatggcgtttttgatttgaaagcgcaatcggaagtgcaaatggggttggtttccaagctgcaagatgaattgattgtgattcaaacccagctggatcaggtgaaagcagtcactccggagaatccgcagattccgggtttgcaggcgcgtgagcagagcttgcgtaaagaaattgaccaacagttacgtgccatttcgggcggtgggcattcttcgttgtctaatcaggctgccgaatatcagcgtgtgtatttggaaaaccagttggcagagcagcagttggcagccgccatgacttctttggaaagtgccaaggttgaagcagaccgtcagcagctttatttggaagtgatctcgcaaccgagcctgccggatttggcacatgagcctaaacggttatacaacattgttgccactctgattatcggcttgatggtttatggtattttgagcctgttgactgccagcattcgtgagcataaaaactga

SEQ ID NO: 4129 - DNA, 798 bp, Neisseria meningitidis
atgaaagccttgcataaaacatcattttgggaatctttagccattcaaaggcgcgtaatcggtgcgctgttgatgcgggaaattatcacccgttacggtcgcaataatattggctttttatggctgtttgttgagccgttgctgatgacattcgttatcgtcttgatgtggaaatttttaagggcagaccgatattcaactttgaatattgtcgcatttgcgattactggctatccgatgttgatgatgtggcgtaatgcctcaaaacgggcagttgggtcgatttcttcaaatgccagcttgctttatcaccgcaatgtaagagttttggataccatcttggcgcgcatgattttggaaattgctggtgcaaccattgcgcagattgtgattatggcggtattgattgcgattggctggattgaaatgccggcagatatgttttatatgctgatggcttggcttttgatggctttttttgcgattggtttgggtttggtgatttgttcgattgcctttaatttcgagccgtttggcaagatttggggcacattgacttttgtgatgatgccgttatccggtgcgttcttttttgtgcataatttgccgcccaaggtacaagaatatgcattaatgattccgatggtgcatggcacagaaatgttccgtgccggatattttggcagcgatgtaattacctatgaaaatccttggtatatcgtattgtgcaatctggtgttgttgttgtttggcttggcgatggtcagtaaattcagtaaaggagtcgagccgcaatga

SEQ ID NO: 4130 - DNA, 651 bp, Neisseria meningitidis
atgatttcagttgaacacgtttccaaacgctatctgacccgccaaggttggcggacagtcttgcacgatattagcttcaaaatggagaagggcgagaaaatcggtattctcggccgcaacggtgcaggtaaatcgacgctcatccgtttgatcagtggcgttgagccgccgaccacgggtgaaatcaagcggacaatgagtatttcttggcctttggcattctccggtgcgtttcaaggcagtctgaccggtatggacaatttgcgtttcatctgccggatttacaatgtcgatatcgattatgtgaaagcgtttacggaagaattttcggagctggggcaatatttgtatgagccggtgaaacgctattcttcaggtatgaaagcgcgtttggcttttgcgctgtcgttggcggtggagtttgactgttacctgattgacgaagtgattgcagttggtgactcgcgttttgccgataaatgtaagtacgagttgtttgaaaagcgcaaagaccgttccatcatcttggtgtcgcacagccacagcgccatgaagcaatattgcgataatgcgatggtgctggaaaaagggcatatgtaccagtttgaagatatggacaaagcctacgaatattataattcgctgccttaa

SEQ ID NO: 4131 - DNA, 2274 bp, Neisseria meningitidis
atgaacattactcaaattctttcccaagaactctccgcgactgccgcgcaaatcaccgccgccgtcgagcttttggacgacggcgcgaccgtgccgtttatcgcccgctaccgcaaggaagcgacgggcgggttggacgatacgcagttgcgccggcttgccgagcggctgcaatatctgcgcgagttggaagagcgcaaagccgttgttttaaaaagcattgaagagcaaggcaagctttcagacgacctcagggcgcaaatcgaagccgccgataacaaaaccgcgctggaagacctgtatctgccctacaaacccaaacgccgcaccaaagcgcaaatcgcgcgcgaacacggtttgcagccgctggcggacgtgttgcttgccgagcagtcgcaggacgtggaagccgccgcacaaggctacctgaacgaaaacgtccccgatgccaaagccgcgttggacggcgcgcgtgcgattctgatggagcagtttgccgaagacgcggaacttatcggcacgctgcgcgacaagctgtggaacgaagccgaaatccacgcgcaagtcgttgaaggcaaagaaaccgaaggcgaaaaattcagcgattatttcgaccaccgcgaacccgtccgcactatgcccagccaccgcgcgctggcggttttgcgcggccgcaacgaaggcgtgttgaacatcgcgctcaaataccagcccgacgacacgccgattacccggcaaagcgaatacgagcaaatcatcgcctgccgcttcaaggtttcagacggccacaaatggctgcgcgataccgtgcgtctgacttggcgcgcgaaaatctttttgtcgttggaacttgaagccctaggccgtctgaaagaagccgccgacaccgacgcgattaccgtgttcgcccgcaatctcaaagacttgctgctcgtcgcgcccgccggacggctgaccacgctgggtctcgaccccggctaccgcaacggcgtgaaatgcgccgtggtggacgacaccggcaagctgctggataccgtcatcgtctatttgcatcaagaaaacaatatgttggcaacgctgtcgcgcctgattaagcaacacggcgtgaagctcatcgccatcggcaacggcaccgccagccgcgaaaccgacaaaatcgcgggcgaactggtgcgcggaatgccggaaatggggctgcacaaaatcgtcgtgtccgaagccggcgcgtcgatttattccgcgtccgaactggcggcgcgcgagttccccgacttggacgtttccctgcgcggcgcggtgtccatcgcccgcaggctgcaagacccgcttgccgagttggtcaaaatcgaccctaaatccatcggcgtgggccagtatcagcacgatgtgaaccaaaaccagctcgccaaatcgctggacgcagtggtcgaagactgcgtgaacgccgtcggcgtggacgtgaataccgcctccgccccgctcttggcgcggatttccggcttgaatcaaacccttgcccaaaacatcgttgcctaccgcgatgaaaacggcgcgttcgacagccgcaaaaaattgctgaaagtaccgcgtttgggcgaaaaaaccttcgagcaggcggcaggctttttgcggattaacggcggtaaagagccgttggacgcgagcgccgtccaccccgaagcctatcccgtcgtcgccaaaatgctggcgcaacaaggcattagcgccgccgaactcatcggcaaccgcgagcgcgtgaagcaaatcaaagcgtccgacttcaccgacgaacgcttcggcctgccgaccattttggacatcctgtccgaactggaaaaacccggccgtgatccgcgcggcgagtttcagacggcatcgtttgccgaaggtatccacgaaatcagcgacttgcaagtcggtatgatactcgaaggcgtggtttccaacgtcgccaacttcggcgcgttcgtggacatcggcgtccatcaggacggcttggtgcacatctccgccctgtccaacaagttcgtccaagacccgcgcgaagtggtgaaagctggcgacgtggtgaaagtgaaagtgctggaagtcgatgctgcacgcaaacgcatcgcgctgaccatgcgcttggatgacgaaccgggcggcgcaaaacataaaatgccgtctgaaaaccgcagccgcgaacggacagccggccgcaaaccccaacgcaacgaccgcgccccagccaattcggcgatggcggatgcgtttgcgaagctgaagcggtaa

SEQ ID NO: 4132 - DNA, 1003 bp, Neisseria meningitidis
atgcacacaccacttacctatattgaccttttctcaggagcaggaggcctatccttgggttttgaacaagccggattccaacaattgctttctgttgaaatggagtctgattattgtcagacttaccgtaccaacttcccccatcatcaattactgcaaaaagatttaaccacactaaccgaacaagatttaatcaattgtcttaacggacaagcagttgatttgattattggaggaccaccttgtcaaggttttagtatggcaggaaagattggacggacatttacagatgacccacgcaaccatttatttaaagagtttgtccgaatagttaaaattgtccaaccatatttttttgttatggaaaatgtagcgcgactctatacacacaattcaggtaaaacacgtattgagattattcaagcatttcagaatatcggttattcggtggaatgtaagatactgagtgcagccgatttcggtgttcctcagatacgtagccgagtgatatttatcgggaggagggataaaggcaaaatttcctttcccgaacctttgcagatttcccatcagactgttggatcagcaataggacattttccaaaactggctgctggcgaaagcaatccacacgttgcaaatcatgaagctatgaatcattcggcacaaatgttagaaaaaatggcatttgttaaaaatggaggtaaccgtaacgatattcctgaaccattacgtccgaaaacaggtgatatccgtaaatacatccgttacaacagcaacaaaaccagccgtttgtattacaggagatatgcgcaaagtttttcactatgaacagaatcgggcgttaaccgttcgtgaattagctgccttacaatctttccctgataattttattttttgcggcagcaaaattgcccagcagcagcaggttggtaacgccgtaccgcctttattggcaaaagctattgctgaaagtattttaaaaatgagtgaaaatgaataa

SEQ ID NO: 4133 - DNA, 351 bp, Neisseria meningitidis
gtgaaaatgaataagcaatatccgaaaattaactatatcggtaataaagagaaaatagcttcctggatttgtgaccagcttccgtctgatgtagatacagttgcagatgtatttagtggaggctgttcctttgcctacgaagccaaaaaacgcggctatcgtgtgattactaacgatattttggcaattaattaccaaattgctttagcattaatagaaaacaaccatgaaacattaaatgacgatgatgtcgcaatgattttttcaggcagcccgcatgccggttttatgagtcagcgttatgccgaaaaattctattttcacgatgaataccaacaacttgatttgtaa

SEQ ID NO: 4134 - DNA, 657 bp, Neisseria meningitidis
ttggcgtttactttaatgcgtcgcgccatgatacgtaaaatgccctatacggaagatatgcgcccaggcgataccgctaatccttatggtgcgtccaaagcgatggtggaacggatgttaaccgacatccaaaaagccgatccgcgctggagcatgattttgttgcgttatttcaatccgattggcgcgcatgaaagcggcttgattggcgagcagccaaacggcatcccgaataatttgttgccttatatctgccaagtggcggcaggcaaactgccgcaattggcggtatttggcgatgactaccctacccccgacggcacggggatgcgtgactatattcatgtgatggatttggcagaaggccatgtcgcggctatgcaggcaaaaagtaatgtagcaggcacgcatttgctgaacttaggctccggccgcgcttcttcggtgttggaaatcatccgcgcatttgaagcagcttcgggtttgacgattccgtatgaagtcaaaccgcgccgtgccggtgatttggcgtgcttctatgccgacccttcctatacaaaggcgcaaatcggctggcaaacccagcgtgatttaacccaaatgatggaagactcatggcgctgggtgagtaataatccgaatggctacgacgattaa

SEQ ID NO: 4135 - DNA, 1068 bp, Neisseria meningitidis; identical to SEQ ID NO: 4119

SEQ ID NO: 4136 - DNA, 867 bp, Neisseria meningitidis; identical to SEQ ID NO: 4118

SEQ ID NO: 4137 - DNA, 555 bp, Neisseria meningitidis
atgaaagataaaaagatgaacatcattgataccgccattcctgacgtaaaactgcttgagccccaagtcttcggcgacgcgcgcggcttttttatggaaaccttccgcgacgagtggtttaaaacccaagtctgcgaacgcaccttcgtgcaggaaaaccactccaaatccggcaaaggcgtattgcgcggcctgcactatcaaactgaaaacacacaaggcaaactcgtacgcgtggttgtcggcgaagtattcgacgtggccgtcgatatgcgtaaagactcccccactttcggcaaatgggtaggcgaaattctgtccgcagaaaacaaacgccaactgtgggtacccgaaggtttcgcacacggcttctatgtactgagcgatgaagccgagttcgtctataaatgcacagactattacaaccccaaagccgaacactcgctgatttggaatgatccgaccgtcggcatcgactggccgttgcaaggcgagccgaacctgtcgcctaaagacttggcaggcaaagtattgtctgaagcggtaacgttttaa

SEQ ID NO: 4138 - DNA, 2115 bp, Neisseria meningitidis
atgttcctcttttcagacggcctacaatccattaataacaataatcgacgaaaacgcattgtgaaaaacgcctacatcccctctcgcggcatccgcaaaatcccccatctctccaccctattgcctgaatttcatatctgcaaagacgggaaagaagcagaggctgttgtcggctggggtttgcgcccgacgacacacaaagcgcgtgcttttgccgctgaacaccagcttccctttattgctttggaagacggctttttacgatcgctcggactgggtgtcgccggttatccgccctactctatcgtctatgacgacatcggcatctactacgacaccacacgtccttcgcgtttggaacaactgattcttgccgccgataccatgccgtctgaaaccttggctcaggcgcagcaggcgatggatttcatcctgcaacaccacctgtccaaatacaaccacgcgcccgaactttcagacgaccatcctttacgttccccatccaaacccgaaaccgtcctcatcatcgaccaaaccttcggcgatatggccatccaatatggcggcgcagacgcctctacgtttgaactgatgtttcagacggccttaaatgaaaacccgcaagccgatatctgggtaaaaacccatcccgatgttttgtgcggcaaaaaacaaggctatctgacccaactggcgcagcaacaccgcgtccatcttttggcagaagacatcaatccgatttctttgttgcaaaacgttgataaagtttattgcgttacctcgcaaatgggttttgaggcgcttttgtgcggcaaaccgctgaccactttcggcctgccgtggtatgccggatggggtgtaagcgacgaccgccatcctgaaatcaaccgccttgttcaaacccaacgccgcgccacccgcaacttgctgcagctcttcgccgcagcctatctgcaatacagccgctacctcaaccccaataccggcgaagcaggcagcctctttgatgtcatcgactatctggcgacggtcaaacgtaaaaacgacaaattgcgtggcgagttatattgcgtcggtatgtctttgtggaaacgcgcggttgccaaaccgttctttaacgtaccctcttgccgtctgaaatttatctcttccacccaaaaactggcaagggtcaaactgtccgacgatgcacgcatcctggcttggggcaacggcaaagaggccatcgtccgctttgccgaacaacaccacatccccctgctgcgcatggaagacggctttatccgctcggtcggactcggctccaacttagtgccgccgctgtcgctcgttaccgacgatatgagcatttatttcaatgccgaaaccccgtcccgtcttgaatacatcctacaaaaccaaaacttcgacgatcaagactttcagacggccttgaagctgcaaaaaatgctgaccgaaaaccacatcagtaaatacaacgtcggcagctcagacttcaccgccccgtcaaccgacaaaaccgtgatcctcgttcccggccaggttgaagatgatgcgtctatccgctacggttcgccccaaatctaccgcaatctggatttgctccgtaccgtacgcgaacgaaaccccaatgcctatatcatctacaaaccgcatcccgatgtagtcagcggtaaccgcatcggccatatttcccctgaagatgctgcacgatatgccgaccaaaccgccgaacaagccgacatcctgacctgtctccaatacgcagacgaaatacataccatgacttcgctgaccggttttgaagccttgttgcgcggcaaaaaagtcagctgctacggcctgcctttttacgcaggctgggggcttacccaagatctgctccccatcccgcgccgtagccgcagacttgagctttggcagctgattgccggcacgctcatccactatcccgactacatccaccccgaaacccatcaggccataaatgcagaaaccgcagcccaaatcctgatacgacaaaaaaatatgcaaaaaaacaacaacggattacatcgcgggtgctttgccaaaaaattaggtaaaatcaaacaactatatcgatctttcaaataa

SEQ ID NO: 4139 - DNA, 1260 bp, Neisseria meningitidis
atgaaacagaccgtcctcaaaaataacctgcaaaacctgcttgaaagcgcagaaaatatcctgctgcttcaaggccctgtcggcgatttttttctgcgccttgccgactggctgactgcaaacggcaaaaccgtacataaattcaactttaatgcaggcgacgactatttttatccgcccactcaagcgcataccgttgtttttaacgacaactacgatgcctttcctgagtttttgcaagaatacatcactcaacatcacatccaggccgttgtctgctttggcgacacacgcccttatcacgtcattgcaaaacgcattgcaaacgaaaaccaagccagtttctgggcgtttgaagaaggctatttccgcccctactacatcaccttagaaaaagacggcgtcaacgcattttccccgttgccgcgccgtgccgacttttttcttgaacaattccctaagcttgcccagcaagaatataaagcgccaacgccggtacacggcggttttacgcccatggcaaaaaacgctatccgttactatatcgagttgttccgcaatccacgcaaataccccgactacatccaccaccgcgcacccaatgccggccattacctcaaaccgtggtcgctctccatcctcaagcgtttgaactactatattgaagacatccaaatcgccaaacgtgtggaagcaggcaaatacggcaagttttttattgttcccttacaggtattcaacgacagccaagtccgtatccattgcgactttcccagcgtccgcagcttcctgctccatgttttgagttcatttgccgagcacgcgcctgccgataccaacatcatcatcaagcatcatccgatggaccgcggttttatcgactactggcgcgacattaaacgctttatcaaagaacaccccgaactcaaaggccgtgtgatttatgtccatgatgtccccctgcccgttttcctgcgccacggtctcggcatggtcaccatcaacagcaccagcggcctgtccggactgattcacaatatgccagttaaggttctcggccgtgcctattatgatattcccggcattactgaccaaaataccttggcagaattttggaatcatccgacaccgcctgacaaagagctgttccatgcctaccgaatgtaccacctcaacgtgacccaaattaacggcaacttctacagtcaggtgtttttccccaacaaaaaaacctccaactcttccacaccagtaatctga

SEQ ID NO: 4140 - DNA, 1406 bp, Neisseria meningitidis
atgaccgccgctcctgatatcctctaccggcaagccgccgcccttttggaacaatccaataccgcccaagccctgcccctgttgcaacaggcggcagagcaaggttatgcggaagctgctttcgtattgggcaaccatctgctgcaaaacggccaaccggagcaggcactttcatggttggaagccgccgcggcccaacgccatcccaaagcactcttctccctgctgcaacaacgcgaacacaacggcaccccgaccggacagcttctcaacgactatgcctggctgggtgagcaggggcactcagaagcccaattaatcctcatgcgttaccacgcgcaacgcaacgatccacaatcgctctactgggcggaacttgctgccgcccgatatgccgcacctgcgtattaccatctggcacgccatcatcaacgccaaggcgacgttgaaacagccatcgaacaatacgaaaaagcggcagcactcggcgtaactgccgcctgctggcaacttggtcaaatctacttctacggtacaggtgtcagccccaaccacgcacaagccgaacactatctcgaaccagccgcacaagccggccacatcgccgcacaaacgctgctggctgaccttcttgccgcccaacgcaaacctgaagccttggaatggtatcgtcgtgccgccgataaggaacaagcggaagcacagtctaagctggcccaatacgccctgaccggcgaactttccgaacgcgatccgttccaagcggcacgatatgccaaagccgctgccgagaaaaaccatcctgaagccctgaaaatcatgggcgacctctaccgctacggtctcggtatcaaagccgacaaccatatcgcgcaagattactaccaccgtgccgccgcgctgggttctgccgccgcagcacaaaaactcatcagcgacgccgcgctgtaccatccgcaacaatacgaacaaatcaaaactgccgcctgcaacaacaacaaaccgaaaccatctaccgtttggcggaagcacaagcctgcgccatcggccgtcccgccgactacaatgccgcgcgaaaaaattacatggaagctgccgggttccaccataaaaacgcagcggcagccttaggccgcatctaccattacggcctcggtacggcgcaagatcctcgggcggctgcacactggtacgccattgctgccgaacaaaaccacccttccgcccaataccacctcgcctgtttttactatcacgggcaaggtgtcggctgtcatgttccgaccgcctgctactggctgcaggccgccatcggcaacggccacacttcggccgaatcattaatatccctattagaacaatggcgacgcgaagcacaccatgccatcggacaaaaggccgtctga

SEQ ID NO: 4141 - DNA, 1215 bp, Neisseria meningitidis
atggaatgggaattcaacagttattacacactgattgccgccacgctcgtgttgctggttggtaaatttctggttcaaaaaatcaaattcttacgagacttcaatattcccgagccggtagccggcggtttgattgccgctatcgtcctgttcgccctgcacgaggcgtacggcgtgagcttcaaatttgagaaaccgctgcaaaatgcgtttatgctgatttttttcacgtccatcggcttgagcgcggatttttcccgtttgaaggcgggcggtttgccgctggtggtttttaccgcgattgtgggcggatttatcttggtgcaaaactttgtcggggtcggactggctacggctttgggtttggatccgctcatcggtctgattaccggttcggtgtcgctgacgggcggacacggtacgtcaggtgcgtggggacctaattttgaaacgcaatacggcttggtcggcgcaaccggtttgggtattgcatcggctactttcgggctggtgttcggcggcctgatcggcgggccggttgcgcgccgcctgatcaacaaaatgggccgcaaaccggttgaaaacaaaaaacaggatcaggacgacaacgcggacgacgtgttcgagcaggcaaaacgcacccgcctgattacggcggaatctgccgttgaaacgcttgccatgtttgccgcgtgtttggcgtttgccgagattatggacggcttcgacaaagaatatctgttcgacctgcccaaattcgtgtggtgtctgtttggcggcgtggtcatccgcaacatcctcactgccgcattcaaggtcaatatgttcgaccgcgccatcgatgtgttcggcaatgcttcgctttcgcttttcttggcaatggcgttgctgaatttgaaactgtgggagctgaccggtttggcggggcctgtaaccgtgattcttgccgtacaaaccgtggtgatggttttgtacgcgacttttgttacctatgtctttatggggcgcgactatgatgcggcagtattggctgccggccattgcggtttcggcttgggtgcaacgccgacggcggtggcaaatatgcagtccgtcacgcatactttcggcgcgtcgcataaggcgtttttgattgtgcctatggtcggcgcgttcttcgtcgatttgattaatgccgcgattctcaccggttttgtgaatttctttaaaggctga

SEQ ID NO: 4142 - DNA, 1017 bp, Neisseria meningitidis; identical to SEQ ID NO: 683

SEQ ID NO: 4143 - DNA, 198 bp, Neisseria meningitidis
atgaataccgtcccaaaaagcaggattcccgtcaaaccgctgcccgaaaaaaccacagacgaagccaaagtcgaaaaatggcggcagctcggtgcggaacacggtttgtcgggcgaatgggcagttgccgtcagattgggcgaaaacggttttaccgaagaacagatggaaaatatcgccaacctgttcggcagataa

SEQ ID NO: 4144 - DNA, 1401 bp, Neisseria meningitidis; identical to SEQ ID NO: 3969

SEQ ID NO: 4145 - DNA, 1473 bp, Neisseria meningitidis
atgaaccagacaagccgcgatctgacccgcatcagccacaacactaaaatcgtcgccacccttgggccgggcagcaacaacgtcgaactgttggaagacatgatccgcgtcggcggtctgaacgtcgtccgcttcaacttcagccacggcacgcccgaattccatcaggaaaacgccctcatcgtgcgcgaggcggcaaaacgcgccggacaggaaatcgccatcattgccgacctgcagggcccgaaaatccgcgtgggcaaaatcgccggcggcggcatcgaattgaacaaaggcgaaacgctggtactggatgccgcgctcgaaggcgaaggcacgcgcgaggcggtcggtttggactaccgcgacctgcccgacgacgttgccgcaggcgatgtcttgtggctggacgacggcctgctgaccctgaccgtggaatccgtcgaaggcagcaggattatcacaagggtggaaaacagccacgtcctgaaaagcaacaagggcatcaacaaacgcggtggcggtctgtccgcaggcgcgttgaccgaaaaagacttccgcgacctgaaaaccgcgattgccatcggttgcgactacctcgccatcagctttgtgaaatccgccgaagatttgcatatcgcgcgcgccaaagtcgaagaagaaatgaagggcagcacggccgtgcgccccggtttggtttccaaaatcgaacgcgtggaagcgattgaaaacttggacgaaatcatcctcgccggcgacggcattatggttgcgcgcggcgacttggcggtcgaagtcggacacgccgccgtccccgccctgcaaaaacggatgatccgccgcgcccgcgagttgcgccgcttcagcattacggcgacgcaaatgatggaatcgatgattaccaaccccgtaccgacccgcgcggaagtcagcgatgtggcaaacgcggtattggacggtaccgatgcggtgatgtgttccgccgaaaccgccgtcggcgcgtatccgtttgaaaccgtcagccaaatggcgattatctgcgcggctgcggaaaaagagcaggattcgctcaacggcgttgccgaacaggtcgagtatcccgaagcggtcagcaccaacctggcggttgccggcggtgcggtcagcgtggcgcgcgcggttcacgccaaagccatcgtcgccctgaccgaaagcggttcgaccgcctttgaaatcagccgccacaacatcaccctgccgattttcgcgctgaccccgagcgtttccgcccaacgccgtatggcgatgtaccggggcgtgcgcccgctgattttggcaaccagtaccgaccacgacacggcgttaaacgaagtcgaaacgatgctggtggaacacaacatcctgcattccggcgaccaatacatcattaccagcggttcgcaaatgcgcgaatccggttcgaccaacacactggaagtgctgcgcgtcaaataa

SEQ ID NO: 4146 - DNA, 644 bp, Neisseria meningitidis
atgagaaaaagtcgtctaagccggtataaacaaaataaactcattgagctatttgtcgcaggtgtaactgcaagaacagcagcagagttagtaggcgttaataaaaataccgcagcctattattttcatcgtttacgatgacttaatttatcaaaacagcccacatttagaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaaccaggcaaaacgtcatttacgcaagtctaacggcattcccaaagcgcattttgagctgtatttaaaggagtgcgaacgacgttttaacaacagtgagataaaagttcttgttccattttaa

SEQ ID NO: 4147 - DNA, 237 bp, Neisseria meningitidis
atgaaagagttacacacctctgaattagttgaagtgtcaggtggcaaattccatatctttgcacagggtggcggcaacctaggtaaaaaagatatggttgctgttggtaaaattggtgcttcctattcccctaacaatagtggagtagagttttctgttagcaagcaatttggatatgtacaaggtcttggtgtacagttttcgaaacctacttttggtattagtaaaaaatggtaa

SEQ ID NO: 4148 - DNA, 228 bp, Neisseria meningitidis
atggtaagattttttgttttatcctttctgacattaataaatctatgctcattaagcgcatgcaatagccactttacaggaaatatcaatccattaggtactcacaataaagttgctaatcccaattgtgccaatagtgccaatagtcatatcagacaacccagtaggaaaaactatgatccaactgaatatagtgcttggttacagtatatgcatgattgcaaataa

SEQ ID NO: 4149 - DNA, 87 bp, Neisseria meningitidis
atgagtaacgatgaaaatttacttttttctcaaccacacttaacaaaggtgaatattatgcaagttttgactttgaatgaaatttaa

SEQ ID NO: 4150 - DNA, 189 bp, Neisseria meningitidis
atgaaaaaatatagtgattattttaaatatttaatcttttttttgattttactcccaacaaattatctcgtatctcattatgtggtacaaacctcaatgagtatgttaagcattttaagttcttctataataacaacttgccttttttttgtttttacaaatttatcccaatcaaagaaacataaataa

SEQ ID NO: 4151 - DNA, 153 bp, Neisseria meningitidis
atgtctaacaatcactcatttttcagaccagaagtctttgtagctcaacggaacaagtggacaggaccagtaggctgggttgacgcaatgggagctggtattttctctgttgctggcggatacaatatcggtcgtggcatgatgaagccataa

SEQ ID NO: 4152 - DNA, 171 bp, Neisseria meningitidis
atgaatactgaaaccatttacgccactgtcttttgcattttagctgcaaccatttctggattattggttaaatttaatgtaattaaaatagaaacatcaatcaatagcaaatttatgttattaggcataagtattttaattattggtatttttctatccatttttttttaa

SEQ ID NO: 4153 - DNA, 1488 bp, Neisseria meningitidis
atgtcccacttattccgaaaagaagtctttgtagcccaacaaaataagtggacaggtcaggttatcttgacccgtccattctcttttttatttctgactttttgcgcttttctcattgctctgtgtatcattatctttttgatttttggtagctataccaataaaacaaccgttgaaggtcaattacttccaactatgggggtggttcgtgtttactcttccgatatcggcacgattacgcataaatttgttgaagatggtaactttgtcaaagctggcgaaccattgttcaaactttccacatcgcgttttggcgaaaaaggaaacgtacaagccaaattggcagcagaagccaaccttaaaaaaactttggcattacaagaattggaacgtttaaagcgcattcatcaaaatgagcaaaaaaatgttcataacaacattcatcgtttaaacaatcaattagagaatattaaacagcaaattacagggcaaaatcgtcaaattcgtttagcggaaaaaacccttaacaagaacaagtttttagccagtcaaggcgcagtatcccaacaagataagatgaccgccgaaagccatttattggaacaacgctcacgtttggagagcctaaaacgtgaacaaaataatgcaatcagggaacttgatgaacagaaaatcacattaagcagcctgcctgaacgccataaaaccgaattgagccaactcaaccgtgcgattacggaaatgaaccaagaaattttggattttgatttgaaatccgaacaaaccatacgagctagtaaatcaggttgagacctttgcaaaaataatctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaggttatatatcaacaattaatgttgatatagggcaacaagttgaaccgtctaaattgctgttaagcattgtccctgaacaaactgaattggtcgccaatctttacatacccagtaaagctgttggttttattaaaccgaaagataaagttgttttacgttaccaagcgtacccttaccaaaaatttggacatgccacaggagaaattatttcagttgccagaactgctctcggtaaacaaaagctatcaggtttaggtatcattttcactaacccaaccttattaaatgaacctgcctatcttgtgaaagttaaattggaaaaacaaacgattaaagcatacggagaaaacaagccgcttcaaattggcatgattttagaagcagatattctccatgaacgaaaaaattgtacgaatgggtacttgacccactttacagcatttcaggaaaaatcaattaaaaatggattatttatcaagactgtcctttggatttaa

SEQ ID NO: 4154 - DNA, 2087 bp, Neisseria meningitidis
atggattatttatcaagactgtcctttggatttaacaaaaagctacctgtcattctgcaaacagaagttgctgaatgtggtttagcatgcctgacatccatcttgtcctattatggctttcacactgatttaagaacgttacgccaaaaatacaccctgtcattaaagggcgcaaatcttgcagacatcatgagatttggcaatgaaatgaatttaacgccacgagctttgcgtttagagttagatgagctgtcaaatttacaactaccctgcattctccattggaacttaaaccattttgttgtactttgttccatttccaaagacagtatcgtcattatggaccctgctgtcggtatgcgaaaaatcaaaatggacgaagtttcacaaaaattcacagggattgccctagaattattccccaatacccattttgaagagaaaaaagaaacaaagaaaatcaaaatattatctctattaagggggggtcaggcttaaaacgctctttaattcaaatgcttatattagctatttctttggaagtctttgcattggttagtccattctttatgcaatgggtaatagaccatgtcattgtaactgctgataaaaatttattattgacccttactttgggatttggtttactgactatcctgcaacagttaattagcctgttacaagcatgggtaggtatgcacctatctacaactcttaatttacaatggaaagccaatatatttaaaaggttacttgacttacctaatgactatttcagtaaacgacatttaggagatgtgatttcaagatttggttcaatagatcatatccaagaaacactaacttctactttttttgttttagttttaaatagcttaatggctgtttttactttcgtgttaatgacaatttacagcactcaattatcgctgattgttcttttaacacttgttttgtacatactaattcgttggcttgcatattacccattaagaaatgcaacagaagaaaatattgttcatgaagccaaacaaaactcatatttcatggaaaccattcgtggtatccaatcagttaaattatttgataaacattatcaaagacatggcacttggatgagcctatttgtgaatacagtcaataccaagctgacaacagataaactctctgctttatttgaattttcaaataaactgttgtttagcatggaaaatgttatcataatttatcttggtgcaagcgcaattttagatggttcatttacagtcggtgttctgatggcttttttggcttataaagggcaatttgaaagcagaacagcttctctcgttgaccaatacatccaaatcaaaatgttagggcttcatgctgaacgtttggctgacattactttaaatgaaacagaaactgaaattattaagtataatcatatacctaaattagataatgaacaactggttcttaaagttgaaaacgtctcattcagatatgctgataatgagccatatctttttgaaaacattaatttggaatttaaagataatgaagcagttgttttaacaggacaatctggtcgggggaagtccactttgttaaacattttaacaggtagcctaaaacctgaaactggtacagttagtattaatgggcatgatatatatcaagtttctccatcctttattaggggattgagcgggattgttcgccaagatgatgtcctttttgcaggttctattggggaaaatatttcattttttgatgaaagcccaaatatggagctcattgaacaatgtgcaaaaatggcacaaatacatgacgatatacttaaaatgccaatgggctatgagaccttgattggcgatatgggaaatatcttatcaggtggacaaaagcagagagttatcttggctcgtgcattgtataaacgacccaaaattctatttttagacgaagcaagtagccatttagatgtagaaaatgaacaaaaaattaaccataacctaaaaagtcttggtattatgaaaataatggttgcacaccgccaagaaacaattcaatcggcagataaaattctgaatttaggttga

SEQ ID NO: 4155 - DNA, 144 bp, Neisseria meningitidis
atggaatgggctgaaaatgagaccgtgaaattagcccaaaaatgggaacaagagcagaaaaaacaacaaattcaacagaaaaaggaaactgaaaaatcgccaaaacacaaagccagtcgtgatgattgggaaatggaacgttaa

SEQ ID NO: 4156 - DNA, 147 bp, Neisseria meningitidis
atgaagtttgtgaaaagtgggagaaatcctttaaagaaaatggaaaagaaattgaatataatcaaaaatattcaagaatttatggtgaagttcgtggagctggctttaatggcgatatcggagaaaagctacatcgttgtgccgtga

SEQ ID NO: 4157 - DNA, 643 bp, Neisseria meningitidis
atgagaaaaagtcgtctaagccagtataaacaaaataaactcattgaactgtttgtcacaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaatcaggcaaaacgtcatttacgcaagtttaacggcattcccaaagcgcattttgagctgtatttaaaggagtgcgaatggcgttttaacaacagtgagataaaagttcttgttccattttaa

SEQ ID NO: 4158 - DNA, 519 bp, Neisseria meningitidis
atgtggcgggttttgagtgctttgccgataggcgtggtgttttttgatttgatctacggttttgtgttgaatgtgttgcagggtttggatttgcagcgtgccgtgccggattcggaaggcgtgttggcggttacgcccgatattgcattcaacagtttgcagattgtcgccaacggcggtatggcggcggtggtctgtttcgggttggcggttgtgtttttgctcaaccgttcggtgcggcggcggcaggtgttggaaatcggggtgttccggatgttggggctggtggcggtattggcgttcagcgcgccgtcggtgtgggagtgggcgaacgcgctgccgctgctgctgaagggcgcggacgtggtcaatacggggaatgcgcgttatgtgctgacggctttgtgtatgccctttccggcggtgtcgtgcgtcatcgggctggtggggcggttcaggcttcagacggcatcgggcagggcggcaaagtcagggggtgcgggcaaggcggacggatag

SEQ ID NO: 4159 - DNA, 495 bp, Neisseria meningitidis
ttggatttttcttgcggcgcggcttcgattgccacgttactgaataatttttatggcagacattattctgaagcggaaatcttagacaaaatggataaaacccaaatgcgtgcttcttttgacgatatgcaacgcataatgcccgaactgggttttgaagcacaaggttatgctttgccatttgaacagttggtacaactaaaaattcctgtaattgtgtatttaaaataccgtaaaaacaaccatttttcggtattgaacggtattaacggagaaactgttttgctggctgatccatcgctggggcacgtctcaatgagcaaatcacaattcttgagcgcatggaaaacacgtgatggcgaaatggaaggaaaaattttagccatcgtgccaaaaaatactgattttgttagaaatcagatgttttttaataagaatcccgttcgtcaaacacgttttacggtagaacaaatccaaatgcggcaaaaacgataa

SEQ ID NO: 4160 - DNA, 675 bp, Neisseria meningitidis
atgctcgctatttattctatcaatattttgatttataatgaaaaaagttttttcagagtgactctttactttgtaaaaaactttgtatcattctcaaaacctagaaaatcaaacgaaatgatgcaaaaacacaaatgtctaatagattttattttgactgttgccagccaaattgcttatgctgacttacctttaagtttggaagaattattgactgacaagggtaaattcaaactagaaagcagtattagctacatcaacactgaacgcaatcaaagcgaatttgctaatcctatttatgtgcaaaccagcgcaacgaaaattgcaactgtaatggctatgatgattacacctgtaatggcgcaaaatttagacagccaagtttttgacagccaaaatgtgaaagcaattcaattatcacaggctgaaatgaaagaaacacaaggtgaatttgttcccattattgcagccgctgcttttggcggtgcattaggtgcatgggggtatcatggtgctaatttgtataatcatggtaaattaggaactgcgcaaggcgcggctactgcgacaggaatcggtgcggcaacaggagtagcggcaaaacagggctggctgctgctgccggaggcggattggctgggaatttggcatggagaccgggtattcatgcactag

SEQ ID NO: 4161 - DNA, 843 bp, Neisseria meningitidis
atgttagtctgcaacccctacgaagtcgtcatccacggcacaacgagttccggcaagattttccgtcccagcgactgggcggaacgcctgtgcggcattctgtcctcgttcaccaaagaccacaggctttcctattcgaaatgggtgcgccccatactggtggacaacatccgctgcgtcgccgtcgataaaaaactggaaaccgacaatccccaaatgttccgcttcctgatggactttgccgccgacaacgacctgcgcgtcatcgactgcaaagccctgctcgaagaacgcgaacagggcggacaaaacaaccctgccgacgaacacgtcatgctggcacaggcaatcgaagaaaaacacgccgccgagaaagcacaggaacagaccgcctcgggcgcatcctacgttttgcgcgaaatcggcgcggacgacaccgccaccgcctttgcagccttgagcgttttgcgttccgccctgaccgacatcaaccgctttaccgaacagatcaacaaagtccaacgcccccaaggctaccgcctgctgggtatttttgaagaaggcaaacacaatgccgtcgccgtctgcggcttccgcgaagcctgcaccctcgccagcggccgccacatccacatcgatgacatcgttaccctgccgcaaagccgccgcaaaggctacgcctcgcgccttttggaagaagtccgcaaaatcggcgcggaaacaggggtaaccaaaatccacctcaacgtccacgtcaaccacgaccgtgccgacgcgcaccgcctgtatttcaaaaacggttttgaaatctgcgcataccacttccgttgcgaccccaaatga

SEQ ID NO: 4162 - DNA, 921 bp, Neisseria meningitidis
atgcctaatccgctttacagacagcatatcatctccatttcggatttgtcgcgcgaacagttggaatgcctgcttcagacggcattgaagctgaaggcgcatccgcgcggcgacctgttggaaggcaaacttatcggttcgtgctttttcgagccgtccacgcgcacgaggctgtcgtttgaaacggcggtgcagcgtttgggcggcaaggtcatcggtttctcggacggcgcgaataccagtgccaaaaaaggcgagacgcttgccgataccgcccgcatcatttccggatatactgatgctatcatccaacgccaccccaaagacggcgcggcgcgcgtggcagcggagttttcgcgcgtccccgttatcaacgccggcgacggcacgaaccagcaccccagtcagacgctgctcgacctggttaccatttatgaaacacagggacgtttggacaagctcaaaatcgccatggcgggcgacttgaaatacggacgtaccgtgcattcgctttgtcaggcgttgaaacgctggaattgtgaatttgcctttgtttcgccgcccagcctagccatgcccgactatattaccgaagagttggacgaagccggctgccgataccgtatcctcggtagtttggaagaagcggcggaatgggcggatatcctgtatatgacccgcgtccagcgcgaacgtttcgacgaacaggaatttgccaaaatccaaggcaaattcaacctcgaagcgtctatgctcgcccgcgccaaaccgaacctgcgcgtgctgcaccccctgccgcgcgtggacgaaatccatcccgatgtcgatgccacgccgcacgcctattatttcgagcaggcgaccaacggcgtttatgcgcgtatggcgatattgtcgctggtgttgaacgaagaagtgtga

SEQ ID NO: 4163 - DNA, 459 bp, Neisseria meningitidis
atggaaaccccgaaactcagtgtcgaagccattgaaaaaggtacggttatcgaccatattcccgccggcagggggctgaccatcctgcgccagttcaaacttttgcactacggcaacgcggtaaccgtgggcttcaacctgcccagcaaaacccaaggcagcaaagacatcatcaaaatcaaaggcgtgtgcttggacgacaaagccgccgaccgcctcgccctgttcgcccccgaagcggtggtcaacaccatcgacaatttcaaggtcgtgcagaagcggcatttgaacctgcccgacgaaatcgccgaagtgttccgctgtccgaacacgaattgcgccggccacggcgagccggtcaaaagccggttttatgttaaaaagcacaacgggcagacgcggctgaaatgccactactgcgaaaaaacctacagccgggattcggtggcggaagcctga

SEQ ID NO: 4164 - DNA, 666 bp, Neisseria meningitidis; identical to SEQ ID NO: 2019

SEQ ID NO: 4165 - DNA, 1332 bp, Neisseria meningitidis
atgttaaaatgcggaacattttttatcacgcggcacatcccgaggggctgccgccgctttttccaacccaatcaagcaagacaaaccgaaatttatcagataaggggaacggttatgcaacgtcgtattataaccctgctctgcgcggcaggtatggcattctcaacacaaactttggcggcaaatttggaggtgcgcccgaacgcgccggaacgctacacggtcaaacagggcgacaccctgtggggcatttcgggcaaatacctgtacagcccgtggcaatggggccgcctgtgggacgcgaaccgggatcaaatccacaatcccgacctgatttatccggaccaggtattggtgttgcgccacgttgacggcgaaccgcgcctcggcttggaacagacagacggcatccccgtcgtcaaaatgagtccggataaggaagtgtccggatacggtattcccgccatcgatgtcaacttctaccgcatctttatgcggcatccgcaaatcgtttcccgcaaagaaaccgctgccgcgccgcgcctgctctcgggcccggaaggcaggctgctgtacaccaaaggcaccagggtttacaccaaaggcctgaaagagccgggccgctacctgacctaccgaatcaataaaaacatcaccgatccggatacgggtaaattcctcgggcaggaagtcgcattcagcggcatcgtgcgctccctcgactataccgactctgtcctcgaacaacgctcgaaacaggctggagaacggccgaaagacaacgaataccatacccgcacccatcctttgattaccccgctgcgcaccccttcgatacagccgctggtggtcgaaaccgccatttccgaaatacagcagggcgactacctgatgaaaatgccggaagacaccgaccgcttcaacatgatgccgcacgaaccgtcccgcccggttcaggctaaaatcgtttccgtgtttgaaggcacaaggattgccggccagtttcaaaccatcaccatcgacaaaggcgaggcggacggtttggacaaaggcacggttttgagcctctacaaacgcaagaaaacgatgcaggtcgacctctccaacaatttcaaaagcagggataccgtcgagctgatttccactcctgccgaagaagtgggcttggcaatggtttaccgcacctccgaacacctgtcgtccgccatcattttggaaaacatctccgatatttccgtaggcgacaccgccgccaatccgggacgcgatttggacaatataccggatcagggccgcagccgcgtgaagtttggcttcaaccgctccgaataa

SEQ ID NO: 4166 - DNA, 504 bp, Neisseria meningitidis
atggctttattgaatatcttgcaatatcccgacgagcgtctgcacacggtggcaaagcctgtcgaacaagtcgacgagcgcatccggaagctgattgccgatatgtttgaaacgatgtacgaatcgcgcggcatcgggctggcggcgacgcaggtcgatgtgcacgagcgcgtggtcgtgatggatttgaccgaagaccgcagcgaaccgcgcgtgttcatcaaccccgtcatcgttgaaaaagacggcgaaaccacttacgaagagggctgcctgtccgtgccgggcatttacgacaccgtaacccgcgccgaacgcgtcaaggtcgaggctttgaacgaaaaaggcgaaaagttcacgctggaggcggacggcttgttggcgatttgcgtgcagcacgagttggaccacctgatgggcatcgtgtttgtcgaacgcctttcccaactcaagcaggggcggattaagaccaagctgaaaaaacgtcagaaacatacgatttga

SEQ ID NO: 4167 - DNA, 927 bp, Neisseria meningitidis
atgaaagtcatcttcgccggcacgcccgattttgccgccgccgccttaagagccgttgccgccgccggttttgaaattccgctggtgctgacccagcccgaccgtccgaaagggcgcggtatgcaactgactgccccgcccgtcaaacaagccgcgctggaactcggtttgcgcgtcgaacagcccgaaaagctgcgcaacaacgccgaagccctgcaaatgctcaaagaggtcgaggcagacgtaatggtggttgccgcctacggtttgattctgccgcaggaagtgttggatacgccgaaacacggctgcctcaacatccacgcttcgctgttaccccgttggcgtggcgcggcgccgattcaacgcgcgattgaagccggcgatgccgagacaggcgtgtgtattatgcagatggacatcggtttggacaccggcgatgtggtcagcgaacaccgctacgccatccaaccgaccgataccgccaacgaagtccacgacgcgctgatggaaatcggtgcggcggcggttgttgccgatttgcaacagcttcaaagcaaaggccgtctgaacgcggtcaaacagcccgaagaaggtgttacttacgcgcaaaaattgagcaaagaagaggcgcgtatcgattggagcaaaagcgcggcggttatcgaacgcaaaatccgcgccttcaaccccgtgcctgccgcgtgggttgagtatcagggcaagccgatgaaaatccggcgggcggaagtggtggcgcaacaaggcgcggcaggcgaagtgttgtcctgttcggcggacggtttggtcgttgcctgcggcgaaaacgcgctgaagattaccgaattgcagcctgccggcggcaggcggatgaatatcgcggcgtttgcagcaggacggcatatcgaagcaggggcgaagctgtaa

SEQ ID NO: 4168 - DNA, 1260 bp, Neisseria meningitidis
atgagtatggcacttgcccaaaaacttgccgccgacagcattgcggcggttgccgaaggacgtaaccttcaggacgtgttggcgcaaatccgcaccgcgcatcccgaccttatggcgcaggaaaacggcgcgttgcaggacatcgcctacggctgccagcgttatttgggcagtttgaaacatatgctcgcgcagatgctgaaaaagccgattggcaatccgcagctcgaaagcctgcttttggcggcgttgtaccagctgcattacacgcgcaacgcgccccacgccgtggtcaatgaggcggtggaaagcatcgcgaaaatcggacgcgggcagtaccgttcgtttgccaacgcggttttgcgccgctttttgcgcgaacgcgacaagcttgtggcttcctgtaaaaaagacgatgtagcgaaacacaacctgccgctgtggtgggtggcttacttgaaaaaccattatccgaaacactggcacaacatcgccgccgcgctgcaatcccatccgccgatgactttgcgcgtcaaccgccgacacggcaatgccgaaagctatttggaaaaactggtggcggaaggtatcgcggctaaggcgttggacgaatatgcggttacgttggaagaagccgtgccggtgaaccgcctgcctggtttttcagacggcattgtttcggtacaggacttcggcgcgcagcaggcggcgtatttgttaaacccgaaagacggcgaacggattttggacgcgtgcgccgcgccgggcggcaagacggggcatatcttggaactggcggattgccgtgttaccgccttggacattgatgcaggccgtctgaaacgggtggaagacaatatcgcgcgtctgggctttcagacggcatcgacggcgtgtgccgatgcacaggacctgtcggcatggtatgatgggaaaccgtttgatgccgtccttgccgacgtgccgtgtaccgcctcgggcgtggcgcggcgcaatcccgacgtgaaatggctacgccgtccgaccgacgcgctcaaaaccgcccgccagcaggaagccctgctagatgcattgtggcaggtgctgaaaagcgggggaaggatgttgatcgctacctgttccgtgttcgtcgaggaaaacgacggacaattgcaaaaattcctcaaccgccatgccgatgcagaactgatcgaatcgcgggtactcttaccgaacaaacaccaagatggcttttattacgcgcttattcaaaagcagtaa

SEQ ID NO: 4169 - DNA, 543 bp, Neisseria meningitidis
atgctccccgcctttcagaatgtggcggcggaggggatagatgtgagccgtgccgaagcgaggataaccgacggcgggcagctttccatcagcagccgcttccaaaccgagctgcccgaccagctccaacaggcgttgcgccggggcgtgccgctcaactttaccttaagctggcagctttccgccccgataatcgcttcttatcggtttaaattggggcaactgattggcgatgacgacaatattgactacaaactgagtttccatccgctgaccaaccgctaccgcgttaccgtcggcgcgttttcgacagactacgacaccttggatgcggcattgcgcgcgaccggcgcggttgccaactggaaagtcctgaacaaaggcgcgctgtccggtgcggaagcaggggaaaccaaggcggaaatccgcctgacgctgtccacttcaaaactgcccaagccttttcaaatcaatgcattgacttctcaaaactggcatttggattcgggttggaaacctctaaacatcatcgggaacaaataa

SEQ ID NO: 4170 - DNA, 2121 bp, Neisseria meningitidis; identical to SEQ ID NO: 251

SEQ ID NO: 4171 - DNA, 1278 bp, Neisseria meningitidis
atgcgtagcagcgatattttaattgtagacgacgaaatcggcatccgcgacctgctgtcggaaatcctgcaggacgaaggttattcggtcgcattggcggaaaacgccgaagaggcgcgcaagctgcgccatcaggcgcgccccgcgatggtgctgctggatatttggatgcctgattgcgacggcatcacccttttgaaggagtgggcgaaaaacgggcagctcaatatgccggtggtgatgatgagcgggcatgccagcatcgataccgccgtggaagccaccaaaatcggcgcgatcgattttttggaaaaaccgatttccctgcaaaagctgctgtctgccgtcgaaaacgcgttgaagtacggtgcggcgcaaaccgaaacggggcctgtattcgacaagctgggcaacagtgcggcgattcaggaaatgaaccgtgaggtaggggctgcggtgaaatgtgcctctcccgtacttttgacgggcgaggcgggttcgccgtttgaaacggtggcacgctatttccataaaaacggtacgccgtgggtcagcccggcaagggtcgaatatctgatcgatatgccgatggaactgttgcagaaggcggagggcggcgttttgtatgtcggcgacatcgcccagtacagccgcaacatccaagccggtattgcctttattgtcggaaaggcggaacaccgccgcgtcagggtggtcgcatcgggcagcagggcggcaggttcagacggcattgcctgcgaggaaaagctggcggaactgctgtcggaatcggtcgtccgtattccgccgctgcgtatgcagcatgaagacattcccttcctgatacaggggattgcctgcaatgtggcggaaagccaaaagattgcgcctgcctcattcagtgaagaggcacttgccgcattgacccgttacgactggccgggaaatttcgaccaactgcaaagcgtcgttgcaacgctgttgttggaggcggacggacaggaaatcggcgcaggggcggtttcttcccttttggggcagaatgtgcctgccgagggggcggaagatatggtgggcgggtttaatttcaacctgcccctgcgcgaattgagggaggaggtggagcggcgttatttcgagtaccacatcgcccaagaaggtcagaatatgagccaagtggcgcagaaagttggtttggaacgcacgcacctttaccgcaaactcaaacagctcggcatcggcgtttcgcgccgggcgggggaaaaaaccgaagaatag

SEQ ID NO: 4172 - DNA, 1194 bp, Neisseria meningitidis
atgacagaggacgaacgtttcgcgtggctgcaattggcgtttacgccctatatcggcgcggaaagtttcctgctgctgatgcgccgtttcggcagcgcgcaaaatgccctgtccgcaccggcggaacaggtggcggcactgatacggcacaaacaggcgcttgaggcttggcgcaatgcggaaaaacgcgctctggcgcggcaggcggcagaagcggcattggaatgggaaatgcgggacggatgccgcctgatgctgcttcaggatgaagattttcccgaaatgctgacgcaggggctgaccgcgccaccggttttgtttttgcgcggcaacgtgcaactgctgcacaaaccttccgccgccatcgtcggcagccgtcatgccacgccgcaggcgatgcggattgccaaagatttcggcaagtcgttgggtgggaaaggcattcccgttgtgtcgggtatggcttcgggcatcgataccgccgcccatcagggtgcgttgcaggcagaaggcggcaccatcgccgtgtgggggacgggcatagaccgcatttatccgccggtcaacaaaaaccttgcctatgaaatcgccgaaaaaggattgattgtcagcgagttccccatcggcacgcggccgtatgccggcaattttccgcgccgcaaccgcctgattgccgccctgtcgcaagtaacgctggtggttgaagccgcgttggaatccggttcgctgattactgccagattggcggcggagatggggcgcgaagtgatggcggtacccggctcgatagacaatccacacagtaaaggctgccacaaactgattaaagacggcgcaaaattggtggaatgcctggacgacatcctgaacgaatgcccggggctattgcaaaatacgggtgcttcatcatattctataaataagggaatacctgaaaagcgcatcactgccgttcagacggcatccgaccagctgtctctgcctgaaggcaaaatgccgtctgaaaagacggagaaccgacccgtcggcggcagtatcttggacaggatgggtttcgacccagttcatcccgacgtgcttgccggacagttggctatgcctgccgcagatttgtatgccgcactgttggaattggaattggacggcagcgttgccgcaatgcccggcggcagataccagcgtatccgaacttga

SEQ ID NO: 4173 - DNA, 462 bp, Neisseria meningitidis
atgaccgaagtcatcgcctacctcatcgaacatttccaagatttcgatacctgcccgccgcccgaagacttgggtatgctgcttgaagaagcgggtttcgatacgatggaaatcggcaacaccctgatgatgatggaagtattgctcaacagctccgaattttccgccgaacccgccgacagcggcgcattgcgcgtgtacagcaaagaagaaaccgacaacctgccgcaggaagtgatggggctgatgcagtatctgattgaagaaaaagccgtcagctgcgaacagcgggaaatcatcatccacgcgctcatgcacattccgggcgacgaaattaccgtagataccgccaaagtgctgaccctgctgcttttatgggcaaacaagagcgagctgcccgtgttggtcggcgacgagctgatgagcgcgcttttactcgacaacaaacccacgatgaactga

SEQ ID NO: 4174 - DNA, 2307 bp, Neisseria meningitidis
atggcgaaaaacctattaatcgtcgaatccccgtccaaagccaaaaccctgaaaaaatatttgggcggcgattttgaaatccttgcatcctacggacacgtccgcgacctcgtccccaaaagcggcgcggtcgatcccgacaacggctttgcgatgaaataccaactcatcagccgcaacggcaaacacgtcgatgccatcgtcgccggtgccaaagaagctgaaaacatctacctcgccaccgacccggatagggaaggcgaagccatttcctggcatcttttggaaatcctcaaatccaaacgcggcttgaaaaacatcaagccgcagcgtgtcgtgttccacgaaatcaccaaaaacgccgtgctcgatgccgttgcccatccgcgcgaaatcgaaatggacttggtcgatgcgcaacaagcccgtcgcgctttggactatttggtcggtttcaacctttcgccattgttgtggaaaaaaatccgtcgcggtttgagcgcgggccgtgtacaaagccccgcactgcgtttgatttgcgaacgcgaaaacgaaatccgcgcgtttgaagcgcaggaatattggacggtacatctagacagccacaaaggccgcagcaagttcaccgccaaactcgcccaatacaacggcgcgaaactcgaacaattcgacctgccgaacgaagccgctcaagccgatgtgttgaaagaactcgaaggcaaagaggccgtcgttaccgccatcgaaaagaaaaagcgcagccgcaaccccgccgcgccgtttaccacatccaccatgcagcaggatgctgtgcgcaaactcggcttcaccaccgaccgcaccatgcgtaccgcccagcagctttacgaaggtattgacgtagggcagggtgccatcggtctgattacctatatgcgtaccgacagcgtgaacttggcggatgaagccttaaccgaaatccgccattacattgaaaacaaaatcggcaaagaatatctgccgagtgccgccaaacaatacaaaaccaaatccaaaaacgcccaagaagcgcacgaagccatccgcccgacttccgtgtaccgcacgcccgaaagcgtcaaacccttcctgagcgccgaccagttcaaactctatcaaatgatttggcagcgtaccgtcgcctgtcagatgacgcccgccaaattcgaccaaaccaccgtcgatattaccgtcggcaaaggcgtattccgcgtaaccggacaagtgcaaaccttcgcaggcttcctcagcgtttacgaagaaagcagcgacgatgaagaaggcgaagacagcaaaaaactgcccgaaatgagcgaaggcgacaaattgcccgtggacaaactctacggcgaacaacactttaccactccgccgccacgctacaacgaagccacgctggttaaagccctcgaagaatacggcatcggccgcccctcgacctacgccagcatcatctccacgctcaaagaccgcgaatacgttacccttgagcaaaaacgctttatgcccaccgacacaggcgacatcgtcaataaattcctgaccgaacacttcgcccaatacgtcgattaccacttcactgccaaactcgaagaccagcttgacgaaattgccgacggcaaacgccaatggattcccttgatggacaaattctggaaaccgttcatcaaacaagtggaagaaaaagaaggcatcgaacgcgccaaatttaccacgcaggaacttgatgaaacctgcccgaaatgcggcgaacacaaactgcaaatcaaattcggcaaaatgggtcgttttgttgcgtgtgccggttatcccgagtgcagctacacgcgcaatgtcaacgaaaccgccgaagaagctgccgaacgcatcgccaaagccgaagccgaacaggccgaactcgacggacgcgagtgcccgaaatgtggcggtcgcctagtgtacaaatacagccgcaccggcagcaaattcatcggctgcgtcaactatccgaaatgcaaacacgtcgagccgctggaaaaaccgaaagataccggcgtccagtgtccgcaatgcaaaaaaggcaacctcgtcgagcgcaaatcccgctacggcaaactgttttacagttgcagcacctatcccgactgcaactacgccacttggaacccgcccgttgccgaagaatgcctgaactgccattggccggtcttgaccatcaaaaccactaaacgctggggtgtagaaaaagtctgcccacaaaaagaatgcggctggaaagaacagattgaaccgcccgcgccgaaggagtaa

SEQ ID NO: 4175 - DNA, 696 bp, Neisseria meningitidis
atgatgaaggatttgaatttgagcaacagcctgttcaaaggctacaacgacaaacatggcttaatgatttgtggctatgaatggggttggagtaaagccgatgaggctgcttatgtagcaggtgaatacaaactccctgaaaacaaaatcgaccatacatttgcaaacaaatccctctatttcggagagcaggcaaaaaagtggcgttacgacaatacgataaaaaattggtttgaaatgtggggacaccccttagacgaaaatggattgggcggtgcatttgaaaaatccctggttcaaaccaactgggctgctacacagggcaacactatcgacaatcccgacaagttcacacaacccgagcacatcgataattttctctaccacatcgaaaaactgcgtccgaaagtcatcctcttcatgggcagcaggttggcggattttctgaacaaccaaaatgtactgccacgcttcgagcagttggtcggtaagcagaccaaaccgctggagacggtgcaaaaagaatttgacggtacacgtttcaatgtcaaattccaatcgtttgaagattgcgaagtcgtctgctttccccatcccagtgccagtcgcggtctatcttacgattacatcgccttgtttgcgcctgaaatgaaccggattttatcggactttaaaacaacacgcggattcaaataa

SEQ ID NO: 4176 - DNA, 552 bp, Neisseria meningitidis
atggaattcctatctcttcacccttggtggtctttttttattatattaactattatccttagctatattggattctgtgcacatctccacattcaaaatagggcagttttcttttatagctatcgggatgtaactattattttcttgacacctgtcatcctcatcgctctaagttatttaattaaaaataaagaaatcctgtcagcttgtatcttatgtataactcttattgcattttcatgggcatggattataacctatcgatctaatactaaaaggttttttctttccttattgatagtatggggaaaattgttattaagtactattgtttgggcaattctcgccatatcacttggcttagctgtaataacagggaacagcaagcgtaaaaaatatgaacgacgtgaccgtcatgctgaacgtaatgaaaaagcttttataggtgcgctattagtaggtttcgaattatcaagaaatttattgaatttatgttgcctacacaaggatttttccaccccatctaaaaacattgaagtcaatcgctcttaa

SEQ ID NO: 4177 - DNA, 378 bp, Neisseria meningitidis; identical to SEQ ID NO: 3367

SEQ ID NO: 4178 - DNA, 570 bp, Neisseria meningitidis
atggcggcaggcaaacataccaaacacagcaaccgggtacgcattatcggcgggcaatgccggggcaggaaattgagtttcacatccgccgacggactgcgtccgacacccgacagcgtgcgtgaaaagctgtttaactggctgggacaggatttgacgggtaaaacggttttggatctcttcggaggcagcggcgcactcggtatagaagccgcttcgcgcaacgccaaacgcgtgctgatttcggataacaaccgccaaaccgtgcagaccttgcagaaaaacagtcgcgaactgggtttggggcaggtgcaaatcgtcttttcagacggcatcgcatatttgaagaccgtatccgaacagtttgatgttgtctttctcgacccgccgtttgcatggcaggactggcaaatcctgttcgatgccttgaagccgtgcctgaacccccgggcattcgtctatctcgaggcgggtacgctgccgaatattcccgattggctgacggaatatagagaagggaaatcggggcagagtacatttgaattaagggttttccaagtggctgaataa

SEQ ID NO: 4179 - DNA, 252 bp, Neisseria meningitidis
atgtcgctttttattaccgacgagtgcatcaactgcgacgtatgcgaacccgaatgccccaatgatgccatttcccaaggcgaggaaatttacgaaatcaaccccaacctctgcacgcagtgcgtcggacactacgatgagccgcagtgccagcaggtttgcccggtggactgcatcctgattgacgaagaacatcccgaaacccatgacgagttgatggcgaaatacgaaaagattatccagtttaaataa

SEQ ID NO: 4180 - DNA, 1185 bp, Neisseria meningitidis
atggctaaggaaaaattcgaacgtagcaaaccgcacgtaaacgttggcaccatcggtcacgttgaccatggtaaaaccaccctgactgccgctttgactactattttggctaaaaaattcggcggtgctgcaaaagcttacgaccaaatcgacaacgcacccgaagaaaaagcacgcggtattaccattaacacctcgcacgtggaatacgaaaccgaaacccgccactacgcacacgtagactgcccggggcacgccgactacgttaaaaacatgattaccggcgccgcacaaatggacggtgcaatcctggtatgttccgcagccgacggccctatgccgcaaacccgcgaacacatcctgctggcccgccaagtaggcgtaccttacatcatcgtgttcatgaacaaatgcgacatggtcgacgatgccgagctgttggaactggttgaaatggaaatccgcgacctgctgtccagctacgacttccccggcgatgactgcccgattgtacaaggttccgcactgaaagccttggaaggcgatgccgcttacgaagaaaaaatcttcgaactggctgccgcattggacagctacatcccgactcccgagcgagccgtggacaaaccgttcctgctgcctatcgaagacgtgttctccatttccggccgcggtacagtagtaaccggccgtgtagagcgcggtatcatccacgttggtgacgagattgaaatcgtcggtctgaaagaaacccaaaaaaccacttgtaccggtgttgaaatgttccgcaaactgctggacgaaggtcaggcgggcgacaacgtaggcgtattgctgcgcggtaccaaacgtgaagacgtggaacgcggtcaggtattggctaaaccgggtactatcactcctcacaccaaattcaaagcagaagtatacgtactgagcaaagaagagggtggtcgtcacactccgttcttcgccaactaccgtccgcaattctacttccgtaccaccgacgtaaccggcgcggttactttggaagaaggtgtagaaatggtaatgccgggtgaaaacgtaaccatcaccgtagaactgattgcgcctatcgctatggaagaaggcctgcgctttgcgattcgcgaaggcggccgtaccgtgggtgccggcgtggtttcttctgttatcgcttaa

SEQ ID NO: 4181 - DNA, 279 bp, Neisseria meningitidis
atgacagaacatacgcctgaaaaaaagaacgttaaagtggatcaactggttgttcaagataaagaatctgcatctaattccggtaaggaagggttttttgcatatttctcaaattcttggtccgaattcaaaaaggtggtttggcctaagcgtgaagatgctgtcagaatgactgtatttgttatagtgtttgttgctgtgctttctatatttatctatgcggcagatacagcaatttcgtggttattttttgatgtattgctgagaagggaaggttga

SEQ ID NO: 4182 - DNA, 537 bp, Neisseria meningitidis
atgtcgaaaaaatggtatgttgtacaggcgtattcggggtttgagaagaatgtccaacgaatattggaagagcgcattgcccgtgaggagatgggagattatttcggacaaattctggtgcctgtagagaaagttgttgatatccgcaatggtcgtaagactattagtgaaagaaagtcatatcctggttatgtgctagttgagatggaaatgacagatgactcttggcatcttgtaaaaagcaccccccgtgtttccggttttattggagggagggctaatagacctacgccgattagtcagagagaggctgaaattattttacagcaggttcagaccggcatagagaagccgaaaccaaaagttgaatttgaggtcggtcaacaggttcgtgtaaatgaagggccgtttgcggattttaacggggtggttgaggaggtcaattatgaacggaataagttacgcgtgtctgttcagatatttggtagagaaacacccgttgagctggagttcagccaggttgaaaagattaactga

SEQ ID NO: 4183 - DNA, 435 bp, Neisseria meningitidis
gtggcaaagaaaattatcggctatattaaactgcaaattcctgcaggtaaagccaatccatctcctccggttggtcctgctttgggtcagcgcggtttgaatattatggaattttgtaaggcatttaatgctgcaacccaaggtatggagcctggcttaccgattccggttgtgattactgcatttgcagataaatcattcacatttgtgatgaaaaccccgccagcttctatcttgttgaaaaaggctgccggtttgcaaaaaggtagttctaatcctctgaccaacaaagtgggtaaattgacccgtgcccagttggaagaaattgctaaaactaaagatcctgatttgactgctgctgacttggatgcggctgtccgtactatagcaggttctgctcgctcaatgggcttggatgtggagggtgttgtataa

SEQ ID NO: 4184 - DNA, 696 bp, Neisseria meningitidis
atggctaaagtatctaaacgcttgaaagctcttcgctcttctgtggaagccaataaattatatgcaattgatgaagcaattgctttggtaaaaaaagcagcgactgctaaatttgacgagtctgttgacgtatctttcaacttgggcgttgatccgcgtaaatctgaccaagttatccgtggttcggtcgttctgcctaaaggcaccggtaagataacccgtgtggctgtatttactcaaggtgcaaatgcagaagctgctaaagaagctggtgcagatatcgtcggtttcgaagatttggctgctgaaatcaaagcaggcaatctgaactttgatgtcgttattgcttctcccgatgcaatgcgtattgttggtcagttgggtactattttgggtcctcgaggcttgatgccaaaccctaaagtaggtacggttactcctaacgttgctgaagcagttaagaatgcaaaagcaggtcaagtacaataccgtacagataaagcaggtatcgttcatgcaacgattggtcgtgcttctttcgctgaagctgatttgaaagagaactttgatgcgttgctggatgctatcgttaaagccaagcctgctgccgctaaaggtcagtatctgaaaaaagttgctgtgtctagcaccatgggtttgggtattcgcgttgatacatcaagcgtaaataactaa

SEQ ID NO: 4185 - DNA, 144 bp, Neisseria meningitidis
atgtccaagaccgtagggatcgtaagatttaatcgtaactgccctacgcagacggtagtcctgaaacacattgcaagattgcttgtaagatgtctttttaggttaccgcgctggtgggatatcgttttggtatcctgtttataa

SEQ ID NO: 4186 - DNA, 501 bp, Neisseria meningitidis
ttgagtctcaatattgaaaccaagaaagtggcggtcgaggaaattagcgcggcaattgctaatgctcaaaccctcgtagtcgctgaatatcgcggtatcagtgtttccagtatgactgagcttcgtgcgaatgcacgtaaagaaggcgtttatttgcgcgttctgaaaaatactttggctcgtcgtgcagtgcaaggtacttcatttgcagaattggccgatcaaatggttggtccgttggtttacgctgcttctgaagatgctgttgctgctgctaaagtgttgcaccaattcgcgaaaaaagatgacaaaattgtcgttaaagccggttcttacaatggcgaagtaatgaatgctgctcaggttgctgagttggcttctattccgagccgcgaagagctgttgtccaaactgttgttcgttatgcaagctcctgtatcgggctttgcgcgcggtttggctgctttggcagagaaaaaagccggcgaagaagccgcttaa

SEQ ID NO: 4187 - DNA, 372 bp, Neisseria meningitidis
atggctattactaaagaagacattttggaagcagttggttctttgaccgtaatggaattgaacgacttggttaaagcttttgaagaaaaattcggtgtttctgctgctgctgttgcagttgcaggtcctgctggtgccggtgctgccgatgctgaagaaaaaaccgaatttgatgtcgttttggcttctgccggcgatcaaaaagtcggcgtgattaaagttgtccgtgcaattaccggtttgggtctgaaagaagctaaagacatcgttgacggcgcacctaaaaccattaaagagggtgtttctaaagctgaagccgaagacatccaaaaacaactggaagaagcaggcgctaaagtcgaaatcaaataa

SEQ ID NO: 4188 - DNA, 4185 bp, Neisseria meningitidis
gtgtgtatgaactattcgtttaccgagaaaaaacgtatccgtaagagttttgcaaagcgggaaaatgttttggaagttcctttcttgctagcaacccaaattgattcttatgcgaagtttttgcagctggaaaatgcttttgacaaacgtaccgatgacggtctgcaggcggcatttaattctattttcccgattgtgagccataacggttatgcgcgattggagtttgtgcattacacattgggcgagcctttgttcgatattcccgaatgtcagttgcgcggaatcacttatgcagcccccttgcgcgcgcgtatccgtttggtgattttggataaggaagcatctaaaccgacggtaaaagaagttcgtgaaaacgaagtgtatatgggcgaaattccgttgatgaccccgagcggttcttttgtgattaacggcacagagcgtgtgattgtctcccagttgcaccgttcgcccggcgtattcttcgagcatgacaaaggtaagacgcactcttccggcaaattgttattctccgcccgcatcattccctaccgtggttcatggttggattttgaatttgatccgaaagatttgctgtatttccgtatcgaccgccgccgtaaaatgccggtaacgattttgttgaaggctttaggctacaacaatgagcaaatcttggatattttctacgacaaagaaacgttctatttgtcttcaaacggtgttcaaaccgatttggttgcagaccgtctgaaaggcgaaactgccaaggtcgatatcttggataaagaaggcaatgtattggttgccaaaggtaagcgcattactgcgaaaaatatccgtgatattaccaatgcaggcctgacccgtttggatgtagaaccggaaagcctgctgggcaaagcattggctgccgatctgattgattcggaaaccggcgaggtattggcttctgccaatgatgaaattacagaagagttgttggccaaatttgatatcaacggcgtaaaagaaattacgaccctttatatcaatgagctggatcagggtgcttatatctccaataccttgcgtacggatgagactgccggccggcaggcggctcgtgttgcgatttaccgtatgatgcgtccgggcgaaccgcccaccgaagaggcggtcgagcaattgtttaaccgcttgttcttcagtgaagacagctacgatctgtcccgcgtaggccgtatgaaatttaatacgcgcacatacgaacaaaaactgtccgaagcccaacaaaactcttggtacggccgcctgctgaacgaaacgtttgccggtgctgccgacaaaggcggttatgtcctgagcgtcgaagatattgtcgcctcgattgcgactttggtcgagttgcgtaacggccatggcgaagtggacgatatcgatcacttgggcaaccgccgagtacgttcggtaggcgagctgactgaaaaccaattccgtagcggtttggcccgtgtggaacgtgccgtaaaagaacgtttgaatcaggcggaatcagaaaacttgatgccgcacgatttgattaatgcaaaacctgtttctgccgctattaaagaattcttcggctccagccaattgagtcagtttatggatcagaccaaccccttgtctgaagtaacccataaacgccgtgtatctgcattgggtccgggcggtttgacccgcgaacgtgcaggatttgaggtgcgggacgtgcatccgacccactacggtcgcgtatgtccgattgaaacgcctgaaggtccgaacatcggtttgatcaactcattgtccgtttatgcgcgcaccaatgattacggtttcttggaaacgccttaccgccgcgttatcgacggcaaagtaaccgaggaaatcgattacttgtctgccatcgaagaaggccgctatgtgattgcacaggcgaatgccgatttggattcagatggcaatctgattggcgatttggttacctgtcgtgaaaaaggcgaaaccattatggcaacgcccgaccgcgtccaatatatggacgtggcaactggtcaagtggtatccgttgcagcatccctgattccattcttggaacatgatgacgcgaaccgcgcattgatgggtgccaacatgcaacgtcaggcagtgccttgcttgcgtcctgaaaaaccgatggtcggtaccggtatcgagcgttccgttgccgttgactctgctactgcaatcgttgcccgccgaggcggcgtggtcgagtatgtcgatgccaaccgcgttgtgatccgtgtccatgacgacgaagcgactgccggtgaagtgggtgtcgatatttacaacttggttaaattcacccgttccaaccagtctaccaatatcaatcagcgtcctgccgtcaaagccggcgatgttttgcaacgcggcgatttggtggccgacggcgcgtccaccgattttggcgaattggctttgggtcaaaatatgaccatcgccttcatgccgtggaacggttacaactacgaagactcgattctgatttccgaaaaagtggctgcggacgaccgctatacttcgattcacattgaggaattgaatgtcgttgcccgcgatactaagctgggtgcggaagacattacccgcgatattccgaacttgtccgagcgtatgcaaaaccgtttggacgaatccggtatcgtttacatcggtgcggaagtagaagccggcgatgtgttggtaggcaaggtaacgcctaaaggcgaaacccaactgacgccggaagaaaaactgctgcgcgccatcttcggtgaaaaagcatctgacgtaaaagatacttcattgcgtatgcctaccggcatgagcggtaccgttatcgacgttcaagtcttcactcgtgaaggtattcaacgcgacaaacgtgctcaatccattatcgattccgaattgaaacgctaccgtttggatttgaacgaccaattgcgtattttcgacaacgacgcattcgaccgtatcgagcgtatgattgtcggtcagaaagccaacggtggtccgatgaagctggccaaaggcagcgaaatcacgaccgaatatctggcgggtctgccgagcaggcacgattggttcgatatccgtctgaccgatgaagatttggccaagcagttggaactgattaaagtgagcctgcaacaaaaacgcgaagaagcggacgagttatacgaaatcaagaagaaaaaactgacccaaggcgacgaattgcaacccggcgtacaaaaaatggtgaaagtttttatcgccatcaaacgccgtctgcaagccggcgacaaaatggcgggccgccacggtaacaaaggcgtggtatcgcgcattctgccagtggaagacatgccttacatggcggacggccgtccggtagacatcgtactgaacccattgggcgtaccttcccgtatgaacatcggtcagattttggaagttcacttgggttgggcagcaaaaggtatcggcgagcgtatcgaccgtatgctgaaagagcaacgcaaagcaggcgagttgcgcgagttcttgaacagactctacaacggcagcggtaagaaagaagatttggatgccctgactgatgaagaaatcatcgaactggcctccaacctgcgcaaaggtgcatctttcgcctctcctgtattcgacggtgcgaaagagtctgaaatccgcgaaatgctgaacttggcttatccgagcgacgatcctgaggttgaaaaactgggcttcaacgacagtaaaacccaaatcacgctgtatgacggccgttcaggcgaagcatttgaccgcaaggttacagtaggtgtgatgcactatctgaaactgcaccacttggttgacgaaaaaatgcacgcgcgttctaccggtccgtacagtctggttacccagcagcctttgggcggtaaagcccagttcggcggccaacgtttcggcgagatggaggtttgggcattggaagcatacggcgcggcatacacgctgcaagagatgctgactgtgaagtctgacgacgtgaacggccgtaccaaaatgtacgaaaacatcgtcaaaggcgaacacaaaatcgatgccggtatgcccgagtccttcaacgtattggtcaaagagattcgctcactgggcttggatatcgatttggaacgttactaa

SEQ ID NO: 4189 - DNA, 4176 bp, Neisseria meningitidis
atgaatttgttgaacttatttaatccgttgcaaactgccggcatggaagaagagtttgatgccattaaaatcggtattgcctctcccgaaaccatccgctcatggtcttatggcgaagtcaaaaaacctgaaaccatcaactaccgtacgttcaaacctgagcgtgacggtttgttctgtgccaaaatctttggcccggtcaaagactacgaatgcttgtgcggaaaatacaaacgcttgaaatttaaaggcgtaacgtgtgaaaaatgcggcgtggaagtaaccctgtccaaagtgcgccgcgaacgcatgggtcatatcgaattggctgcgcccgtcgcacatatttggttcttaaaatccctgccttcccgcttgggtatggtgttagacatgactttgcgcgacatcgagcgcgtattgtactttgaagcatttgtggtaaccgatcccggtatgactccgctgcaacgccgccaattgctgactgaagacgattactacaacaagctggacgaatacggcgacgatttcgatgccaaaatgggtgcggaaggtatccgcgaattgctgcgtaccctgaatgtagcgggcgaaatcgaaatcctgcgccaagagttggaatcgaccggttccgacaccaaaatcaaaaaaatcgccaaacgcttgaaagtattggaagccttccatcgttccggtatgaaactggaatggatgattatggatgtgctgccggtattgccgcctgatttgcgtccgttggttccattggatggtggtcgttttgccacttccgatttgaacgatttgtaccgccgcgttattaaccgtaacaaccgtctgaaacgtctgttggaactgcatgcgcctgacatcatcgtccgcaacgaaaaacgtatgttgcaagaagcagttgactcgctgttggataacggccgtcgcggtaaagccatgaccggcgccaacaaacgcccgctgaaatcattggcagacatgattaaaggtaaaggcggtcgcttccgtcaaaacctgttgggcaaacgtgtggactactccggccgttccgtgattaccgtaggcccgtacctgcgtctgcaccaatgcggtttgccgaaaaaaatggctttggaactgttcaaaccgttcattttccacaaattggaaaaacaaggtttggcctctaccgttaaagcagcgaaaaaattggtagagcaagaagtaccggaagtatgggacatcttggaagaagtcatccgcgaacatccgattatgctgaaccgtgcgccgaccctgcaccgtttgggtattcaagcgttcgaacctatcttgattgaaggtaaagcgattcagttgcacccattggtgtgtgctgcgttcaacgccgactttgacggcgaccaaatggcggtacacgttccattgagcttggaagcacaaatggaagcacgcacgctgatgctggcttcaaacaacgtattgtctccggccaacggcgaaccgattatcgtaccttcccaagacatcgtattgggcctgtactatatgactcgcgatcgtatcaatgccaaaggcgaaggcagcctgtttgccgatgtgaaagaagtgcatcgcgcataccataccaaacaggtcgagctgggtacgaaaatcaccgtacgtctgcgcgaatgggtgaaaaacgaagcaggtgagtttgagcctgtcgttaaccgttacgaaacaaccgtcggccgtgcattgttgagcgaaatcctgccgaaaggcctgccgtttgaatatgtcaacaaagcgttgaagaaaaaagaaatttctaaactgattaacgcatcgttccgcctgtgcggcttgcgcgatacggttatctttgctgaccacctgatgtacaccggtttcggatttgcggcaaaaggcggtatttccattgccgttgacgatatggaaattccaaaagaaaaagcggccttgctggctgaagccaatgccgaggttaaagaaatcgaagaccaataccgtcaaggtttggttaccaacggcgaacgctacaacaaggtggtcgatatttggggtcgtgccggcgataagattgctaaagcgatgatggacaacttgtccaaacaaaaagttatcgaccgtgccggcaacgaagtcgatcaagagtcattcaactccatttatatgatggcggactccggtgcccgtggttctgcagctcagattaaacagttgtccggtatgcgtggcttgatggcaaaacctgacggctcgattattgaaacgccgattacctcaaacttccgtgaaggtctgaccgtattgcaatactttattgcgacccacggtgcgcgtaagggtttggcggataccgcattgaaaaccgcgaactccggttacctgactcgtcgtctggtagacgtaactcaagatttggtcgttgttgaagacgattgcggtacttcagacggctttgtcatgaaggcagtggtacaaggcggtgatgtgattgaagcattgcgcgatcgtattttgggtcgtgttaccgcgtctgacgttgtcgatccgtcaagtggcgaaaccttggttgaagccggtacgttgctgactgaaaaactggtggatatgatcgaccaatccggtgtcgatgaagtcaaagtccgtacgccgattacttgtaaaacccgtcacggcctgtgtgcacactgttacggtcgtgacttggcacgcggcaaactggttaacgccggtgaggcagtcggtgtgattgctgcacaatccattggcgaaccgggtacccagttgaccatgcgtacgttccacatcggtggtgcggcatcccgtgcggcagcagccagccaagtggaagccaaatccaacggtacggcacgattcagcagccagatgcgctacgttgccaacaacaaaggcgagttggttgtcatcggccgttcttgtgaagtcgtgattcacgacgatatcggccgtgaacgcgaacgccacaaagtaccttacggtgccatcctgctggtacaagacggtatggccattaaagccggtcaaaccttggcaacctgggatccgcatacccgtccgatgattaccgaacacgcaggtatggtgaaattcgaaaacgtggaagagggcgttaccgttgccaaacaaaccgatgatgtaaccggtttgtccactttggtggtgattgacggtaaacgtcgttcctctagtgcttccaaactgctgcgtccgactgtgaaactcttggacgaaaacggcgtggaaatctgtattcccggtacttctactccggtatccatggcattccccgttggtgcggtgattaccgtacgcgaaggtcaggaaatcggtaaaggcgacgtattggcgcgtattccgcaagcctcttccaaaacccgcgacattaccggcggcctgccgcgcgttgccgaattgtttgaagcacgcgtgccgaaagatgccggtatgttggcggaaattaccggtaccgtttccttcggcaaagagaccaaaggcaagcaacgtctgattgttactgacgtggacggtgtagcatacgagaccttgatttccaaagagaaacaaattctggtacacgacggtcaagtggtaaaccgcggtgaaaccatcgtggacggcgcggtcgatccgcacgatattctgcgtttgcaaggtatcgaagcactggcacgctacattgtccaagaggtgcaagaggtttaccgtctgcaaggtgtgaagatttctgataaacacatcgaagtcatcatccgtcaaatgttgcgccgtgtgaacattgcggatgccggcgaaaccgggttcattaccggagagcaggtcgaacgcggcgatgtgatggcggccaatgaaaaagctttggaagaaggcaaagaaccggcgcgttacgaaaacgtattgctgggtattaccaaagcttccctgtccaccgacagcttcatttctgccgcatcgttccaagaaacgacccgcgttctgaccgaagccgcgattatgggcaaacaagacgagttgcgtggtttgaaagaaaacgtcatcgtcggtcgcttgattcctgccggtaccggtttgacttaccaccgcagccgtcatcaacaatggcaagaggtggaacaggagactgccgaaacccaagtaacggatgaataa

SEQ ID NO: 4190 - DNA, 258 bp, Neisseria meningitidis
atgaaacccagaaatctcttttttgcaggctgcctgctgacttcggcgacgtttgccgaggatatcggcgtacctgtcgaactgattaacgtcggtaatcggattgcgatgccgtctgaaggggaaagcctcgccctcctgccgtttgccgaggatgtaccgccggttcgcgatgcaatgccgtctgaagttcctaaaagcgcggcaggcggcgatgttcggggtgaccggatgagaatgccgattaacatcggatga

SEQ ID NO: 4191 - DNA, 150 bp, Neisseria meningitidis
atgagcgcggctttatggcataaaaaactgtcgtggaaaggatttacaccccaaataaatttccgttacaacaagatcaacagcaatatgcccgccttttattcgcgcagcggcaaggaacggtttgtcagtatagaaaaaacgtattga

SEQ ID NO: 4192 - DNA, 372 bp, Neisseria meningitidis
atgccaactatcaaccaattagtacgcaaaggccgtcaaaagcccgtgtacgtaaacaaagtgcccgcactggaagcttgcccgcaaaaacgtggcgtgtgcacccgtgtatacacaactacccctaaaaaacctaactctgcattgcgtaaagtatgtaaagtccgcctgaccaacggttttgaagtcatttcatacatcggcggcgaaggtcacaacctgcaagagcacagtgtcgtattgattcgcggcggtcgtgtaaaagacttgccaggtgtgcgttaccacactgtacgcggttctttggatactgcaggtgttaaagaccgtaaacaagcccgttccaaatacggtgctaagcgtcctaaataa

SEQ ID NO: 4193 - DNA, 471 bp, Neisseria meningitidis
atgccaagacgtagagaagtccccaagcgcgacgtactgccagatcctaaattcggcagcgtcgagttgaccaaattcatgaacgtattgatgattgacggtaaaaaatccgttgccgagcgtatcgtttacggtgcgttggaacagattgagaaaaaaaccggcaaagtagcaatcgaagtatttaacgaagccattgcaaacgccaaacctatcgtggaagtgaaaagccgccgtgtaggtggtgcaaactaccaagttcctgttgaagttcgtccttcacgccgtttggctttggcaatgcgctgggttcgcgatgcggcccgcaaacgtggtgagaaatccatggacctgcgtttggcaggcgaattgattgatgcgtccgaaggccgtggcggtgcgttgaaaaaacgtgaagaagtacaccgtatggctgaagccaacaaagcattctctcacttccgtttctaa

SEQ ID NO: 4194 - DNA, 2106 bp, Neisseria meningitidis
atggctcgtaagaccccgatcagcctgtaccgtaacatcggtatttccgcccatattgacgcgggtaaaaccacgacgacagaacgtattttgttctataccggtttgacccacaagctgggcgaagtgcatgacggtgcggctactaccgactacatggaacaagagcaagagcgcggtattaccattacctccgctgccgttacttcctactggtccggtatggcgaaacaattccccgagcaccgcttcaacatcatcgacaccccgggacacgttgactttaccgtagaggtagagcgttctatgcgtgtattggacggcgcggtaatggtttactgcgcggtgggcggtgttcaaccccaatctgaaaccgtatggcggcaagccaacaaataccaagtgccgcgcttggcgtttgtcaataaaatggaccgtcagggtgccaacttcttccgtgttgtcgagcaaatgaaaacccgtttgcgcgcaaaccctgtacctatcgtcattccggttggtgcggaagacaacttcagcggtgtggttgatttgttgaaaatgaaatccatcatttggaatgaagtcgataaaggtacaacctttacctatggcgatattcctgccgaattggtcgaaactgccgaagaatggcgtcaaaatatgattgaagccgcagccgaagccagcgaagaactgatggacaaatacttaggcggcgacgagctgaccgaagaagaaatcgtaggcgcgttgcgtcaacgtactttggcaggcgaaattcagcctatgctgtgtggttctgcatttaaaaacaaaggtgttcaacgtatgttggacgcagttgtagaattgctgccagctcctaccgatattcctccggttcaaggtgtcaacccgaataccgaggaagccgacagccgtcaagccagcgatgaagagaaattctctgcattggcgttcaaaatgttgaacgacaaatacgtcggtcagctgacctttatccgcgtttactcaggcgtagtaaaatccggcgataccgtattgaactccgtaaaaggcactcgcgaacgtatcggtcgtttggtacaaatgactgccgcagaccgtactgaaatcgaagaagtacgcgccggcgacatcgcagccgctattggtctgaaagacgttactaccggtgaaaccttgtgtgcggaaagcgcgccgattatcttggaacgtatggaattccccgagccggtaatccatattgccgttgagccgaaaaccaaagccgaccaagagaaaatgggtatcgccctgaaccgcttggctaaagaagacccttctttccgtgtccgtacagacgaagaatccggtcaaaccattatttccggtatgggtgagctgcacttggaaattattgttgaccgtatgaaacgcgaattcggtgtggaagcaaatatcggtgcgcctcaagtggcttaccgtgaaactatccgcaaagccgttaaagccgaatacaaacatgcaaaacaatccggtggtaaaggtcaatacggtcacgttgtgattgaaatggaacctatggaaccgggtggtgaaggttacgagtttatcgatgaaattaaaggtggtgtgattcctcgcgaatttattccgtctgtcgataaaggtatccgcgatacgttgcctaacggtatcgttgccggctatcctgtagttgacgtacgtatccgtctggtattcggttcttaccatgatgtcgactcttcccaattggcatttgaattggctgcttctcaagcgtttaaagaaggtatgcgtcaagcatctcctgccctgcttgagccaatcatggcagttgaagtggaaaccccggaagaatacatgggcgacgtaatgggcgacttgaaccgccgtcgcggtgttgtattgggtatggatgatgacggtatcggcggtaaaaaagtccgtgccgaagtacctttggcagaaatgttcggttactcgaccgacctgcgttctgcaacccaaggccgcgctacttactctatggagttcaagaaatattctgaagctcctgcccacatagctgctgctgtaactgaagcccgtaaaggctaa

SEQ ID NO: 4195 - DNA, 1185 bp, Neisseria meningitidis
atggctaaggaaaaatttgaacgtagcaaaccgcacgtaaacgttggcaccatcggtcacgttgaccatggtaaaaccactctgactgctgctttgactactattttgtctaaaaaattcggtggcgctgcaaaagcttatgaccaaatcgacaacgctcctgaagaaaaagctcgtggtattaccattaatacctcacacgtagaatacgaaactgaaacccgtcactacgcacacgtagactgcccggggcacgccgactacgttaaaaacatgattaccggcgccgcacaaatggacggtgcaatcctggtatgttccgcagccgacggccctatgccgcaaacccgcgaacacatcctgctggcccgccaagtaggcgtaccttacatcatcgtgttcatgaacaaatgcgacatggtcgacgatgccgagctgttggaactggttgaaatggaaatccgcgacctgctgtccagctacgacttccccggcgatgactgcccgattgtacaaggttccgcactgaaagccttggaaggcgatgccgcttacgaagaaaaaatcttcgaactggctgccgcattggacagctacatcccgactcccgagcgagccgtggacaaaccgttcctgctgcctatcgaagacgtgttctccatttccggccgcggtacagtagtaaccggccgtgtagagcgcggtatcatccacgttggtgacgagattgaaatcgtcggtctgaaagaaacccaaaaaaccacttgtaccggtgttgaaatgttccgcaaactgctggacgaaggtcaggcgggcgacaacgtaggcgtattgctgcgcggtaccaaacgtgaagacgtggaacgcggtcaggtattggctaaaccgggtactatcactcctcacaccaaattcaaagcagaagtatacgtactgagcaaagaagagggtggtcgtcacactccgttcttcgccaactaccgtccgcaattctacttccgtaccaccgacgtaaccggcgcggttactttggaagaaggtgtggaaatggtaatgccgggtgaaaacgtaaccatcaccgtagaactgattgcgcctatcgctatggaagaaggcctgcgctttgcgattcgcgaaggcggccgtaccgtgggtgccggcgtggtttcttctgttatcgcttaa

SEQ ID NO: 4196 - DNA, 312 bp, Neisseria meningitidis
atggcaaaccaaaaaatccgtatccgcctgaaagcttatgattacgccctgattgaccgttctgcacaagaaatcgttgaaactgcaaaacgtaccggtgcagttgtaaaaggcccgattcctttgccgaccaaaatcgagcgtttcaacattttgcgttctccgcacgtgaacaaaacttcccgtgagcaattggaaatccgcacccacttgcgcctgatggacatcgtggattggaccgataaaactaccgatgcgctgatgaagctggatttgccggccggtgttgatgtagaaatcaaagtccaataa

SEQ ID NO: 4197 - DNA, 366 bp, Neisseria meningitidis
atgattgccaaacacatcgaccggttcccactattgaagttggaccgggtaattgattggcagccgatcgaacagtacctgaatcgtcaaagaacccgttaccttagagaccaccgcggccgtcccgcctatcccctgttgtccatgttcaaagccgtcctgctcggacaatggcacagcctctccgatcccgaactcgagcacagcctcatcacccgcatcgatttcaacctgttttgccgctttgacgaactgagcatccccgattacagtcatcaaccatattccggtttgtcggagaaagatgcatacgctgtgatgaccggataccgacccgttaaaagagtccgaccctatgccgtctga

SEQ ID NO: 4198 - DNA, 645 bp, Neisseria meningitidis
atgactttaggtctggttggacgcaaagttggtatgacccgcgtgttcgacgaacagggtgtttctgttccggtaaccgttttggatatgtctgccaaccgcgttacacaagtaaaatccaaagatactgacggctatactgccgttcaagttacctttggtcagaaaaaagccaatcgtgtcaacaaagccgaagccgggcactttgcaaaagcaggtgttgaagccggtcgcggtttgattgagtttgctttgactgaagaaaaactggctgaattgaaagctggtgacgaaatcaccgtttctatgtttgaagtcggtcaactggtcgatgtaaccggtacctctaaaggtaaaggtttctccggcacgattaaacgtcataacttcggtgcccaacgtacttcccacggtaactcccgttctcaccgtgttccaggctctatcggtatggcgcaagacccgggtcgcgtgttccccggtaaacgcatggccggccaatacggcaacaccaaagcaactgttcaaaaattggaagttgtccgtgttgacgcagaacgccaactgctgttggttaagggtgctgttccgggtgcggtcaacagcgatgttgtagttcgtcccagcgtgaaagtaggtgcgtaa

SEQ ID NO: 4199 - DNA, 621 bp, Neisseria meningitidis
atggaattgaaagtaattgacgctaaaggacaagtttcaggcagtctgtctgtttctgatgctttgttcgcccgcgaatacaatgaagcgttggttcatcagctggtaaatgcctacttggcaaacgcccgctccggtaaccgcgctcaaaaaacccgtgccgaagtaaaacactcaaccaaaaaaccatggcgtcaaaaaggtaccggccgtgcccgttccggtatgacttcttctccgctgtggcgtaaaggtggtcgcgcgttcccgaacaaacccgacgaaaacttcactcaaaaagtaaaccgcaaaatgtaccgtgccggtatggcgactattctgtcccaattgactcgtgacgagcgtttgtttgcgattgaggcgttgactgccgaaactcctaaaaccaaagtttttgccgaacaagtgaaaaatctgggtctggagcaagtgttgtttgtaaccaaacagctcgacgagaatgtttacttggcttcacgcaacttgccaaacgtgttggttttggaagctcaacaagttgatccttacagcttgctgcgttacaaaaaagtaatcatcactaaagatgcagttgcacaattagaggagcaatgggtatga

SEQ ID NO: 4200 - DNA, 315 bp, Neisseria meningitidis
atgaatcaacaacgtttgactcaagtgattttggcacctatcgtttctgaaaaaagcaacgtattggctgaaaaacgtaaccaaatgacgtttaaagttttggcaaatgcaaccaaacctgaaattaaagcggctgttgagctgctgttcggcgttcaagttgcagacgttactactgttaccattaaaggtaaagttaaacgttttggtcgcactttaggtcgtcgcagcgatgttaaaaaggcttatgtaagcttggctgccggtcaagagttggatttggaagccgctgctgcagctgcagataaggaataa

SEQ ID NO: 4201 - DNA, 834 bp, Neisseria meningitidis
atggcaatcgttaaaatgaagccgacctctgcaggccgtcgcggcatggttcgcgtggtaacagaaggtttgtacaaaggtgcaccttatgcacctctgctggaaaagaaaaattctactgccggtcgtaacaacaatggtcatattactacccgtcataaaggtggtggtcataaacatcattaccgcgtcgtagattttaaacgtaacaaagacggtatccctgcaaaagtagagcgtatcgaatatgaccctaaccgtactgcatttatcgcactgttgtgctatgcagatggtgagcgtcgctacattattgctcctcgtggtattcaagccggtgcagtattggtttccggtgctgaagctgcgatcaaagtaggtaacactctgccgatccgcaatattcctgttggtacaactattcactgtatcgaaatgaaaccaggtaaaggtgcgcaaattgcacgttctgccggtgcttctgcggtattgctggctaaagaaggcgcgtacgctcaagtccgcctgcgctctggcgaagtccgtaaaatcaacgtagattgccgtgcaaccatcggtgaagtcggtaacgaagagcaaagcctgaaaaaaatcggtaaagccggtgccaatcgttggcgcggtattcgtccgactgtacgtggtgttgtcatgaaccctgtcgatcacccgcatggtggtggtgaaggccgtacgggcgaggcccgcgaaccggtcagcccatggggtactcctgctaaaggctaccgcactcgtaataacaaacgcacggataacatgattgttcgtcgccgttactcaaataaaggttaa

SEQ ID NO: 4202 - DNA, 279 bp, Neisseria meningitidis
atggctcgttcattgaaaaaaggcccatatgtagacctgcatttgctgaaaaaagtagatgctgctcgcgcaagcaacgacaaacgcccgattaaaacctggtctcgtcgttctaccattctgcctgattttatcggtctgaccattgctgtgcacaacggccgcacccatgtgcctgtgtttatcagcgacaatatggttggtcataaattaggcgaattctcattgacccgtacctttaaaggccacttggccgataaaaaggctaaaaagaaataa

SEQ ID NO: 4203 - DNA, 330 bp, Neisseria meningitidis
atgagagtaaatgcacaacataaaaatgcccgtatctctgctcaaaaggctcgtttggtagctgatttgattcgtggtaaagacgttgcccaagctttgaatattttggctttcagtcctaaaaaaggtgccgagctgattaaaaaagtattggagtcagctattgctaatgccgagcacaataacggtgcggacattgatgaactgaaagtggtaactatctttgttgacaaaggcccaagcttgaaacgttttcaagctcgcgccaaaggtcgcggtaaccgcatcgaaaaacaaacttgtcatatcaatgtgacagtgggtaactaa

SEQ ID NO: 4204 - DNA, 693 bp, Neisseria meningitidis
atgggacaaaagattaaccctacaggctttcgcctggcggtaactaaagactgggcttcaaaatggtttgctaaaagcaccgacttttctactgttttgaagcaggatatcgatgttcgcaattatttgcgtcaaaaattggccaatgcttcggttggtcgagtggttattgaacgccctgcaaaatctgcacgcattaccattcactccgctcgtccgggtgtggttatcggtaaaaaaggtgaggatatcgaggttttgaaacgtgacttgcaagtcttgatgggtgtacctgttcatgtaaatattgaagagattcgccgtcctgagttggatgctcaaattattgctgacggtattgcccagcagttggaaaagcgcgttcaattccgtcgtgctatgaaacgagcaatgcaaaatgcaatgcgttctggtgctaaaggcattaagattatgacttcaggccgtctgaatggtgcggatattgcccgtagcgaatggtatcgtgaaggtcgcgtgccactgcatactttacgtgcaaatgtagattatgcaaccagcgaagcgcacaccacatatggtgtattgggtctgaaagtttgggtttatacggaaggcaatattaaatcttccaaacctgaacatgagagtaaacaaagaaaggcaggtagacgtaatgctgcagccaactag

SEQ ID NO: 4205 - DNA, 417 bp, Neisseria meningitidis
atgctgcagccaactagactgaaataccgtaagcaacaaaagggtcgcaataccggcatcgctactcgcggtaataaggtaagtttcggtgagttcggcttgaaagccgtaggtcgtggtcgtttgactgcccgtcaaatcgaagctgctcgtcgtgcaatgacccgtcatatcaaacgtggtggtcgtatttggattcgtgtattccctgataaaccgattactgaaaagcctattcaagttcgtatgggtggcggtaaaggtaacgtggaatattacattgccgaaattaaaccaggtaaagtgttgtatgaaatggatggcgttccagaggaactggctcgtgaagcattcgagttggctgctgccaaattgcctattcctacaacctttgtagtaagacaggtgggtcaataa

SEQ ID NO: 4206 - DNA, 192 bp, Neisseria meningitidis
atgaaagcaaatgaattgaaagacaaatccgttgagcagttgaatgcagatttgttggacttgttgaaagctcagtttggcttacgtatgcaaaacgctaccggtcaattaggcaaaccaagtgaattgaaacgtgtacgtcgcgatattgctcgtattaaaaccgttttaactgaaaaaggtgctaagtaa

SEQ ID NO: 4207 - DNA, 264 bp, Neisseria meningitidis
atgagcgaaactaaaaatgttcgtactttgcaaggcaaagtagtaagcgacaaaatggataaaaccgtaacagtattggttgagcgtaaagtaaaacatccgctgtatggtaagattattcgattatctactaaaatccatgcccatgatgaaaataatcaatatggaattggtgatgtggttgttatatcggaatcccgtccattgtcaaaaactaaatcttgggttgtcagtgagctggttgagaaagcacgttctatttaa

SEQ ID NO: 4208 - DNA, 369 bp, Neisseria meningitidis
atgattcaaatgcagaccatcttagatgtggctgataactctggtgcgcgtcgcgtaatgtgtatcaaggtattgggcggatctaagcgtcgctacgcttctgttggcgatattattaaagtggcagttaaagatgcggctccgcgtggccgtgtcaaaaaaggcgatgtatataatgcggtagttgttcgtactgctaagggtgtacgtcgtcctgatggtgcgttaattaaattcgataacaatgccgccgtgttactgaataataaacttgaacctttgggtactcgtatctttggtccggtaacccgtgaattgcgtactgagcgatttatgaaaatcgtttcattggcacctgaagtattataa

SEQ ID NO: 4209 - DNA, 324 bp, Neisseria meningitidis
atgaataaaatcattaaaggcgatagggttgtagtaattgctggtaaggataaaggtaagcagggtcaagtagttcgagtgttgggtgataaagttgttgttgagggcgttaatgttgtaaaacgccatcaaaaacctaatccaatgcgtggcattgagggcggtattattactaaagaaatgcctttggatatttctaatatcgcaatcctgaatccggaaactaataaagcggaccgtgttggtattaagctgattgaaaatgaaggcaaagttaaacgcgttcgtttcttcaaatcaaatggctctatcattggggcataa

SEQ ID NO: 4210 - DNA, 540 bp, Neisseria meningitidis
atggctcggttgagagagttttataaagagacagttgttcctgaattggttaaacaatttggttacaaatcagtaatggaagtcccgcgtattgaaaaaattaccttgaatatgggtgtgggtgaggctgttgctgataaaaaagttatggaacatgctgtttccgatttagagaaaattgccggtcaaaaaccggttgttactgttgcccgtaaatctatcgcaggttttaaaatccgtgataactatccggttggttgcaaagtaacattgcgtcgtgatcaaatgtttgaattcttggatcgtttgattactattgcattacctcgcgtacgtgacttccgtggtgtgagcggtaaatcatttgatggccgtggcaattacaatatgggtgttcgtgagcaaattatttttccggaaattgaatacgataaaattgatgctttgcgtggtttgaatattactattactactacagcaaaaaccgatgaggaagcgaaagctttattgtcattgtttaaatttccgttcaaaggataa

SEQ ID NO: 4211 - DNA, 306 bp, Neisseria meningitidis
atggctaagaaagcacttattaatcgtgatctgaaacgtcaagctttggctaaaaaatatgcggctaaacgcgcggcaattaaagcggtaatcaatgattcgaatgcaactgaggaagagcgttttgaggctcgtttgaggtttcaatccattcctcgtaatgcggcacctgtgcgtcaacgtcgtcgttgtgctttgacaggtcgccctcgtggtactttccgtaaatttggtttgggtcgtattaaaatccgtgaaatcgccatgcgtggcgaaattccgggtgttgttaaagccagctggtaa

SEQ ID NO: 4212 - DNA, 393 bp, Neisseria meningitidis
atgagtatgcatgatcctatttccgatatgttgactcgtatccgcaatgcgcaacgtgctaataaagcagcggttgcaatgccttcttcaaaattaaagtgtgctattgcaaaggtattgaaagaagaaggatatattgaggacttcgcagtttcatctgacgtaaagtctatattggaaattcaattaaaatactatgcaggtcgtcctgtaattgaacaaatcaagcgtgtatctcgccccggtttgcgtatttataaagcgtctagtgagattccaagtgttatgaatggcttgggtattgctattgttagtacttctaaaggtgtaatgactgatcgtaaagcacgttctcaaggtgttggtggtgagttgttatgcattgtagcctag

SEQ ID NO: 4213 - DNA, 534 bp, Neisseria meningitidis
atgtcacgtgtcgcaaaaaacccagtgactgttcccgctggtgtagaagtaaaatttggagcagaggcattagttattaagggtaagaacggtgaattgtcttttcctttgcattctgatgtagccattgaatttaatgatggcaaattgacttttgttgcgaataacagcagtaaacaagcaaatgcaatgtctggtactgctcgcgcattagtcagcaatatggttaaaggtgtttcagaaggttttgagaaaagattgcaattgataggtgtgggttatcgtgctcaagcacaaggtaaaatcttgaatctgtctttgggtttttctcatccgatcgtatatgaaatgcctgaaggtgtctccgttcaaactcctagccaaacagagattgttttaaccggctcggataaacaagttgttggtcaagttgctgctgagattcgtgcgttccgtgctcctgagccttataaaggtaaaggtgttcgctatgtaggagaagtagtggtaatgaaagaagccaagaaaaaataa

SEQ ID NO: 4214 - DNA, 354 bp, Neisseria meningitidis
atggataaacatacaacccgactccgtcgtgcacgcaaaacccgtgctcgtattgcggacttgaaaatggtaagattatgtgtgttccgaagcaataatcatatttatgctcaagtaattagtgctgaaggtgataaagtattggctcaagcctctacattggaagctgaggtgcgcggtagtctgaaatctggaagcaatgttgaagcagctgcaatagttggtaaacgtatcgctgaaaaagctaaagcagcaggtgtagaaaaggttgcttttgatcgttcaggtttccaatatcacggtcgtgtgaaggctttggctgaagctgctcgtgaaaatggtttaagcttctaa

SEQ ID NO: 4215 - DNA, 519 bp, Neisseria meningitidis
atggcaaaacatgaaattgaagaacgcggtgacggtctgattgaaaagatggtcgctgttaatcgcgtaactaaagtagttaaaggtggccgtatcatggctttctcagcactgactgttgttggtgatggtgatggtcgcattggtatgggcaaaggtaaatcaaaagaagtaccagttgctgttcaaaaagcaatggatcaagctcgacgctctatgattaaagtacctttgaaaaacggtactattcatcatgaggttattggccgtcatggtgctactaaagtatttatgcagcctgctaaagagggtagtggcgtaaaagccggtggacctatgcgtttggtttttgatgctatgggcattcataatatctccgccaaagtgcacggatctactaacccatataatatcgtacgtgcaacattagatggtttgtctaagttgcatactcctgctgatatcgcagccaaacgtggcttgacagtggaagacattttgggagttaaccatggctga

SEQ ID NO: 4216 - DNA, 186 bp, Neisseria meningitidis
atggctgaacaaaaaaagattagggttacattggttaaaagcctgattggtacaattgaatctcatcgtgcatgtgcacgcggtttaggtttgcgtcgtcgcgagcatacggtagaggttttagatacccctgaaaaccgtggtatgattaataaaatcagctacttgttgaaagtggagtcttga

SEQ ID NO: 4217 - DNA, 435 bp, Neisseria meningitidis
atgtttttgaatacaattcaacctgctgttggtgctacgcatgctggtcgtcgtgttggacgcggtattggtagtggtcttggcaaaacgggtggtcgtggtcataaaggtcaaaagagccggtctggtgggtttcataaggtgggtttcgagggtggtcaaatgcccttgcaacgacgcctccctaaaagaggttttaaatctttaacagcatcagctaatgcacagcttcgtttaagtgaactggaatcaattgctgttaatgagattgatattttggtcttaaagcaagcgggtctgattgcatctacagtctctaatgttaaagttattgcttctggtgaaatttctaaggcagttgctttgaagggtattaaagttaccaaaggtgcgagagctgctatcgaggctgttggtggtaagattgaaatgtaa

SEQ ID NO: 4218 - DNA, 1311 bp, Neisseria meningitidis
gtggctaatcaacaaacgtcatcaggttcatccaaatttggagatcttaagaaacgtcttttgtttctatttggagcattgattgtttttcgaattggtgcccatatacccgtacctggagttgatgctgttgctttagctaaattatacgaaagcgctggaaacggcatcctgggaatattgaatatgttttccggtgggtcgttagagcgctttagtatatttgcaataggaattatgccatatatttcagcttctattattgtacagctcgcttctgaaattttgccatcattgaaggctttaaaaaaagaaggggaggctggtagaaaggtaattacgaaatatactaggtatggtactgttttgttagcaattcttcaaagtctaggtgttgcatctttcgtatttcagcaaggaattgttgtaacaagttcatttgagtttcatgtttccacggtagtttctttggtaacgggaaccatgtttcttatgtggcttggggagcaaattactgaaaggggtatcgggaacggtatttctttaatcattacggcaggtattgcttcaggtattccttcgggtattgcaaagctggttacactgacgaaccaaggttctatgagcatgcttacggcgttgtttattgtatttggtgccttattattaatttatttggttgtatactttgaaagtgcacagcggaagattcctattcattatgcaaaacgccagtttaatggtagggcgggtagtcaaaatacgcatatgcctttcaagttgaatatggctggtgttattcccccaatttttgcttccagtattattctatttccatctactcttttaggttggtttggttcggctgatacaaatagtgttttgcacaaaatagctggattgttacaacacggtcaattgctgtatatggctttatttgcagcgacagttattttcttttgttatttttatacggctttggtttttagccctaaagaaatggcagagaatttaaaaaagagtggtgcttttgttcctgggattagacctggtgagcagacctctaggtatttagaaaaagttgtattacgtttgacattgtttggagctctttatattacaactatttgtttaattccagagttcttaactacggttttaaatgtacctttttatttgggtggcacgtctttgttgattctagttgttgtaacgatggattttagtacacaaataaattcgtataggcttactcaacagtatgataagttaatgactcgttcagaaatgaaatcattttctcggaaatag

SEQ ID NO: 4219 - DNA, 219 bp, Neisseria meningitidis
atggcgaaagaagatactatccaaatgcaaggtgaaattcttgaaactttacctaatgcaacatttaaagtaaaacttgagaatgaccatattgtattgggtcatatttctgggaagatgcggatgcattacattcgtatttctccgggagataaggtcacagtagagctgacaccttatgatctaactagggctcgaatcgttttcagagcaagataa

SEQ ID NO: 4220 - DNA, 114 bp, Neisseria meningitidis
atgcgtgtacaaccatctgttaagaaaatttgccgaaattgcaagattattcgtcgaaatcgtgtagttcgtgtaatttgtactgatctccgtcacaaacagcgtcaaggttaa

SEQ ID NO: 4221 - DNA, 363 bp, Neisseria meningitidis
atggctcgtattgcaggggtaaatatccctaataacgcacacatcgtaattggtcttcaggctatttacggtattggtgctactcgtgctaaattgatttgtgaggctgcaaatattgcgcctgatactaaagcaaaagatttggacgagactcaattagatgctttgcgtgaccaagttgccaagtatgaagtagaaggtgatttgcgtcgtgaggtaactatgagtatcaagcgattgatggacatgggctgctatcgtggcttccgtcatcgtcgcggcttaccatgccgcggtcaacgcactcgtacaaatgcgcgtacccgcaaaggtccgcgtaaagcgattgctggtaagaaataa

SEQ ID NO: 4222 - DNA, 396 bp, Neisseria meningitidis
atggctaaagcaaacacagcttcacgtgtacgtaaaaaagtacgtaaaaccgtgagtgagggtattgtgcacgttcatgcatctttcaacaataccatcattacaatcactgaccgtcaaggcaatgcgttgtcttgggctacctctggcggcgctggttttaaaggttctcgtaaaagtacaccatttgcagcacaagttgcagcagaagcagctggtaaagttgcccaagagtatggcgttaaaaatttagaggttcgtattaaaggtccaggtccaggtcgtgaatcctctgtacgtgctttgaatgctcttggtttcaagattaccagcattactgacgttaccccgttgcctcataacggttgccgtccgcctaaaaaacgtcgtatttaa

SEQ ID NO: 4223 - DNA, 621 bp, Neisseria meningitidis
atggcacgttatattggccctaaatgtaagttggcacgtcgcgaaggtacggatttgtttttgaagagtgcgcgccgctctttggattctaaatgtaaaattgattccgctcctggtcagcatggtgcaaaaaaaccgcgtttgtcagactatggtttgcagttgcgtgaaaaacaaaaaatccgccgtatttatggcgtattagaacgtcagttccgtcgttatttcgcagaagctgatcgtcgtaaaggttctaccggcgagttgctgttgcagttgctggaatctcgtttggataatgtcgtttatcgtatgggtttcggttctacccgagctgaagcaagacagcttgtttctcataaggcgatagttgtgaatggacaagttgtcaatattccttctttccaagtgaaagctggtgatgttgtctcagttcgtgaaaaagccaaaaaacaggtacgtattcaagaagcattgggtttggcaactcaaatcggcttgccgggttgggtttctgtagatgcggataaacttgagggtgtgttcaaaaacatgccggatcgctcggaattgaccggtgatattaatgaacagctggtggtagagttctactctaaataa

SEQ ID NO: 4224 - DNA, 987 bp, Neisseria meningitidis
atgcagaatagcacaaccgaatttttgaaacctcgtcaaattgatgtaaatactttttctgcaactcgtgcaaaagtatctatgcagccatttgaacgtggtttcggtcataccttaggtaatgctttgcgccgtatcttactgtcatccatgaatggttttgctcctactgaagtagctattgccggtgtattacacgaatattctactgttgatggtattcaggaagatgttgttgacattttgctgaatattaaaggtattgtgtttaaactccatggtcgtagccaagttcaacttgtgttgaagaaatcaggttcaggtgtcgtatctgccggtgatattgagttgccgcatgatgtagaaattctgaatcctggtcatgtcatttgtcatttggctgataacggtcaaattgagatggaaattaaagtagagcaaggtcgtggttatcaatctgtttcaggtcgtcaggtagttcgtgatgagaaccgtcagattggtgcaatccagttggatgcgagcttttcgcccatcagccgtgttagctttgaggttgaacctgcacgtgtagagcagcggacggatcttgataagttggttttggatatcgaaaccgacggttctattgatcctgaggaagctgtacgcagtgcggcacgtattttgattgatcagatgtctatttttgctgatttgcagggtacgcctgtggaggaggttgaagaaaaagcacctcctatcgaccctgttcttttgcgtccggtggatgatctggaattgacagtacgttcagctaattgtttgaaagctgaggatatttattatattggcgatttgattcaacgcactgaaaccgagcttcttaaaacgccgaatttgggacgtaaatctttgaatgagattaaggaagtattggcatctaaaggtttgacactgggttctaagttggaagcatggccacctgtaggcttggaaaagccttaa

SEQ ID NO: 4225 - DNA, 369 bp, Neisseria meningitidis
atgcgtcatcgtaatggcaatcgcaaattaaaccgtaccagcagtcatcgtgctgcaatgctgcgtaatatggcgaattcattattgactcacgaagctattgtaacaactctgcctaaggccaaggaattgcgccgtgtagtagagccgttgattacattgggtaaaaagccgtcattggcaaaccgccgtttggcatttgaccgtactcgcgaccgtgatgttgtagtaaaactgtttggcgatttgggtcctcgttttactgctcgtaacggtggttatgttcgggtgttgaaatacggattccgtaaaggtgataatgcacctctggcactggttgaattggttgacaaaccggctgctgagtaa

SEQ ID NO: 4226 - DNA, 714 bp, Neisseria meningitidis
atgatggtttatataatgaatgctttcgatataaagtcgacaaagatggacgtattgtctatatctttgcatacgtcagacttgtttgatttggaagatgtgctggtcaaattgggcaagaagtttcaagagtctggtgttgttccatttgtgctggatgttcaagagtttgattatcccgagtctttggatcttgctgcattggtttcgttgttttcaaggcatggtatgcaaattttgggtctgaagcattctaatgaacgttgggctgctgcggctatgaagtatcatttgctgttttgtctgtctcattcggaaaatgttaaagaactgggtcaggttgaggtgcagaaaacggaggatggtcagaaagcaaggaaaacagtattgattacatcccctgtccgtaccggtcagcaggtttatgccgaagatggcgatttgattgttacgggggcggtcagccagggggcggaattgattgcggatggcaatatacatatttatgcgccgatgagggggcgtgctttggccggtgccaagggtgatacttctgcccgcatatttatccactccatgcaggcagaactggtttctgtggcgggtatttaccgtaattttgaacaggatttgccgaaccatctgcacaagcagccggtacagatattgttgcaggataaccgattggttatcagtgcaattggctcagagtaa

SEQ ID NO: 4227 - DNA, 816 bp, Neisseria meningitidis
gtggcaaaaattattgtagtaacttcaggtaagggcggtgtcggtaaaacgactaccagtgccagtattgcgacaggtttggcattacgcggatataaaactgcggtaattgattttgatgtgggtttgcgtaacctcgacctcattatgggttgcgagcgtcgtgtcgtttatgacctgatcaatgtcattcagggggaggcgacgctcaaccaagctttgattaaagataaaaattgtgaaaacctgtttattttgccggcttcccagactcgggataaagacgctttgacacgcgagggcgtagaaaaagtgatgcaggagctgtccggcaagaaaatgggctttgagtatattatttgcgactctcctgccggtattgagcagggtgcattgatggcgttgtattttgctgatgaagccattgtaacgaccaatcctgaggtttccagtgtgcgtgactccgacaggattttgggaattttgcaaagcaaatcccataaggcagagcaaggcggttcggttaaagaacatctgttgattacgcgttattctcccgaacgtgtggcaaaaggcgaaatgctgtctgtacaggatatttgcgatattctgcatattcctttgctgggtgtgattcctgaatcccaaaacgtcttgcaggcatccaattccggagaaccggtcatccatcaggacagcgtggcggcttccgaggcatataaggacgttattgcccgtcttttgggcgagaaccgtgaaatgcgtttcttggaagctgagaaaaaaagcttcttcaaacgtctgtttggaggataa

SEQ ID NO: 4228 - DNA, 264 bp, Neisseria meningitidis
atgtcattaatcgaatttttattcggcagaaagcagaaaacggcaaccgttgcccgcgaccgccttcaaatcatcattgcccaagagcgcgcccaagaaggtcaggctccggattacctgccgactttacgtaaagagttgatggaagtcctgtccaaatatgtgaatgtttcattagacaatatccgtatttcccaagaaaagcaggatggtatggatgtgcttgagttgaacattactttgccggaacagaaaaaggtatag

SEQ ID NO: 4229 - DNA, 921 bp, Neisseria meningitidis
atgaccttaaccgaattgcggtacatcgtcgcagtcgcccaagaacgtcatttcggcagggcggcgcggcgttgttttgtcagccagcccactttgtctattgccattaagaaattggaagaagagcttgccgtctctttgtttgaccggagcagtaacgatattattacgaccgaggcgggggaacgtatcgttgcacaggcgcgtaaggtattggaagaggcggagcttatcaggcatttggcaaatgaagaacaaaacgagctggagggtgcgttcaaactcgggctgatttttacggttgcgccgtacctgctgccgaaactgattgtttcgttgcgccgtactgcaccgaaaatgcctttgatgttggaagagaattacacgcatactttgaccgagtcgctcaaacgcggggacgttgatgcgattatcgttgccgaaccgtttcaagagccgggcattgttaccgaacccttgtatgacgaaccgtttttcgtgattgtcccgaaagggcattcatttgaggaactggatgccgtttcgccccggatgctgggtgaggagcaggttttgctgctgacggaaggcaactgtatgcgggatcaggtactctcaagctgttccgaattggcggcgaaacaacgtatacaggggttgaccaatacattgcagggcagctcgattaatacaatccgccatatggttgccagcggtttggcaatcagcgtgttgccggcaaccgcactgaccgaaaacgatcatatgctgttcagcattattccgtttgagggtacgccgccaagccggcgggtcgtattggcgtaccgccgcaattttgtccgtccgaaggcgttgtcggcgatgaaggcggcgattatgcagtcgcagcttcacggggtaagttttatctgcgactag

SEQ ID NO: 4230 - DNA, 2838 bp, Neisseria meningitidis
atgttagacaaatacaatccagccgaaatcgaatccaaacattatcaaaactgggaagagcagggctatttccaacctgatatggatttgacgaaaccgtctttctccatccaactgccgccgcccaacgtaaccggcacgctgcacatgggtcatgccttcaaccaaaccattatggacggtctgacccgctactaccgcatgaaaggctgcaacaccgcctggattcccggcacagaccacgcgggcatcgccacgcagattgtggttgagcgtcagcttgctgcgcaaaacgtgtcccgccatgacttgggtcgcgaaaaatttttggagaaagtgtgggaatggaaagaagtttccggcggcacgattacccaacaaatgcgccgcgtgggctgctctgccgactggacgcgcgagtatttcacgatggacgacgtgcgcgccgaaaccgtaaccgaagtgttcgtgcgcctgtatgagcaaggcttgatttaccgcggcaaacgcttggtgaactgggatcccgtgcttggcacggcggtatcggatttggaagtggaaagcgtggaagaacaaggctctatgtggcacatccgctatccgctggcggacaatcccgccgaagccgttatcgtggcgaccacccgtcctgaaacgctgctgggcgacgttgccgttgccgtcaatcctgaagacgaacgttatacccacttaatcggcaaggaattaatcctgccgctgaccggccgtactatccccgtgattgccgacgaatacgttgaaaaagacttcggcacaggctgcgtgaaaatcacgcctgcacacgacttcaacgactacgaagtcggcaaacgccacgacacgcgcctgattaatgtgttcaacttggaagccaaagtgctggcaaacgccgaagtgttcaacttcaaaggcgaagcgcaactaggctttgccctgcctgaaaaatacgcaggcttagaccgctttgccgcgcgcaaacaaatggttgccgatttgcaggaacaaggtttcttggtcgaaatcaaaccacacacgctgatgacgccgaaaggcgaccgtacaggttcggtgattgaacctatgctgaccagccaatggtttgtcgccatgtccgccaccccaaacggcggcgagccggacagcgagttcaaaggcttgagcctcgccgataaagccaaaaaagccgttgatagcggcgcggtacgctttatccctgaaaactgggtcaacacttacaaccaatggatgaacaacatccaagactggtgtatctcacgccaactgtggtggggccatcaaatccctgcatggtacgacaacgaaggcaatgtgtatgttgcccgcaatcaggaagaagccgaaaaacaagccggcaaaacaggcttgactcgcgaagaagacgtattggatacatggttctcctccgcgcttgtgccgttctccacactcggctggccgtctgaaaccgacgaactcaaagccttcctgccgtccaatgtcttagtaaccggctacgaaatcatcttcttctgggtggcgcgtatgattatgatgaccacccacttcaccggcaaagtaccgtttaaagacgtgtacatccacggcatcgtgcgcgaccacgaaggcaaaaaaatgtccaaatccgaaggcaacgtcattgaccctgtggatttgatcgacggcatcggcttggaaaaactgctggtaaaacgcaccaccggcctgcgcaaacccgaaaccgcgccgaaagtggaagaagccacgaaaaaactcttccccgaaggcattccgagtatgggcgcggacgctttgcgcttcactatggcgagctacgccagcttggggcgttcggtcaacttcgacttcaaacgcgccgaaggctaccgcaacttctgcaacaaaatctggaacgccaccaacttcgtcttgatgaacaccgaaaaccaagactgcggttacggcgcaaccgctgccgaaccgcgcggctactccttccccgatatgtggattgtaggccgtctgaatcagaccatcgaacaggttacgcaagcctacgaaacctaccgctttgatttggcggcggaaaccctgtacagcttcgtatggaacgactattgcgactggtatttggaactcgccaaagtgcagcttcaaaccggctgcgccagccgccaacgcgccacacgccataccttattgcgcgtactcgaagccgccctgcgcctgctgcacccgattatcccgttcatcaccgaagaactgtggcaaaccgtcgctcctatgtgcgacgcgaaaaccgccgacagcatcatgctcgcccgcttccccgaagccgacagcggcgagattgttcagacggcattcgagcaaatgaccgtgttgcaggatttgattggcgcagtccgcaacctgcgcggcgaaatgggcatccagcccaacgtaaaagccccgctgtttgtcgaaagcacggacgacttggcggactacctcaaatacctgccgatgatgacccgcctgaccgaagcacagcaagtcgccgccctacccgaaagcgaagacgcgcccgtcgccgtctgcaacggcgcgcgcctgatgttgaaagtcgaaatcgacaaagccgccgaaaccgcccgtttgagcaaagaagccgagaagctgcaaaaagccttggacaaactcaacgccaaactctccaaacccggctacaccgaaaaagcccctgcgcatctggtggaaaaagacaaagccgatttggcggaattggaagacaaaatggcaaaagttcaaaatcagttggcgaagttgaaagactga

SEQ ID NO: 4231 - DNA, 810 bp, Neisseria meningitidis
atgcccgatttttcgatgtccaatttggccgttgccttttccatcacattggctgccggtttgtttaccgtattaggcagtggcttggtgatgttttccaaaacgcccaatccgcgtgtgttgtcgtttggtttggcgtttgccggcggtgcgatggtatatgtttccctgacggagattttcagtaagtccagcgaggcgttcgctgaaatttatgataaagaccacgcgtttgcggcggcgaccatggcatttttggccgggatgggcggcattgcgctgattgaccgtctggtgccgaacccgcatgaaactttagacgcgcaagacccgtcgtttcaagaaagcaaacgccgccatatcgcgcgagtcggcatgatggcggcgtttgcgattactgcgcacaatttccccgaaggcttggcgacgttttttgccacattggaaaatccagcagtcgggatgcctttggccttggcgattgccatccataatattccggagggcatttccatcgccgcgccggtttattttgccacccgcagccgtaagaaaacggtgtgggcgtgtctgctatccggcttggccgagccgttgggggcggctttgggctatttggttttgcagccgtttttgtcgcctgccgtgtttggttcggtattcggcgtgatagccggtgtgatggtgtttttggcgttggacgagctgctgccggctgccaaacgctattcagacggccatgaaaccgtttacggcctgacaacgggtatggcggtgattgccgtcagcctggtattgttccatttttaa

SEQ ID NO: 4232 - DNA, 1257 bp, Neisseria meningitidis
atgaaagtgcttgttttaggtgcgggtgttgccggcgtgtcttccgcgtggtatctggcagaggccggacatgaagtaacggtcatcgaccgcgccgagggtgtggcgatggaaaccagttttgccaacgcaggccagctttcttacggctataccacgccttgggctgcacccggtatcccgaccaaagcgctgaaatggctgtttaaaagccatccgcctttgctgtttcgccccgacggcagcctgtatcaaatcgaatggctgtggcaaatgctgcaaaactgcacggcagcgcactatcaaaccaataaagagcgcatggtcaggatttccgaatacagccgtgaaatgttccgccgttttgaagcgcaaaccggcatgaattttgagggacgcaaaaaagggacgttgcagattttccgccaaaccaaagaagtcgaagcggcaaaacaagacattgccgttttggaacgctacggcgtgccgtaccgccgtctgaaacccgaagaatgtgcagaatttgagcctgcgctggcacgcgttaccgccaaaattgccggcggcctgcacctgcctgcagatgcgaccggcgactgccgcctcttcactgaaaacctatacaaattgtgtcaggaaaagggcgtacggtttcatttcaaccaaaacatcagccgcatcgaccacaacgggctgcgcatcaaaaccgttgaaaccgaaacagggcggtttgaagcagatgccgttgtctgcgcgctcggttgcttcagcaggacggttttggcgcagttggatctcaatctgcccatttatcccgtcaaaggctattccttgaccctgccggtcaccaattcagacggcgcaccggtgtccaccgttttagatgaaagctacaaagtcgccatcacgcgctttgacaacagaatccgcgtcggcggtatggcggaattgtcgggctacgaaatcaaactgcccgaaaaacgccgcgaaaccttggctttggtcgtcaacgacttgttcccggaaggcggcgatttgagccaagcatcgttctggagcggcctcagaccgatgacgcccgacagcacgccgttaatcggtcgcacccgctttgacaacctgtttctgaataccggccacggtactttaggctggaccatgtcgctgggttcggcaaaattaaccgccgatatcgtgagcggcaaagacaccgaaatccgcagcgacgatttgagcctgtcgcgttatcaggcttaa

SEQ ID NO: 4233 - DNA, 1392 bp, Neisseria meningitidis
atgcaagtgtttttagacaatcccaaagccttttttgaaaccgtcagcggctgggtttggggacctttgatgctgatgctgctggtcggcacgggtattttgctgactgttttattaaaaggtttgcagttcacgatgttgggttatgcgctgaaacaggcgtttatgccgccaaagaagcataaaagcggcgaaggccacgaaggcgatatttcccattttgcggcgttgatgaccgcgctgtccgccaccatcggcacgggtaacatcgccggcgtggcgactgcggtggtaaccggcggcccgggcgcggtattttggatgtggatgaccgccattttcggcatggccaccaaatacggcgaaggcgtgttggcggtgaaataccgcgtcaacaattccaaaggcgaaatgtccggcggcccgatgtattacatcgaaaaaggcttgggcaaaaactggaaatggatggccgtcgcgtttgcgctgttcggcacattcgcttccttcggtatcggcagctcggtgcagtccaactcggttgcacaggcggtgcaaaccagcttcggtatcgaacctgcctataccggcattacgttgaccgttctgactgccgttgtcgttttaggtggtattaaaggcatcgccaaagccgcttctttcatcgtgcctgctatggcggtgttttatgtgttgggcggtctttccattatcgcgattaattccgatgcactgatgcctgccgtcaagctgattttctccgatgcgttcagcgcgcaggcagtggcgggcggtgctatcggtacggtcatccgctacggcgtggcgcgcggcgtgttctccaatgaggcgggtatgggttctgcgcctattgccgccgcagccgcgaaaaccgaccatcccgtccgtcaggccttggtttctatgaccggtacgtttttggataccatcgtcgtttgctcgattaccggcatcgtgttggtaatgggactgctcggcgcgggcggcgagtttgtcaaacctgaagtgagcggcgcggcactgacaaccgtcacattccaaaaaatgctgcccggcatcggcggctggattgttaccatcggcctgattttctttgcctactcaaccattttgggctggtgctattacggcgaaaaatgcgcggtgtatgttttcggcgagaaatttgccggtttgtaccgcgtgggttatgtttcttccgttatgctgggtaccgtgttgagccttgatttggtgtggctggcttcggacacattcaacggcttgatggcattgcccaacctgattgcacttttattgatggcgaaagtcatcgtcaatgaaacgcgcgacttcaaacaaaaaatcacaaacggcgaattgccgcattaa

SEQ ID NO: 4234 - DNA, 777 bp, Neisseria meningitidis
atgaccctcatccacccgaccgccgtcatcgaccccaaagccgaactcgactccggcgtcaaagtcggcgcgtacaccgttatcggccccaacgtccaaatcggcgcgaataccgaaatcggtccgcacgccgtcatcaacggccacaccagcatcggcgaaaacaaccgcattttccaatttgccagcctcggcgaaatcccgcaggacaaaaaataccgcgacgagccgaccaagctgattatcggcaacggcaacaccatccgcgaattcaccacctttaatttaggtacggtaaccggcatcggcgaaacccgtatcggcgacgacaactggattatggcgtactgccacctcgcgcacgactgcgtcatcggcaaccacaccattttcgccaacaacgcctcgcttgccggacacgttaccatcggcgactacgtcgttttgggcggctacacgctggttttccaattctgccgcatcggcgactacgccatgaccgcgtttgccgcaggcgtacacaaagacgtgccgccctactttatggcatcgggctaccgcgccgaaccggcggggctcaacagcgaaggcatgcgccgcaacggttttaccgcagagcagatttccgccgtcaaagacgtgtacaaaaccctctaccatcgcggcattccgtttgaagaagccaaggcagacattctccgccgcgccgaaacccaagccgagcttgccgtattccgagactttttcgcacaatcggcgcgcggcatcatccgctga

SEQ ID NO: 4235 - DNA, 450 bp, Neisseria meningitidis
atggacgtacaactccccatcgaagccaaagacatccaaaaactcatcccccaccgctatccgtttctccagctcgaccgcatcaccgccttcgagccgatgaaaaccctgaccgcgattaaaaacgtcaccataaacgaaccccagttccaaggccatttccccgacctgcccgtgatgcccggcgtactcatcatcgaagcgatggcgcaggcgtgcggcacgttggcgattttgagcgaaggcgggcgcaaagaaaacgaattcttcttcttcgccggcatagacgaagcccgtttcaaacgccaagtcatccccggcgaccaactcgtctttgaagtcgagctgctgaccagccggcgcggcatcggcaaattcaacgccgttgccaaagtggacgggcaagttgccgtcgaagccatcatcatgtgtgccaaacgcgtggtttga

SEQ ID NO: 4236 - DNA, 1047 bp, Neisseria meningitidis
atgattccggccacctacaccctgtcccaaatcaccgcgcggctcggcggcgaatggcgcggcgaggacatttccgttaccgccgtgcgcccgctcgcagacgcgcaggcggaacacatcagcttccttgccaatccgaaatacaaagccgaagtccacgacagcagcgcgggcgcggtcatcgtttccgccaaagcggcagacggatttgaagggcgcaacctgattgtcgccgacgacccctatctctatttcgccaaagtcgcccgcctgttttcacccgtcgtcaaagcgcgcggcggcatccatccgaccgccgtcgtcgaaccgggcgcgaccgttcccaccagctgcgaaatcggcgcgaacgtctacatcggcgcaaacaccgtgctcggcgaaggctgccgcatcttggcaaacgccgtcgtccaacacgattgcaaactgggcgacgaagtcgtcctgcatcccaacgccgtcgtttattacggctgcacactgggcagacgcgtcgaaatccacagcggcgcggtcatcggcgcggacggtttcggactcgccttcgccgacgattcgtggttcaaaatcccgcaaaccggcgcggtaacgctgggcgacgacgtagaaatcggctcgaacaccaacatcgaccgcggcgcgatgagcgacaccaccgtcggcaacggcaccaaaatcgacaaccaagtccaaatcggacacaactgcaaaatcggttcgcacaccgtcatcgccgccaaaaccggcatctcaggtagcgtaaccataggcagctactgcatcatcggcggcggcgtcggtacggtcggacacatcgaaatcgccgacaaaaccaccatcggcggcggcacgtccgtcacccacagcattaccgaaagcggcaaacacctcgccggcatcttcccgatgtccacccataaagaatgggcgcgcaacgctgtttacatccaccgcttaagcgaaatgaacaaacggctcaaaacactggagcagcagctttcagatgccggtcaagacagcaaataa

SEQ ID NO: 4237 - DNA, 501 bp, Neisseria meningitidis; identical to SEQ ID NO: 2685

SEQ ID NO: 4238 - DNA, 2394 bp, Neisseria meningitidis
atgaaactgaaacagattgcttccgcactgatgatgttgggcatatcgcctttggcacttgccgacttcaccatccaagacatccgcgtcgaaggcttgcagcgtaccgagccgagtaccgtattcaactacctgcccgtcaaagtcggcgacacctacaacgacacacacggcagtgccatcatcaaaagcctgtacgccaccggtttctttgacgacgtacgcgtcgaaactgcggacgggcagctcctgctgaccgttatcgaacgccccaccatcggctcgctcaacatcaccggcgcaaaaatgctgcaaaacgacgccattaagaaaaacctcgaatcgttcgggctggcgcagtcgcaatactttaatcaggcgacactcaatcaggcagtcgccggcctgaaagaagaatacctcgggcgcggcaaactcaatatccaaatcacgcccaaagtaaccaaactcgcccgcaaccgcgtcgacatcgacatcacgattgacgagggcaaatccgccaaaatcaccgacatcgaatttgaaggcaaccaagtctattccgaccgcaaactgatgcggcaaatgtccctgaccgaaggcggcatttggacatggctgacacgaagcaaccaattcaacgagcagaaatttgcccaagatatggaaaaagtaaccgacttctaccaaaataacggctacttcgatttccgtatcctcgataccgacatccaaaccaacgaagacaaaaccaagcagaccatcaaaatcaccgtccacgaaggcggacgtttccgttggggcaaagtctccatcgaaggcgacaccaacgaagtccccaaagccgaactggaaaaactgctgaccatgaagcccggcaaatggtacgaacgccagcagatgaccgccgttttgggtgagattcagaaccgcatgggctcggcaggctacgcatacagcgaaatcagcgtacagccgctgccgaacgctgaaaccaaaaccgtcgatttcgtcctgcacatcgaaccgggccggaaaatctacgtcaacgaaatacacatcaccggcaacaacaaaacccgcgacgaagtcgtccgccgtgaattacgccaaatggaatccgcaccttacgacacctccaagctgcaacgttccaaagagcgcgtcgagcttttgggctacttcgacaatgtccagtttgatgctgtcccgcttgccggcacgcccgacaaagtcgatttgaacatgagtctgaccgaacgttccaccggttccctggatttgagcgcgggttgggttcaagataccgggttggtcatgtccgcaggcgtttcccaagacaacctgttcggtacgggcaagtcggccgcactgcgcgcctccaggagcaaaaccacgcttaacggctcgctgtcgtttactgacccgtacttcacggcagacggggtcagcctgggctacgatgtttacggaaaagccttcgacccgcgcaaagcatcgaccagcatcaaacaatataaaaccaccacggcaggcgcaggcatccgcatgagcgtgcctgttaccgaatacgaccgcgtgaatttcggtttggtggcagaacacctgaccgtcaacacctacaacaaagcgcccaaacactatgccgactttatcaagaaatacggcaaaaccgacggcacagacggcagcttcaaaggctggctgtacaaaggtaccgtcggctgggggcgcaacaaaaccgacagcgcgttatggccgacgcgcggctacctgacgggcgtgaacgccgaaatcgccctgcctggcagcaaactgcaatactactccgccacccacaaccaaacctggttcttccccctgagcaaaaccttcacgctgatgctcggcggcgaagtcggcattgcgggcggctacggcagaaccaaagaaatccccttctttgaaaacttctacggcggcggcctgggttcggtgcgcggatacgaaagcggcacgctcggtccgaaagtctatgacgaatacggcgaaaaaatcagctacggcggcaacaaaaaagccaacgtctccgccgagctgctcttcccgatgcccggcgcgaaagacgcgcgcaccgtccgcctgagcctgtttgccgacgcaggcagcgtgtgggacggcaaaacctacgacgacaacagcagttccgcgaccggcggcagggttcaaaacatttacggcgccggcaatacccataaatccacctttaccaacgaattgcgctattccgccggcggcgcggttacctggctctcgcctttaggcccgatgaaattcagctacgcctacccgctgaagaaaaaaccggaagacgaaatccaacgcttccaattccaactcggcacgacgttctaa

SEQ ID NO: 4239 - DNA, 1341 bp, Neisseria meningitidis; identical to SEQ ID NO: 2825

SEQ ID NO: 4240 - DNA, 1185 bp, Neisseria meningitidis
atgacaccacaagtcctgaccatattaggcagtaccggcagcataggcgaaagcacgctggacgttgtctcccgccaccccgaaaaattccgcgtattcgcgctggcagggcataagcaggtcgagaaattggcggctcaatgtcaaacgttccaccccgaatatgccgtcgttgccgatgcggaacacgccgcccggcttgaagccctgttgaaacgcgacggcacggcgactcaggttttacacggcgcgcaggcattggttgacgttgcctctgccgacgaagtcagcggtgtcatgtgcgccatcgtcggggcggtggggctgccttccgcgctcgcagcggcgcaaaaaggcaaaaccatttatctggcaaacaaagaaacgctggtggtttccggcgcgttgtttatggaaaccgcccgtgcaaacggcgcggcagtgctgcccgtcgacagcgaacacaacgccgttttccaagttttgccgcgcgattacgccggccgtctgaacgaacacggcatcgcttcgattatcctgaccgcttccggcggcccgtttctgaccgccgatttaaacacgttcgaccgcattacgcccgcccaagcggtcaaacaccccaattggcgtatgggacgcaaaatctccgtcgattccgccaccatgatgaacaaaggtttggagctgattgaagcgcattggctgttcaactgtccgcccgacaaactcgaagtcgtcatccatccgcaatccgtgatacacagcatggtgcgctaccgcgacggctccgtgctggcgcaactgggcaatcccgatatgcgaacgcccatcgcttattgtttgggtttgcccgagcgcatcgattcgggtgtcggcgacctggatttcgacgcattgtccgcgctgaccttccaaaagcccgactttgaccgcttcccctgcctgaggctcgcctatgaagccatgaacgcaggcggagccgcgccctgcgtattgaacgccgccaacgaagccgccgtcgccgcctttttggacggacagattaagtttaccgacattgccaaaaccgtcgcccactgtcttgcacaagacttttcagacggcataggcgatataggggggctcttggcgcaagatgcccggacacgcgcacaagcgcgagcatttatcggcacactgcgctga

SEQ ID NO: 4241 - DNA, 798 bp, Neisseria meningitidis; identical to SEQ ID NO: 2679

SEQ ID NO: 4242 - DNA, 747 bp, Neisseria meningitidis
atgaaaagcagcacgcaggccgttttggaacacaccgccattcccaagcatatcgccgtgattatggacggcaacggccgttgggcgaaaaaacgtttcctcccgcgcataatgggacacaaacgcggtttggacgcattggaaaatatggtgaagcattgcgccaaactgggtgtgcaatatctgaccgtgtttgccttttcaaccgaaaactggcgccgccccgaagacgaagtttcgttcctgatggggctgtttttacaggctttgcaaaaacaggtacgccgcctgcacgaaaacaatatgcgcctgaagatattgggcagccgcgaacgcttcaaccggcagattctgcaaggcatcgaagaggcggaagcgttgacggcaaacaataccggcctgaccctgagcattgccgccgattacggcggccgctgggatattttgcaggcggcaaacaaactgattgccgaaggcgtatccgagattacggaagacacgctggcgaaacacttgatgctgggcgatgcaccggaaccggatttgttcatccgcaccggcggcgaaacgcgcatcagcaatttcctgctctggcagatggcatatgcagaactgtatttcaccgatattttgtggcccgattttgacggcaaggctttggacgatgccgtcgcttcgttccaaaaacgcgaacggcggttcggacgcacctccgagcaactgcctatcgaacagcaaaggaactga

SEQ ID NO: 4243 - DNA, 558 bp, Neisseria meningitidis
atgatcaacgatattcaaaaaacagccgaaggcaagatgcagcgttcggtcgaagtactgaaagaaaatctggcgaaagtgcgtaccggccgcgcgcataccggcctgctcgaccaagtggaagtcgaatactggggcagcatggtccccgtcagccaagttgccaacgtaacgcttctggacgcgcgcaccatcggcgtgaaaccgtttgagggcaatatggcggccaaagtcgagaaagccatccgcgattcaaacttgggactgaacccggcagctgtcggcgacctgatccgcgtgccgatgcccatgctgaccgaggaacgccgcaaagacctgattaaagtcgtacgcggcgaagcggaagaaggccgcgtctctatccgcaacgtgcgccgcgatgccaacgaccacatcaaaaaactcctcaaagacaaagaaatttccgaagacgaggcacgtcgcggcgaagaagcggttcaaaaactgaccgacaaatacattaccgaagccgacaaactcctgactgccaaagaagaagatttgatggcaatttaa

SEQ ID NO: 4244 - DNA, 1128 bp, Neisseria meningitidis; identical to SEQ ID NO: 631

SEQ ID NO: 4245 - DNA, 423 bp, Neisseria meningitidis
atgtttgtgaacgagaaatatccttatgcggctctgtttgcgggactggtgtttttgacgctgccgtttgcgttggcggtgcatgatgcctttgcgcttgcgttcggacggacggggttgctggtgtcggtgtcggacggcggattcggctggcgtggcggttgggacggcactgtttggtttgtgttcggtgtgtttgcgtttttgaatgtggttgtgtcggcgggtctgacgaaactggcgtacaaaaagatgatgcggcggcattcgcgttacacactgtttctgtcgggcgtggcggcttgcgcggcggcagcggtggcttggattttcgagctgctgcttggcagtggggctttgggcgggctgcgggggaggcggtgttggaatatgcgtttgccgtgtggctggtggcgatgctga

SEQ ID NO: 4246 - DNA, 624 bp, Neisseria meningitidis
atggaacgcaaagaacgcctgcgtgcaggcattgccgcgatggggctggatatttcggaaacggcgcaggacaggcttttggtctatgtggatttgttgaaaaagtggaacaaaacctacaatctgaccgccctgcgcgacgaggaaaaaatgattgtccatcatcttttggacagcctgacgctgctgccccatatcgagggtgtgcaaacgatgctggatgtcggttcgggcggcggtcagcccggcattccggcggcggtgtgccgtccggatgtgcaaataacccttttggatgcgaatacgaagaaaacggcttttttacagcaggcggttatcgagttggggttggacaatgtgcgcgtggtatccggacgcgtggaggcggtttcggacgtgcgtgccgatgtggttaccagccgtgcgtttgcagaactggcggattttgtgtcgtggacggtgcatctgttgaaagacggcggctactgggcggcgatgaagggcgtgtatccgcaggaagaaatcggccgcctgccgcaggatgtgtgcgttgaaaaagtccaaaggctcgacgtgccgggcttggatgcggaacgccatatcgtcatcctgagcaagcgttga

SEQ ID NO: 4247 - DNA, 774 bp, Neisseria meningitidis; identical to SEQ ID NO: 2667

SEQ ID NO: 4248 - DNA, 585 bp, Neisseria meningitidis
atgcacatactgaccgccggcgtggacgaggcaggacgcggacctttagtcggcagcgtgtttgccgccgccgtcatccttccggaaacattcgacctgcccggactgaccgactccaaaaaactcagcgagaaaaaacgcgacgcgcttgccgaaatgataaaaaatcaggcggttgagtggcacgttgccgccgcctcgcccgaagaaatcgccagcctcaacatcctgcacgccaccatgctcgcgatgaaacgcgccgttgacggcttggctgtgcgtcccgaaaaaatattcatcgacggcaaccgcattcctgaacatttgaacatccctgccgaagccgtcgtcaaaggcgacagcaaaatcatcgaaatctccgccgcatccgttttggcaaagaccgcacgcgatgcggaaatgtacgcactggcgcaacgccatccccaatacggtttcgacaaacacaaaggttacggcacgaagcagcatttggaagccctcgaaaaatacggcgtgctgcccgaacaccgccgcgacttcgcccccgtcagaaacctgctcgcgcagcaggccttgttttaa

SEQ ID NO: 4249 - DNA, 1896 bp, Neisseria meningitidis
atgacccacatgatttaccccaaaacctacgacgttatcgtcgtcggcggcggacacgccggcacggaagccgcactcgccgccgcccgtatgggcgcgcagacgcttttgctctcacacaatatcgaaacgctcggacaaatgtcgtgcaacccctctatcggcggcatcggcaaagggcatttggtgcgcgaactcgacgcgctcggcggcgcgatggcgttggcaaccgacaaatccggtatccagttccgccgcctgaacgccagcaaaggcgcggcagtgcgtgccacgcgcgcgcaggcggaccgcatcctgtacaaagccgccatccgcgaaatgttggaaaaccaagaaaacctcgaccttttccaacaagccgtcgaagacgtaacgctcgacggcgaacgcatcagcggcgtaattaccgcgatgggcgtggagtttaaagcacgcgccgtcgtgttgaccgcaggcacgtttttgtccggcaaaatccacatcggtttggaaaactacgaaggcggacgcgccggcgaccccgccgccaaatcgttgggcggacgtttgcgcgaattgaagctgccgcaaggccgtctgaaaaccggcacgccgccgcgtattgacggacgcacgattgacttctcccaactgaccgaacagcccggcgacacgcccgttcccgtcatgtccgtgcgcggcaacgccgatatgcacccgcgccaagtgtcctgctggattacgcataccaacacgcaaacccacgacatcatccgctcaggcttcgaccgcagcccgatgtttaccggcaaaatcgaaggcgtgggtccgcgttattgtccgtctatcgaagacaaaatcaaccgcttcgccgacaaagacagccaccagattttcctcgaacccgaaggtctgaccacgcacgaatactatcctaacggtatctccaccagcctgccgttcgacatccaaatcgcgctcgtccgcagtatgaaaggtttggaaaacgcccatatcctgcgccccggctacgccatcgaatacgactacttcgatccgcgcaacctcaaagcaagcctcgaaaccaaaaccattgccggattgtttttcgccgggcaaatcaacggtacgaccggctacgaagaagccgccgcgcaaggtttattggcaggcgcgaacgccgtgcaatatgtgcgcggacaagacccgctcctgctgcgccgcgaacaagcctacctcggcgtattggtggacgacctcatcaccaaaggcgtgaacgaaccctaccgaatgttcaccagccgcgccgaataccgcctgcaactcagggaagacaacgccgacatgcgcctgaccgaagacggctacaaaatcggcttggtgtccgaagcgcaatggcgcatgttcaacgaaaaacgcgaagccgtcgaacgcgaaatccaacgtttgaaaacaacgtggtacacgccgcaaaaactcgccgaaggcgaacaaatccgtgtgttcggacaaaaactcagccgcgaagccaacctgcacgacctcctgcgccgcccaaacctcgactacgccgcgctgatgacgctcgaaggcgcgatgccgtctgaaaacctctccgccgaagtcatcgaacaagtcgaaatccaagtcaaataccaaggctatatcgaccgccaaaacgaagaaatcgacagccgccgcgacatcgaaaccttaaaactgcccgacggcatcgattacggcaaagtcaaaggcttgtcggcagaagtgcagcaaaagctcaaccagcacaaacccgaaaccgtcggacaagccagccgcatttccggcgtaacccctgcggcagtggcattgctgatggtgcatttgaagcgcgggtttaaagacgcgaaataa

SEQ ID NO: 4250 - DNA, 1428 bp, Neisseria meningitidis
atgaacgagaactttaccgaatggctgcacggctgggtcggcgccatcaacgatccgatgtggtcatacttggtttatatgcttttgggtacggggcttttcttcaccgtaaccacgggctttgtccaattccgcctgttcgggcgcagcatcaaagaaatgctcggcggccgcaaacagggggacgaccctcacggcatcacgccgtttcaggcatttgtaaccggccttgccagccgcgtgggcgtgggcaatatcgcgggcgtggccatcgccatcaaagtcggcggaccgggcgcggtgttttggatgtgggtaaccgccttaatcggtatgagttcggcgtttgtcgaatcttcgctggcgcagctctttaaagtccgcgactacgacaaccaccatttccggggcggccctgcctactacatcactcaagggctggggcagaaatggctgggcgtgttgttcgccctgagcctgattttctgtttcggctttgtgtttgaagcggttcagaccaataccatcgccgataccgtcaaagcggcatggggttgggagcctcattatgtcggcgtcgccctggtgattttaaccgcgccgattatcttcggcggcatcaggcgcatatctaaagcggcggaaatcgtcgtccccctgatggcggttttgtacctctttatcgcgcttttcatcattttgaccaatattccgatgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttacggcgatttgagcggtgcggcgctgacgcaggcggcgattgtcagccaagtggggcaatggggcgcgggcttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcattatggcgtggatcaaccttgtcgccatcctgctgctctcgcccttggcgtttatgctgctgcgcgattacaccgccaagctgaaaatgggcaaagaccccgagttcaaactttccgaacatccgggcctgaaacgccgtatcaaatccgacgtttggtaa

SEQ ID NO: 4251 - DNA, 1008 bp, Neisseria meningitidis
ttgtttggagcaaacacgatgaaacagcctgtttttgccgttacttccggcgagcctgccggcatcggccccgatatttgtttggacttggcgtttgcacgcctgccctgccgctgcgcggtattgggcgacaaaaacctattgcgcgcgcgcgccgaagccttgggcaaaagcgtcgtcctgcgcgacttcgatccagaatcaggcggcgcggcatacggcgagctggaagtgctgcacatccctgccgtcgaagcggttgaggcgggcaaactcaatcccgccaacgccgcctatgtgctgcaacttttggacaccgcgctcgcaggcatttcagacggcattttcgacggcatcgttaccgcgccgctgcacaaaggcatcatcaacgacgcgcgcgcaagcacaggttttttcagcggacacaccgaatatctggcggaaaaaagcggcacggggcaggtcgtgatgatgcttgccggcaaaggcctgcgcgtcgccctcgtaacgacccacctgccgctgaaagacgttgccgccgccatcacgcaaccgctgattgaaagcgtcgcacgcattttgcatcacgacttaaaacacaaattcggcatcaaaaatcccaaaatccttgtcgccggacttaatccccacgccggcgaaggcggacacctcggacacgaagaaaccgacaccattatccctgcattggaaaacctgcgccgcgaagggataaaccttgccggcccgtatccggcggacacattgttccagccgtttatgctcgaaggtgcggatgccgtattggcgatgtaccacgaccaagggctgcccgtgttgaaataccacagcttcggacagggcgtgaacatcacgctcggcctgccctttatccgcacctccgtcgatcacggcaccgcgcttgatttggcggcaaccggcagggcggattccggcagcctgataactgccgtggagaccgccgtcgagatggcgcgcggcagcctttaa

SEQ ID NO: 4252 - DNA, 2760 bp, Neisseria meningitidis
atgaaaagaatgttatttaacgcaacgcaggccgaagagctgcgcgttgccatcgtcgacggacaaaacctgctggatttggacatcgaaacgctgggcaaagaacagcgcaaaggcaatatctacaaaggcatcattacccgcatcgagccgtcgctggaagcgtgtttcgtggattacggaaccgaccgccacggcttcttgccgtttaaagaagtctcccgctcatacttccaagactacgaaggcggacgcgcgcgcatccaagacgtgctcaaagaaggcatggaagtcatcgtccaagtcgaaaaagacgagcgcggcaacaaaggcgccgcgctgaccaccttcatcagcctcgccggacgctatctggtattgatgccgaacaacccgcgcggcggcggcgtatcccgccgtatcgaaggtgaagagcgtcaagagttgaaagccgccatggcggaactcgacattccgaacggcatgagcatcatcgcccgtaccgccggcatcggccgcagcgcggaagagttggaatgggacttgaactacctcaaacaactctggcaggcgattgaagaagcaggaaaagcgcatcacgacccctacctgctctttatggaaagctcgctgctgatccgagccatccgcgactatttccgccccgacatcggcgagattttggtggacaatcaagaagtttacgaccaagttgccgagttcatgagctacgtcatgccgggcaatataggccgtctgaaactctacgaagaccacacgccgctgttttcccgcttccaaatcgaacaccaaatcgaaagcgcgttttcgcgcagcgtcagcctgccctccggcggcgcgatcgtcatcgaccataccgaagccctcgtctccatcgacgtgaactccgcacgcgccactcgcggcgcagacattgaagacaccgcgttcaaaaccaatatggaagccgccgaagaagtcgcccgacaaatgcgcctgcgcgacttgggcggcttggtcgtcatcgacttcatcgacatggaaaaccccaaacaccagcgcgatgtggaaaacgtcctgcgcgacgcgctcaaaaaagaccgcgcccgcgtgcagatgggcaaactctcccgtttcggacttttagaattgagccgccaacgtttgaaaccggctttgggcgaaagcagccacgtcgcctgtccgcgctgcgccggcaccggcgtgattcggggcatcgaatccaccgccctgcacgttttacgcatcattcaagaagaagcgatgaaggacaacaccggagaagtgcgcgcacaagtgcccgtcgatgtcgccaccttcctgctgaacgaaaaacgcgccgagctgtttgcgatggaagagcgtttggatgtcaacgtcgtcctgattccgaacatccacctcgaaaatccgcactacgaaatcaaccgcatccgcaccgacgacgtagaagaagacggcgaaccgagctacaaacgcgtcgccgagccggaagaagacgaatccgccaaaccgttcggcggcgaaaaagccaaagccgcccgtcccgaacccgccgtcaaaggcgtgcgccacaccagccccgccccgactgccgcccccgagaaaaaaacctcttggtgggacagcttcaaagcatggctcaaacgcattttcggcggcagcgaaacccaagccgcgcccgctgccgaaacctccgaaaaacgcagcacggcaaaccgcagcggcagccgcgccaacaaccgccgccaaaacccgcgccgcagcaaacgcgaaggcagcaaagtagaagtccgcgaagtggcaggcaaaactgccggacaggaagcgcgtgccgacaaagccgaaacgcgcaacaacggcaaccgccgccgcaatgaacgcggcgaccgtgccgccgaacgcgccaacgaagcggaaatccaaagccgcaacgtacagcctgccgcaaccgttgcagatgccgcaccgtccgaaaccgaagtgcaaaccggaaaacgccgccgcaacggcagccgcagcgaacgcggccaaaccgcgccggaaaccgccaccgttgccgaaacaaccgttcagacagcggaaaacacgccgtccgaaccgcataccgcagaagacaaaggcagcaagcccaaatccgaacgcaaccgccgcgaacgcgacagccgagatgccaaagaacgccgcgagcgcaacaatcagcgcgaccgccgtcaaaacggcaaaaaacgcaatattccgtctgccgccaaaatcgagcagtacctgaatattcacgacaccgccgacaaagtccgttccgccgccgcgcacgttttcggcgaaaccgacgcaaacgcgccgattactgtcagcattgccgatccggttgcagaaagggatcttccgacagcatctcccgccgtttcaaacggcgacgcaccggtttatgatgcggcggaaaaaatccgccgtgccaccgccgccatcctgcccgaaggcgcgacaccgaaagccgaagcacaggaaatgccgtctgaaaccgcaacctttacggctgcggcggaacaggcacgggaaaccgcacaaaccggcggactcgtcctgatcgaaaccgaccctgccgcattgaaggcatgggcggcacaacccgaagtccaagccggacgcggtttgcgccgttccgaacagcccaagccgtctgaagtcgcaaccgtccctgccgaagaaatgatccaagtcgaaacccggcaaggctga

SEQ ID NO: 4253 - DNA, 288 bp, Neisseria meningitidis
atgcacgttccggagaaccgtgtgcggaagggtcggatacagaaggctataaagatcgatgcggcggtttgtctgccgcgttccgaacgctgcggtcggaaaaatgggggccggcttcttcttgttatcgtgatgcctgtgttttgggcggtttgcgtttgggacttgggcccggctgccgtcttacttccgcgccgaaacggcaaaatcaattcaaacttgattacgttctgcgcctgccggctgggaacaggcgcagggaaaatgctttgcggagtgcgtttttaa

SEQ ID NO: 4254 - DNA, 993 bp, Neisseria meningitidis
atgaaaacgcacgaaataagcaaagattcggtcagcttgataggggttgccgaacatgaggcgggtcaacgccttgataactatctgataaaaatcctcaagggtgttcccaagagccatatccaccgcattatccgcgccggcgaggtgcggttgaacaagaaacgctgcaaacccgacagccgtattgcggagggggatacggtgcggattccgcctgtgcgcgtggcggagaaggaaatgccgtctgaaaggcgtgccgccgtaccggcgcgtgcgtttgacgttgtttacgaagacgatgcgcttttggtcatcgacaaaccgtccggcgttgccgtccacggcggcagcggcgtgagtttcggcgttatcgaacagttgcgccgcgcccgtccggaggcgaagtatttggagttggttcatcgtttggacaaggatacgagcggcttgttgatggtggcgaagaaacgcagcgcgctcgtcaaacttcacgaagccatccgtaacgaccaccccaaaaaaatctaccttgcgctgggggtgggcaaactgccggacgacaatttccatgtcaaactgcccctgttcaaatataccggcgcacaaggcgaaaagatggtgcgcgtcagtgcggacgggcagtcggcgcatacggtgttccgtgtgttaagccgtttttcagacggcattttgcacggtgtcgggctgtcgcacctgactttggtgcgggcgacgttgaaaacggggcgcacgcaccaaatccgcgtccacctgcaatctcaaggctgtccgattgcgggcgacgaacgctacggcgattatcaggcgaaccgtcgtttgcagaagttgggtttgaagcggatgtttttgcacgcgtccgagctgcacttgaaccatccgctcacgggcgagccgctggtgttgaaggcggagctgccgccggacttggcgcagtttgcggtgatgttggaaaacgggacgaaaatgtga

SEQ ID NO: 4255 - DNA, 1173 bp, Neisseria meningitidis
atgtggggacagacgaatatggctgataaaaaaagccctttgattgccgtcagtgtcggcgaagcgtcgggcgacctattgggggcgcacctgatacgcgccatccgcaagcgttgtccgcaggcgcggtttaccggtatcggcggcgaactgatgaaggcggaaggtttcgagagcctttatgatcaggagcggctggcggtgcgcggctttgtcgaagtggtcaggcggctgccggaaattttacggatacgcagggggctggtacgggatttgctgtcgttgaaacctgatgtctttgtcggtatcgatgcgcccgattttaatttgggtgtggcggaaaagctgaaacggtcggggattccgaccgtgcattatgtcagcccgtcggtgtgggcgtggcggcgggaacgtgtgggcaaaatcgtgcatcaggtcaaccgcgtgttgtgcctgttcccgatggagccgcagctttatctcgatgcgggcggacgtgcggagtttgtcggtcatccgatggcgcagcttatgcccttggaagacgaccgtgaaacggcgcggcaaactttgggcgtggatgccggcatccccgtattcgccctgctgcccggcagccgcgtcagcgaaatcgactatatggcgccggtgttttttcagacggcattattgttgttggaacgctatcccgccgcacgcttcctgctgcctgccgcaacggaggcgacgaagcggcgtttggcggaagttttgcagcggccggagtttgccggattgccgctgacggtaatcgacagacagtctgaaacagtgtgcagggcggcggatgcggtgctggtaacgagcggtacggcaactttggaggtggcgttgtgtaagcgtccgatggtcatcagctacaagatttcgccgctgacctatgcttatgtgaaacgcaaaatcaaagtgccgcatgtcggcctgccgaatatcctgttgggtaaggaggctgtgccggaattattgcaatctgaagcaaaaccggaaaaactggcggcggcgttggcggactggtacgaacaccccgataaggttgccgcgctgcaacaggatttcagggcgttgcacctgctgttgaaaaaagatacggcggatttggccgcgcgcgcggttttggaagaggcgggatgttga

SEQ ID NO: 4256 - DNA, 390 bp, Neisseria meningitidis
atgaatgtgaagataaaatataatcttttagaatattgtgaatatttaggtggtatttttggtgtttataaaaattatttaaatatggatatcaaagatccaaatttaaaaattagattttttgattttttggaagaacttttatcagatggtgttattgaattatgcgattatcgtgaaaatcctccaaaaatattaactggttcgccaaaaacacaggtagatgaattaagaagaatttggccggatatggaagagatgttgctatattttccagataatccttggttttatgtagaacatttttggtggggagcaacttgccctattgaactgacacaattgcctaaaatagaaatttacgaagaacaaatgaaacaaggtaagtaa

SEQ ID NO: 4257 - DNA, 411 bp, Neisseria meningitidis
atgacaacttataccattccaaaaaaagattatcaatttctgtatatatatgagggcactctattaaactatactttgaaaaacgatgaattccatatcatcgtccagaatgtggattatccggactttcctcaagagattcctacaccaaattatacagactgggtaaaaattaaattcaagcagttcagctatctgaaatttatctatggatacgccacgaagaaccaagataaaaatatcaaaaatgtattggaacttggagaattaaagcaggatgatgaaatcttggattatggaggtgcgctggaagtgataggcagtaggtatgatcttccgaccggttttagtatagatatagtttgccgggaaatagagttagaatttttagatcaggagagtttcaattaa

SEQ ID NO: 4258 - DNA, 174 bp, Neisseria meningitidis
atgctgagcaggcaactttatcgtatttccttttcggttgaaaccccgccactcggacatctgtccttcggggcggtagaatcagattttatttgggaggggcgtaaccccttccgaatcagggcaacacatagggcgacgctttatgtgtcgtcctgtgtgttgaaacattga

SEQ ID NO: 4259 - DNA, 810 bp, Neisseria meningitidis
atgacaccgctcaaaatcgccatcgccggcgcaaacggccgtatgggacgcgtattggttgaagccgtcaacaaccatcccgacaccgtcctttccggtgcgcttgaacactcaggctcagaagccctcgggctggacgcaggctacgccgtcggactcaaaaccggcatcgccatttcagacgacgttgacgccgttctcgcacaaagcgacgtactcatcgacttcacccgccccgagcccaccctcaaacacctgcaaaaatgcgttgaaaaacaagtcaacatcatcatcggcacaacaggcttcgacgatacgggcaaagccgctatccacactgccgccgaaaaaacaggcatcgttttcgccgccaacttcagcgtcggcgtcaacctcaccttccacatcctcgacaccgtcgcacgcgtattaaacgaaggctacgacatcgaaatcattgaaggccaccaccgccacaaagtcgatgcccccagcggcaccgcgttacgcatgggcgaagtcatcgccggcgcgctcggcagagacctcaaacaatgcgccgtttacggccgcgaaggccacaccggtccgcgcgatccgtcgaccatcggctttgccaccgtccgcgcaggcgacatcgtcggcgaccacaccgccctcttcgccaccgacggcgagcgcgtggaaatcacccacaaggccagcagccgcatgacctttgccgccggtgccgtccgcgccgcagtttgggtcaacggcaaaacgggtttgtacgatatgcaggacgtactcgggctgaacaaccgttaa

SEQ ID NO: 4260 - DNA, 378 bp, Neisseria meningitidis
gtgaacaaaaccctcatcctcgccctttccgccctcctcggccttgccgcgtgcagtgccgaacgcgtttcactgttcccctcgtacaaactcaaaatcatacagggcaacgaactcgaaccgcgcgccgttgccgccctccgccccggcatgaccaaagaccaagtcctgctcctgctcggcagccccatactgcgcgacgcattccataccgaccgctgggactataccttcaacacctcccgcaacggcatcatcaaagaacgcagcaatctgaccgtctattttgaaaacggcgtactcgtccgcaccgaaggcgacgtcctgcaaaacgctgccgaagccctcaaagaccgccaaaacacagacaaaccataa

SEQ ID NO: 4261 - DNA, 435 bp, Neisseria meningitidis
atggaaaaattcaacaatattgcacaactgaaagacagcggtctgaaggttaccggcccgcgtttgaagattttggatttgttcgagacgcatgcggaagagcatttgagtgcggaagatgtgtaccgcattttgttggaagagggtgtggaaatcggtgtggcgacgatttaccgtgtgctgacccagtttgagcaggcgggcattttgcaacgccatcattttgaaacgggcaaggcggtttatgagttggacaaaggcgaccaccatgaccacatcgtctgcgtgaagtgcggcgaggtaacggaattccacaatcccgaaatcgaagccctgcaagacaaaatcgcggaagaaaacggctaccgcatcgtcgatcacgcgctttatatgtacggcgtgtgcagcgactgtcaggccaagggcaaacgttaa

SEQ ID NO: 4262 - DNA, 726 bp, Neisseria meningitidis
atgcgtattccgctgcttgcccctgacaattatgcctttcccgatcctgcctatgctttggcccggtgcgacgggctggtcggcgtgagcggcgatttggatgcggggcggctgcttgaggcgtatcggaacggcgtgtttccgtggttttcccgggacgggtggtttttttggtatgcggtcgggccccgtgcggtggtgtttcccgacaggctgcatattccgcgctcgctggcgaaaacgctgcgcaacggcagctatcgggttgcggtcaacggctgttttgcggaagtggtcgcgcattgtgcggcagcggcgcgcccgaatcaggacggaacttggattgcgcccgagtttcagacggcatatttgaagctgcacgaaatggggtacgcgcattctttcgagtgccattatcccgatgaaagcggtgaaacgaggttggcgggcggcttttacggcgttcagatcggcagggtgttttatggcgaatcgatgttcgcattacaaccggatgcgtcgaaaatcgcgtttgcctgcgccgtgccgtttttggcggatttgggcgtggaactgatagactgccagcaggatacggaacatatgcgccgtttcggttcggagctgctgccgtttgcggattttgccgaacgtctgcggatgttgaacgccgtgccgttgaaagaggaaatcgggcggcgcgaagtggcgtgcaaggggctttga

SEQ ID NO: 4263 - DNA, 1032 bp, Neisseria meningitidis
atgggcatcaaagtcgccatcaacggctacggacgcatcggccgccaggttttgcgcgccatctacgattatcagattcaagaccaactccaaatcgtcgccgtcaacgccagcggcagccttgaaaccaacgcccatctgaccaaattcgacaccgtgcacggacgctttgaagccgacgtatcccacgacggcggcaacctcatcgtcaacggcgacaaaatccccttcttctcgacccgcaaccctgccgaactgccgtggaaagaactcggtgtcgatttggtcatggaatgcaccggcgcgttcaccagcaaagaaaaagccaaaatccacctcgaaagcggcgcgaaaaaagtcctcatttccgcaccgggcggcgacgatgtcgatgcaaccgtcgtgtacggcgtgaacgacagcgtcctgaccgccgacatgaccgtcgtttccaacgcttcctgcaccaccaactgcctctcgccggttgccaaagtgttgagcgaaagcgtcggcatcgtcaaaggcgcgatgaccaccatccacgcgctgaccaacgaccaaaccgttaccgacgtgcgccacaaagacctgcgccgcgcccgcagcggcgtggaaaacatgattccgaccaaaaccggcgcggcaaaagccgtcggtttggtactgcccgaattgaaaggcaggctcgacgggcttgccatccgcgtgccgaccgtcaacgtatcattggtagatttgagcttccaagccgcgcgcgacaccacagtcgaagaaatcaacgcactgatgaaagccgcctcggaagcaggcccgctcaaaggcgttttgggctacaacaccctgcccttggtttccatggacttcaaccacactaccgaagccagccacttcgacgcaacactgaccaaagtcgttgacggcaacatggtcaaagtgttcgcttggtatgacaacgaatggggcttcagctgccaaatgctgaacaccgcacgccgtatgttcggacttgaagtgcgcccgctcaaataa

SEQ ID NO: 4264 - DNA, 840 bp, Neisseria meningitidis
atgaccgccacagccgccgccatagaccgcctgcttccccaaacccaatgccgcgaatgcggctacgacggctgcctgccctacgcacaggcagtcgcaacaggcgaagcgtacaacctctgcgccccgggcggagaaaccgtcattcgggacatttccgccctgctcggcaaaccctttgtcgcacctgccaaaacccaagccaaagcactcgcccggatagacgaaaccgcctgtatcggctgcaccgcctgcatccgcgcctgccctgccgatgccattatgggcgcgggcaaacttatgcacaccgtcatcgccgacgaatgcaccggctgcggactctgcgtcgccccctgccccgtcgactgcatccatatgcagcccgttgccgacaccgtcctgccccgcgcgcgccgcttcagcctgtccgccgacagccgttttgccgccgccgaacacgcgcgcacgcgctacctcaaacgcaacgaacgcaaacagcgcgaagccgacgaacgcaaggccatgcttgccgaacgcgaagccgccgtccgcaacgcgcgtccgcaaacgcccgacacaccgaaaaaaccgacgtttaaccctgccgacctcatcgccaaagccatggcaaaagcgcaaacccaacaagaccgcctcgccgccgccgacaaccgcaaagactatcaggcgaaacagatagccgaagcccgcgaacgcgccgagttgcgccgcgcccaacgcgatatgaaatacggcagcgacagcgaaaaagccgccgccctcgaatatctcaaacaatacaaagccaaacaggaagccgcacagaataccgcctcctga

SEQ ID NO: 4265 - DNA, 1977 bp, Neisseria meningitidis
atgaacgaattttcgcttgcccctattgtgattgttttgctggtgtcggtcattacggtgatcctgtgccgcaagttcaacattccctccatgctgggctacctgctggtgggctttttggcggggcccggtatgctcagcctgattccgaaaagccatgcgacggattatttgggcgaaatcgggattgtgttcctgatgttcagcatcggtttggagttctcgctgcccaagttgagggcgatgaggcggctggtgttcggtctgggcggtttgcaggtcggcattacgatgctgtcggtaatgggcatactgatgctgacgggcgtgccgttcaattgggcgtttgccgtgtcgggcgcgttggcgatgtcgtccacggcgattgtgagccggattttgtcggaaaagacggaattggggcagccgcacggtcagatggcgatgggcgtgctgctgatgcaggacatcgccgtcgtgccgctgatgattctgattcccgcgctggcgggcggaggggacggaaatatttgggcggccttgggtttggcgtttgcaaaaatgctgctgacgctggggctgctgtttttcgtcggcagcaaaattatgtcgcgatggttcaggatggtggcaaaacgcaaatcgtccgaactctttatgatcaatgtgctgctggtaaccttgggtgtggcttatctgactgagctggaaggtttgtctatggcgttgggcgcattcgttgccggcatgctgctttcggaaacggaataccgtttccaagtcgaagacgacatccgcccgttccgcgatattttgctcggctttttctttatcacggtcggcatgaagctggacattcaggcattgatcggcggctggcggcaggtattgatgctgttggcaatgctgctggtgttgaaggcactggttgtgtttgccattgccttcaaaatgaaacattcggtcggcgacagcctcaaaacggctttgtatctcgcgcagggcggcgagttcggcttcgtgatgctggccattgccgggcagcttgatatggtttcgccagaatgggaacaggcggcgacggcggcggttctgctgtcgatgattatcgcgcccttcctcttgggcggcagcgatgcgctggtcgggcgtttggtcaagtcaagctgggacatgaagtcgctcgatctgcacagtatgctggtagaaaccatgagcaagtccgaccatgtgctgattgtcggcttcggcaggggcgggcagacggtcggacgcgtccttgcccaagaggatattccgtatttcgcgctcgacttggacattgcgcgggtgcaggttgccagaagtgcgggcgaaccggtgtcgttcggcgatgcgaaacgcagggaagtattggaagccgccggtctgggacgggcgaaaatggtggtggttacgctcaacaatatgcacgaaacgcaacacgttttagacaatgtgctgtccatgtatcccaatatgcccgtatatgtgcgcgccaccaacgacgattatgtgaaaacgtttaccgatataggtgcggaagaagccgtgtcggacaccaaagaaaccggactcgtgctggcaggctatgcaatgttaggcaacggcgcgtcgtatcggcacgtctatcagacgatggcaaatatccgccacagccgttatgccgcgttggagggactgtttgtcggtagtgatgatgaggcaggattcggcgaaaacggcgaaaccgtccgtcacgcctttcctttggctgcagaagcatacgccgtcggcaaaacagtcggcacgcttccgatggcggcttacggcatcaaactcttgttcgtccgccgccgcaccggccggattgaaaacccggatgcctcgtttacattggaaggcggtgacgtgttggtggtcgcaggcaaaaaagaagaaattatctcttttgaaaactggagtttgcagggaatataa

SEQ ID NO: 4266 - DNA, 323 bp, Neisseria meningitidis
gcgcggacttgctcaaaatcgcatgtgattccggtatttgaggctttgattagggatgcggactttcaatatattttctcagctacaacaacgaaggcttgatgtctgtcgggcaggtaagggagatttttgagcgtttcggcaaatataatttggttcaaacggaataccggcgttttaaggcagataagacagaaaaccgtaatcataaggcaaattcgatattcgaatttctgcatattttagaaaagaccttttatagtggattaacaaaaaccagtacagcgttgcctcgccttagctcaaagagaacgattctctaa

SEQ ID NO: 4267 - DNA, 1386 bp, Neisseria meningitidis
atgatcagcattttcgatattttcaaaatcggtatcgggccttccagttcgcatacggtcggcccgatgaaggcagccgccgcctttgcggcaggtttggatgcacaggctgttcgcatcgtcatcgacatttacggctcgctcgcactgaccggatacggacacggtacatttgacgcgctgatgctcggtttggaaggcagcctgccgcacgacatcccgcttgccggcattcccgaacgcctcgaacgcatccgcacgcagcacatcctccggctcaacgggcaagaaatccgcttcatccccgaccgcgacctgaacatactcggcaatcaagtgctgcccaaacaccccaacagcctgcgttttaccgcctatgcttcagacggcacggtattgaatgaacaggtttattattcggtcggcggcggctttgtcgttaccgaagaagattttgaccggcaggcggaaacggaaaaagccgttccctatccctataccagttgcgccgaactgcttgcccgatgccgtctgaaccggctcgacatctccgaagtcgtgttggcaaacgaagccgcgcttgccggatgcggcgaagccgaaatccgccgccgcgccgctgccgttgccgaggttatggaaggctgcatcaaacgcggcttgggtgcggacggcgaactgcccagcggattgaacgtccgccgccgcgccccgcagcttgccgccaagctcaaagtcctgcgcgaaaccgaaatcgtcaacacccagctctggccgatggtgtacgccatggcggtcaacgaagaaaacgccgccggcggacgcgtcgttaccgcaccgaccaacggcgcggcaggcatcattcccgccgtattgcactatttccgcaagttcaatccgcacgccacacaggaacgcgtcgaaaacttcctgctcaccgcaggcgcaatcggcatcctctacaagaccaacgcctccatttccggtgcggatgtcggctgtcagggcgaagtcggcgtagcgtgttcgatggcggcgggcgcatacgccgaagtcatcggcggcacgcccaaacaagtggaaaacgccgccgaaatggcgatggaacaccatttggggctgacttgcgaccccgtcggcggactggtgcaaatcccctgcatcgagcgcaacggcatcgccgccgaaaaagccctcaaactcggcacgctcgcgcttttggaagacggcacggacaaaaaagtctcgctcgacgaagtcatccgaaccatgctgcaaaccggccgggatatgaaggcgacctacaaagaaacctcgcttgccggactcgccgccacgctccggaaaaaagccgtccccgtatccgtgcgcgtggtcgagtgctga

SEQ ID NO: 4268 - DNA, 2391 bp, Neisseria meningitidis
atgactgaacaaaaacacgaagaatacggcgccgacagcattcaggtgctcgaaggcttggaagcggtacgcaaacgccccggcatgtacatcggcgacacgcaggacggcagcggtctgcaccacatggtgttcgaagtattggacaacgccattgacgaagcactcgccggacattgcgacaaaatcacggtaacgatacacgccgaccattccgtcagcgtcgccgacaacgggcgcggtatgcccaccggcatccacccgaaagaaggacgctccgccgccgaagtcatcatgaccgtattgcacgcgggcggtaaattcgacaacaacagctacaaaatctccggcggcctgcacggcgtgggcgtgtccgtcgtcaacgcgctgtccgactgggtaacgctgaccatctaccgcgacggcaaagaacacttcgtccgcttcgtgcgcggcgaaaccgaagagccgctgaaaattgtcggcgattccgataaaaaaggcacgaccgtgcgcttcctcgccagtacggaaaccttcggcaacgtcgaatacagcttcgacatccttgccaaacgcatccgcgaactttccttcctgaacaacggcgtggacatcgaattgaccgacgagcgcgacggcaaacacgaaagcttcgccctttccggcggcgtggcgggtttcgtgcaatacatgaaccgcaaaaaaacgccgttgcacgaaaaaatcttctacgcgttcggcgaaaaagacggcatgagcgtcgaatgcgcgatgcaatggaatgacagctatcaagaaagcgtgcagtgtttcaccaacaacatcccgcaacgtgatggcggtactcacctgaccgcactgcgccaagtgatgacccgcaccatcaacaactatatcgaagccaacgaagtcgccaaaaaagccaaagtggaaaccgcaggcgacgatatgcgcgagggtttgacctgcgtgttgtccgtcaaactgcccgaccccaaattctcgtcccaaaccaaagacaaactggtttccggcgaaatcggccccgttgtcaacgaagtcatcagccaagccctgaccgacttcctcgaagaaaatccgaacgaagccaaaatcatcaccggcaaaatcgtcgatgccgcccgcgcgcgcgaagccgcccgcaaagcacgcgaaatcacccgccgcaaaggcgtgatggacggcttgggactgcccggcaaactcgccgactgccaagaaaaagaccctgccctgtccgaactctacctcgtcgagggcgactccgcaggcggttccgccatgcaaggccgcgaccgcaaattccaagcgattttgccgctcaaaggtaaaattttgaacgtcgaaaaagcacgttttgaaaaaatgctggccagccaagaagtcgccacgctgattaccgctttgggcgcgggcatcggcaaagaagaattcaatgccgaaaaactgcgttaccaccgcatcatcatcatgaccgatgccgacgtggacggcgcgcacatccgcaccctgctcctgaccttcttctaccgccaaatgcccgagctggtcgagcgcggctacatctatatcgcccagccgcctttgtataaagcgaaatacggcaaacaggaacgttacctcaaggacgagttggaaaaagaccaatggctgctcggtcttgccttggaaaaagccaaaatcatttcagacggccgcaccatcgaaggcgcagaacttgccgacaccgccaaacaattcctgttggcaaaaaccgtcatcgaacaggaaagccgcttcgtagacgaactcgtcctgcgcgccatgctacacgcgtcgcccattgatttgacgtcgtctgaaaacgccgataaagccgttgccgaactttccggtctgcttgacgaaaaagaagtcgccctcgaacgcatcgaaggtcatgaaggacaccggttcatcaaaatcacgcgcaagctgcacggcaacgtcatggtcagctacatcgaacccaagttcctcaacagcaaagcctaccaaaccctcacccaaaccgccgccgcgctcaaaggcatggtcggcgagggtgccaagctttacaaaggcgaaaacgggtacgacgcggacagctttgaaaccgctttggacatcttgatgagcgttgcccaaaaaggtatgtccatccaacgatacaaaggcttgggcgagatgaaccccgagcagctgtgggaaaccacgatggatcccgccgtgcgccgcctgttgaaagtgcgcatcgaagatgccattgccgccgacgaagtgttcgttacgctgatgggcgacgaggtcgagccgcgccgtgcctttatcgaaaacaacgcgctgattgcccaaaatatcgacgcataa

SEQ ID NO: 4269 - DNA, 987 bp, Neisseria meningitidis
atgaaacggtacgtttgcctccggcatcaggtcggggattgtcccgtaaagtggcaaaagcgtttttttgccactaaaatctacaccctatacttttcggacaggggcgcggaaatggaaatatggaatatgttggacacttggctcggtgccgtcccgatacgtgcggaggcggtcgaatccgtggcggcggttgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagtattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccatccaacggcatttggaaaacgtgcaggcggaaaaactgtttatcacgcccgccgccagaccgcgcgttacccgcgtgccgtacgatgacaaggcataccgcatcatcgtccgcttcgcttcccccgtttcaaagcggctggaaatccaacaggcggttatggacgaatttttgcgcgtacaataccgcctgttaaatcaccccgccggctccgaaacactttaa

SEQ ID NO: 4270 - DNA, 2037 bp, Neisseria meningitidis; identical to SEQ ID NO: 1471

SEQ ID NO: 4271 - DNA, 567 bp, Neisseria meningitidis
atgggtttttatgctttgctcttgattgctctggggatgtcgatggatgcgtttgccgtcgcattggcaaagggtgcggcggtcagaatgcctccgcgcaaaattgcggcaacggctttggtgttcggcacggttgaagcgctcacgccgctggcaggctgggtaggcggtttttatgccaagccgtttatcagcgaatgggaccattgggtggctttcgtcctgctgggcgggctgggtctgaaaatgatgcgcgaagggctgtccggcgaggcggaagatgtgcgcgaaagcaaacgggaaagcctatggatgacggttttgactgcttttggaaccagtattgattccatgatagtcggggtgggcttggcgtttatggaggtaaacatcgcctttgccgccgcaatcatcggtatggcgacgacggtgatggtggcggtcgggctgacggcgggaagggctttgggcgtattgttcggcaggtgtgcggaatttgccggaggtttggtgttgattgccatcggcacatggacgctcttgtcgcatttgggtttgattcaatga

SEQ ID NO: 4272 - DNA, 1515 bp, Neisseria meningitidis
atgactacctccaaatgccctgtaacccatctgaccatgaacaacggcgcgcctgttgccgacaatcaaaacagcctgaccgccggtcctcgcggccctctgctggcgcaggatttgtggctgaatgaaaaactcgccgacttcgtgcgcgaagtcatccccgaacgccgtatgcacgccaaaggttcgggcgcgttcggtacgtttaccgtaacgcacgacatcaccaaatacacccgcgccaaaatcttcagcgaagtcggcaaaaaaaccgagatgttcgcccgtttcaccaccgtggcaggcgaacgcggcgcagccgatgcagaacgcgacatccgcggttttgccttgaaattttataccgaagaaggcaactgggatgtggtcggcaacaacacgcccgtgttcttcctgcgcgacccgcgtaagttccccgacctgaacaaagccgtcaaacgcgacccgcgcaccaatatgcgctctgccacaaacaactgggacttctggacgctgctgcccgaagcactgcaccaagttaccatcgtgatgagcgaccgcggcatccccgccggctaccgccatatgcacggcttcggttcgcatacctacagcttctggaacgaagcaggcgagcgtttttgggtgaaattccatttccgcacccaacaaggcattaaaaacctgaccaacgaagaagccgccaaaatcatcgccgacgaccgcgaaagccatcagcgcgacttatacgaagccatcgaacgcggcgagtttccgaaatggacgatgtacatccaagtcatgcctgaagcagacgcggaaaaagtaccttatcatccgtttgacttgaccaaagtttggccgaaaaaagactatccgctgattgaagtgggcgaattcgagttgaaccgcaatcccgaaaacttcttcgccgatgtggaacaatccgccttcgcaccgagcaacctcgttcccggtgtcggcgccagcccagataaaatgctgcaagcgcgtttgttcaattacgccgacgcacaacgctaccgtttgggcgtaaacttccgccaaattcccgtcaatcgtccgcgttgccctgttcacagcaaccagcgcgacgggcaaggccgcgccgacggcaactacggcagcctgccgcactacgaacccaacagcttcggccaatggcagcaacaacccgacttcgccgaaccgcctttgaaaatcaacggcgacgcggcacactgggactaccgccaagacgatgacgactatttcagccaaccgcgcgccctgttcaacctgatgaacgacgcgcagaaacaggcattgttcggcaacaccgccgccgcaatgggcgacgcgcccgacttcatcaaataccgccatatccgcaactgctaccgttgcgacccggcatacggcgaaggcgtggccaaagcccttggactgactgtcgaagatgcccaagccgcccgcgcgaccgatcccgcactgggtcaggctggtttgctgtaa

SEQ ID NO: 4273 - DNA, 852 bp, Neisseria meningitidis
atgaccttactcggaataaagctcaaacagacccagcagctcaaccagcggctgcaacaatctttgcgcgtattgcagatgtcgggtatcgaacttgaacgcgaggtcgaaaactggctgtcggacaaccccctgctcgaacgcaaagacacggatgaattttccgatgccgagttcagccattacactgcgcctgcccgtcaaatcggcggagacgaaggcgaagatatgctgtccaacatcgccggcgagcaggatttcaagcaatacctgcacgcgcaagtatgcgaacacccgctttccgaccaagaagccgcctgtgtccacatccttatcgatttccttgacgagcagggttatctgaccgacagcatcgaagacatcctcgaccatacgcccttagagtggatgttggatgaagcaatgctgcaacacgcgctgaccgcattgaaaaaattcgacccggcaggcgtggccgccgccgatttgaacgaatcgctgatactgcagatagaaagattgggcgaatgtgctgccaaacccgccgccctgcatatcgtccgaaacgccctcgacagcattgacggcaaccgcagccaaaccctcgcacgaataaaaaaacacctgccccaaaccgacagcggcacactcgaagccgcactcgacctcattgcttcgctcaatccctttcccgccgccggttttgcctcgtccacgcccacgccgtattctgacgaggcgctcgccaacctgctggctttccgcggcatggaggtttctcgccgcaccattgccaaatacagagaatcctttgagattccggcagcacacaaacgcaaaaccgcagaataa

SEQ ID NO: 4274 - DNA, 1131 bp, Neisseria meningitidis
atgaaaatcgtttttatcacaacagtcgcatccagcatttacggtttccgcgcccccgtcattaaaaaattaatcggcaaaaaccatcaggtgtatgcctttgtatcggagttttccgacaatgaattggatattatcagggaaatgggggttacacccgttacctaccgttcaaaccgcagcgggctgaacccgttttcggatataaaatccaccttcctcatctttaaagaactcaaaaaaatatcgccggatttggttttcccttatttcgcaaaacccgtgattttcggcacttttgccgcaaaactggcaggcgtgcccagaatcgtcgggatgctggaaggtttgggattcgcatttaccccgcagccggaaggcataccgttaaaaacaaaaatcataaaggggattttgattgccttataccgcattgccctgccgatgttggaaagcctgattgtattaaaccccgacgacaaagacgaactgacggacaaatacggcatcaaaataaaaaacatccatattttgggcggaatcggtctggatttgcggcaatatccttattccgaggcggatattcccgatgaaaaagaacccgtaaaattcctctttatcggcagatttctgaaagaaaaggggattgatgattttattcgggcggcggaacaggttaaggacaaataccccgatacggtttttaccgctttgggcgcaatcgacaaatcacgcgggggggggggcgatttggaacggcttgccgcccgcgatattatccgtttccccggttttgtgaacaatgtttccgaagtgataaaagaacatcatatattcgtattgccgtcttattatagggaaggcgttccccgaagcactcaggaggcaatggccgtcggcagggcagtgattacgacggatgtccccggatgcagggaaacggtcgccgacaaggtcaacggcttcctgatcgagccttggaatccccgcatcttggccgaaaaaatgatttattttatcgaaaacagggaagccgtccgcctgatggggaatgcaagttatgcgattgccaaagataaattcgatgccgaaaaagtcgatttgaaattgctcgatattttgaaggcgtaa

SEQ ID NO: 4275 - DNA, 1248 bp, Neisseria meningitidis
atgagtcagagaagagtagtcattacaggcttaggtcaggtttcccctgtcggcaacactgtcgcagaggcttgggacaccctgctcaccggcaaaagcggcatcggcgcgattacccgctttgacacatccgacatcaacagccgtgtcgccggcgaggtgcgcggtttcgacatcggacaatacatcagcgcgaaagaagcgcgccggatggacgtattcatccactacggcattgccgccgcattgcaggcaatcgccgattcgggtttggacgatgtggaaaacctcgacaaagaccgcatcggcgtgaacatcggttccggcatcggcggactgcccggcatcgaggtcaccggcaaagccgtaatcgaaggcggcgcgcgcaaaatcaaccctttctttatccccggttctctgattaatctgatttccggacacgttaccatcctcaaaggctaccgcggcccgagctacgggatggtttccgcctgcaccaccggcgcgcacgccatcggcgattccctccgtatgattaaatacggcgacgcggacataatggttgccggcggcgcggaaggcgcaatcagcactttgggcgtgggcggttttgccgcgatgaaagccctctccacccgcaacgacgaccccgccaccgcttcccgtccgtgggacaaaggccgcgacggcttcgttatcggcgaaggcgcgggcatattggtgttggaagaattggaacacgccaaaaaacgcggcgcgaaaatctacgccgaaatcgtcggcttcggcatgagttccgatgcttaccatatcaccgcgccgaacgaagaaggccccgcccttgccgttacccgcgcgctgaaagatgccggcatcaatcccgaagacgtggattacgtcaacgcgcacggcacgtccacccccttgggcgatgccaacgaaaccaaagccctcaaacgcgcgttcggcgaacacgcctacaaaaccgtcgtcagctcgaccaaatccatgaccggccacctgctcggcgcggcgggcggcgtggaggccgtgtacagcattttggcgatacacgacggcaaaatcccgccgaccatcaacatttttgaacaagacgttgaagccggctgcgatttggactactgcgccaacgaagcgcgcgacgcggaaatcgacgttgccatttccaactccttcggcttcggcggcaccaacggcacgctggtcttcaaacgcttcaaaggctga

SEQ ID NO: 4276 - DNA, 237 bp, Neisseria meningitidis
atgtcaaacatcgaacaacaagttaaaaaaattgttgctgaacaactgggcgtaaacgaagccgacgtgaaaaacgaatcttccttccaagacgacttgggcgcggattctttggacaccgtggagctggttatggctttggaagaagcattcggctgcgaaatccccgacgaagatgccgaaaaaatcaccaccgtccaactggctatcgactacatcaatgcccacaacggctaa

SEQ ID NO: 4277 - DNA, 1008 bp, Neisseria meningitidis
atgtatccacttgcccgtcgcatcctgtttgcactcgatgccgaaaaagcccaccacttcacgctcgacgcgctctacacggtttataaattgggtttgattcctgtaaccgacaaccgtaccaaacctgtaaaattgatgggtatggatttgcccaaccctgtcggacttgccgccggactcgacaaaaacggcgaatacatcgacgcattgggcgcgctcggctttggtttcatcgaaatcggcacggtaacgcccaacccgcagcccggcaacccgcagccgcgcctctttcgcgttcccgaacaccaaggcatcatcaaccgcatgggtttcaacaaccacggtatcgacaccatgatacgcaacatcgaaaaaagtaaattcagtggcgtattgggcatcaacatcggtaaaaacgcggttacacccatcgaaaacgctgccgatgattatttaatctgccttgaaaaagcctacgcacacgcaagttacattaccgtcaatatttcctcgcccaacactaaaaacctccgcgcgctgcaaggtggcgacgagttgagcgcattgcttgaggctttgaaaaacaaacaggcacagcttgcctctgtacacgggaaatacgtcccgctcgccgtcaaaatcgcccccgatttggatgaagcacaaatcgaagacatcgcccacgttgtcaaatccgtcgaaatggacggcatcatcgctaccaataccaccatcgacaaatcaagtctcggcagccatccgctcgcaggcgagcagggcggtttgagcgggctgcccgttcatgaaaaaagtaatcgggtgttgaagctgttggcagaccacatagacggcaagctgccgattatcggcgtaggcggcattatggaaggcgaggactcggcagataaaatccgcttgggcgcgaccgccgtccaagtgtacagcggattgatatacaaaggtccggcattggtcaaagaatgtttgaaggctttggcgcgatga

SEQ ID NO: 4278 - DNA, 474 bp, Neisseria meningitidis
atgaaccttgatttaaccgcgcaaaaagtccgtctttcttggaaggatattctgtgggggtatgggaataaatacttgggttgggctgatgtggcagcttatgcccgaaaaatgacgctttcagatcatgatgaacgtgtgttcaaactatctttaatcaacaaatccaatattcttgaattaaagcctgttctggaagatttggcttcggaaatgagggattattcccctaaaaattggctgtacgtcctcttaagcgatgtattccatagaaaagaagaatttgaggatcctttgggggaagttgaaaaaatttatgcagattttgattatccggaagaaatagaatcatttgtcaggtatatgccgcccaaagacggttatattccttctgcccacacctatgaagaaaatattgcccggttatattctcactgggaacactatttgaacaacggcggagggcagggttaa

SEQ ID NO: 4279 - DNA, 219 bp, Neisseria meningitidis
atgattatgggtttttggaatggtgtggcaaaagcagcaaaagcagtgggagagggaatgattgaagccggcaatgagcataaggcgttgaaaatggaatatgcggagaaatcaagtgaggagctgcatgaaatcgtcaagagtgatggtttttttaaaaattccacacgggagaaaagtgcggcttatgctattttaaaagagcgtggcgaggtgtga

SEQ ID NO: 4280 - DNA, 2691 bp, Neisseria meningitidis
atgtccgacaaccgcctcgacaccgcccgccgccattccctcttcctcgcccgccagctcgacaacggcaaactcaagcccgaaatattcctgcctatgctcgacaaggttttgaccgaagcggatttccaagcctttgccgactggggcgaaatccgcgcggaagaaaacgaggaagaattggcgcggcagttgcgcgagttgcgccgttatgtggtgtcgcagattatcgtgcgcgatatcaaccgtatcagcgatttgaacgaagtaacccgcacgattacgctgtttgccgattttgccgtcaataccgcgctggattttgcctacgcctattatcgggacatgtacggcacgccgatcgggcgttataccaaatcgccgcagcatttgagcgtggtggcgatgggcaaggcgggcggctatgagttgaacgtgtcttccgacatcgatttgattttcgtctatcccgaatcaggcgacaccgacggcaggcgcgaacggggcaatcaggaatttttcaccaaagtcgggcagaaactgattgcgctgctgaacgacattaccgccgatgggcaggtgttccgcgtcgatatgcggctgcggccggacggcgattcgggcgcgttggtattgagcgaaaccgcgctggagcaatatttgattacacaggggcgagaatgggaacgctacgcgtggtgcaaaggtcgcgtggttacgccgtatccgaacgacatcaaagcactggtgcgcccctttgtgttccgcaaatatctggattacggcgcgtatgaggcgatgcgtaagctgcaccgccaaatcagcagcgaagtcagcaaaaaaggcatggcggacaacatcaaactcggcgcgggcggcatccgcgaagtcgaatttatcgcccagattttccagatgatacgcggcggacaaatgcgcgcgctgcaactgaaaggcacgcaggaaacgctgaagaagcttgccgagctgggcatcatgctgtctgaacacgtcgaaaccctgcttgccgcctaccgcttcctgcgcgatgttgaacaccgcctgcaatactgggatgaccagcaaacccaaaccctgccgacctcgcccgaacagcggcaactgctcgccgaaagcatgggtttcgacagttattccgctttttcagacggtctcaatgttcatcggaacaaagtcaatcagttgttcaacgaaattttgagcgaacccgaagagcaaacgcaagacaacagcgaatggcaatgggcatggcaggacaaacccgacgaagaagggcggcgatgccgtctgaaggcgcacgggttcgatgccgaaaccgtcgccgcaaggctcgaccaaatccgccacggccataaataccgccatctttccgcacacgcccagccgcgtttcgatgcggttgtgccgctgttcgtacaggcggcggcagcgcaaagcaacccgaccgatacattgatgcggctgttggattttctcgaaaacatcagccgccgatccgcctatctcgccttcctcaacgaacatccgcaaaccttggcgcaactggcgcagattatgggccaaagttcttgggtggcggcgtatctgaacaaatatccgattttgttggacgaactcatcagcgcgcagcttttggataccgcgtttgattggcaggcgctcgccgccgccctttcagacgacctcaaagcctgcggcggcgatactgaagcgcaaatggacaccctgcgccgcttccagcacgcccaagtcttccgtctcgccgtccaagacctcgccggactgtggacggtagaatccctctccgaccaactctccgccctcgccgacaccatcctcgccgccgccctgctgtgcgcatgggcggacatgcccaaaaaacaccgcgacacaccgcaattcgccgtcgtcggctacggcaaactcggcggtaaagaactcggctacgcctccgacctcgacctcgtctatctctacgacgacccccaccccgacgcaggcgacgtgtacagccgcctcgcccgccgcctgaccaactggctttccgccgccactggcgcaggcagcctctacgaaaccgacctgcgcctgcgccctaatggcgacgccggtttcctcgcccacagcatcgccgcctttgaaaaataccagcgcgaaaacgcctggacgtgggaacaccaatcccttacccgcgcccgcttcatctgcggcacgtccgaaattcagacggccttcgaccgcatccgcaccgaaatcctcaccgccgaacgcgaccaaaccgccttggcaggcgaaatcatcgaaatgcgcgaaaaaatgttccccacccacccgcctgccgacagcaacgtcaaatacgcgcgcggtggcgtggtcgatgtcgaatttatcgtccaatatctgatacttgcccatgcccgccagtatccgcaactcttggacaactacggcaacatcgccctcttaaacatctccgccgactgcggtttgattgacaaaaccctcgccggacaaagccgcaccgcctatcgcttctaccgccggcagcagcacaacaccaaactgcgcgacgcggcaaaaaccgaagtaaccggcgaactgttggcacattacggcaatgtcaggaaattgtggcgggaagtgttcggcgaagaagcggcaaccgtctga

SEQ ID NO: 4281 - DNA, 966 bp, Neisseria meningitidis
atgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 4282 - DNA, 693 bp, Neisseria meningitidis
atgaaacgcttcacctatactctttccgacggtttgtgcatcgaaatcgaactcaaacgcagtgccaagaaaaatctgattctgcgccccgtcaatatgcagacggtcagcatcaacgtcccacccttttttcaagaccacgcgttagcaaactggctggcggcaaacgaaacgattttgcggaacacgcttgccaaaacgcccgtgcatcctgtttcccacccaaacttacccgagtggatttggtatcggggaataaagaccaagctggatacccacagccaaagccatatccgtatcacgtcgtctgaaatcctgcttccccgaaaagaaaccgccgcacaaatcgaccacctgcgccgcctgttgaacgaacgcgcccgcgaatacctgctgccccgccttgaaaaacacgcagccgaaacaggactgacgcccaccgccacagacctgagcaacgccaaaaccttttggggcgtatgccgcccgcacaccggcatccgcctcaactggcggctgatcggcacgcccgaatacgtcgccgactatgtctgcatccacgaactctgccacctccgccaccccgaccacagtccgcgcttttggcatttggtgaacacgctgacgccgcataccgacaatgctaaaagttggctgaaggcgcacgggcgggaattgtttgtgctggggtaa

SEQ ID NO: 4283 - DNA, 1194 bp, Neisseria meningitidis
atgtctgatcaaaaaaaccgcagaaatgccttaatcggcgctgcattcctgatggcgacttccgccatcggcccgggctttctgacccaaaccgccaccttcacccaagcactggcggcaagtttcggctttgtgattctgctctcgattctgctcgacatcggggcgcagctcaatatttggcggattgtcgccgtttccgaaaaacaggcgcaggatattgccaatcaggtcttgcccggcgcaggctatttcttggctgtgctgattgtgatgggcggtttggcgttcaatattggcaacgtcggcggcgcaggcttgggtctgaacctgctgaccggactgtcaccggaaaccggtgccgtgatcagcggcgtgattgccatcggtgtgtttctgtttaaagaagcaggcaaagtgatggacaaattcgcccaagtgatgggtttcgtaatgattgcgctgacggtttatgtggcatggcaggcgaatccgccgctggcagatgccgccgtgcatacctttatgccggaaaaactcgatgcaatggcgattgttacactggtgggcggcacggtcggcggctacatcaccttcgccggtgcgcaccgtctgctggacgcaggtatcaaaggcaaatcggcgttgccggaagtgagccaaagctcggtgcgggcgatcctgattgcctcgattatgcggattgtattgtttttggcggttttgggcgtggtcagccaaggcgtacagctcaatcccgacaaccctgcttccacaccgtttgaatatgcggcgggatacatcggcctgctgattttcggcgtggtgatttgggcggcttcgattacttcggtgattggtgcggcttatacttcggtgtcgttcttctccggtctcagcccgtctatcgaacgcaataaaaacaaatggattattgcctttatcgccgtgtccaccgccgtattttccaccatcggcaaaccggcgcaggtgctggtgttcgtaggcgcattaaacggcctgattttaccgatttccctcggtctgattctgattgccgcctacaaaaccaaaattgtcggcgactacaaacacccgctgtggctcaccgtttccggcgtgattgtggtcggtttgatggcagtactcagcgccatcaccatcagcaaatatatcggcggcttgttcggctga

SEQ ID NO: 4284 - DNA, 738 bp, Neisseria meningitidis
atgaagcaggttgatttaaacgccgatctcgccgaaggctgcggcagcgacgaagccttgttgcagctgattacttcggccaacatcgcctgcgcccaacacgccggcagcattgccgatattcgggcggcattggcgtatgcccaacaaaacggcgtgcgcatcggagcacaccccggctatcccgatcgggaaaacttcggccgtaccgaaatgaatctgtccgaagccgatttgcgggcgtgtctgaattaccagttgggcgcattgcaggccttgtgccgtgatcagggtttggaaatggcttatgtcaaaccgcacggcgcaatgtacaatcaagcggcgaaaaaccgtgcgctggcggataccgttgcccgaattgtggcggatttcgacccgaaattgaaattgatggcactttccggcagcctgctcttggaagccggaaaagccgcaggcttgggtgtgatttccgaagtattcgccgaccgccgctatatgcccgacggtacgctggttccccgcagccgccccgatgcgcaggtggacagcgacgaagaagccatcgcccaagtattgcagatggtgcgggacgggcaggtcaaagcagtggacggcagcctggttgccgtgcaagccgacagcatctgtctgcacggagacgggccgcacgccgtggtgtttgccgaaaaaatccggcaggaactactggcggcaggcatcaaagtttctgcttga

SEQ ID NO: 4285 - DNA, 929 bp, Neisseria meningitidis
atgattcacgtttcggcagtgcaggcaccggcgcatattcaggataccggacgctacggacaccggcgttacggcatcggtcatgccggtgcgatggacacggttgctttggcggcgggcaatattttattgggcaacgacgaaggcacggccgcaatcgaaatcgctttgggcgggataatgctggtgtttgaacgggatacgccgttttgtctcaccggtgccgtgtatcaggcggaattggacggcgaaccggtctattcgtattggcgttataccgcccgcaaagggcagaccttgaaactggtgcgtgccgtgcagggcatgtacggctatgtgtgcgtggcgggcggatttgatgtgccggaagtgatgggttcgagaagcaccgacctgaaagccggtttcggcggccatcagggcagaatgctgcaaaaaggcgattatctccccatcggcaaaggtgcgcaggaattgtccaaagtcggcattgccccgataccgtttaccgataccgtccaccttgttccttcgtcggaatatgccgctttcagtgaaaaagggcgtctgaatctggaacgggaaacgtggacgctgcaaagcgatagcaaccgcatgggctaccgcttcgacggacagccgctgaccctgtcgcaacctttggaaatgctgtcccacgctgttcaggcaggaaccgtgcaggtgccgcccggcggcaaaccgattatcctgctggccgatgcgcaaaccaccggcggttatccgaaaatcgctaccgttgccgccgccgatttgggcaggctggcacaggtgcgcttcggcagcaaagtcaaattcaaaataatcggcttgaaagaagccaccgccctgcggcgcaaaaacaagcctatctgaaccaaatacggagaatcacccatgaagcaggttga

SEQ ID NO: 4286 - DNA, 648 bp, Neisseria meningitidis
atgagaatagagatcacaccaatcagcgaatccgctttggtctaccgactgaatgcgccttccgaactgggcaaacagcaaaagttgtgggcgtttgccgctgcgctcgggcagcacgacaggattgaggaagtggtggtcggcatgaacaatctgaccgtgtttacccgtttcgataccgatttggcgacgcttgccgatgaattgcaatatgtgtgggaacacaccgccgttacagaccatcagggcaaactggtggaaattcccgtctgctacggcggcgaatacggcccggatttggcggaagtcgctgctttccatcagacggttatttccgaaatcgtccgccgccatacggcgcaaacttataccgtatttatgatgggcttccagcccggtttcccttatctgggcggcttgcccgaagcattgcacacgccccgccgtgccgtgccgagaacgtccgttcctgccggttcggtcggtatcggcggcagtcagaccggtgtgtatccgttcgcttcgcccggcggctggcagattatcggcagaaccgaattacccttgttccgagccgatttgaatccgccgaccctgctggcggcgggtgaccaagtccgctttgttgcagaaaggattgagccatga

SEQ ID NO: 4287 - DNA, 105 bp, Neisseria meningitidis
atgcgctattttaatagaaacggtttaaggtcgtctgaaaaagtgcagcggcagggcagcacttttccaatcgacggtttgatgatgcagcacagaagatattga

SEQ ID NO: 4288 - DNA, 2208 bp, Neisseria meningitidis
atgtttcccgaccaatccgcccccaacctgctgcaaggcttgaatcccgaacaactctccgccgtaacctggccgccgcaatccgcacttgtgctggcgggcgcgggcagcggcaaaacgcgcgtgctgaccacgcgcatcgcatggctgttgcaaagcggacaagccagcgtgcacagcattatggcggtaacgtttaccaacaaagccgccaaagaaatgcaaacccgtttgggcgcgatgattcccatcaatgtccgcgccatgtggctcggcacgttccacggtctctgccaccgctttttgcgcctgcaccaccgcgacgccggtctgccgtcttcctttcaaatcctcgacggcggcgaccagctttccctcatcaaacgcctgctcaaaagcctcaacatcgccgaagaaatcatcgcgccgcgttcgctgcaaggctttatcaacgcgcaaaaagaatccggtttgcgcgcttccgtgttgagcgcgcccgatccgcacacacgccgcatgattgagtgctacgccgaatacgacaaaatctgccaacgcgaaggcgtggtcgattttgccgaactcatgctccgcagctacgaaatgctgcaaaacaacgaaatcctgcgccagcactaccaaaaccgcttcaaccacattctcgttgacgagttccaagacaccaacaaactgcaatatgcttggctgaaactgattgccggcaaccacgcagcagtatttgccgtcggcgacgacgaccaaagcatttaccgtttccgtggcgcaagcgtcggcaacatgaccgcgctgatggaagaattccacatcgacgcgcccgtcaaactcgaacaaaactaccgctccgtcggcaacatccttgccgccgccaatgccgtgattgaaaacaacgacgaacgactcggcaaaaacctgcgcaccgacgccgaagcaggcgacaaaatccgctactactccgcctttaccgacctcgaagaagcccggttcatcttggacgaaaccaaagccctcgaacgcgaaggctgggatttggacgaaatcgccgtcctctaccgtagcaacgcccaatcccgcgttatcgaacaaagcctgttccgcagcggcattccctacaaaatctacggcggcttgcgtttttacgaacgccaagaaatcaaacacgcgctcgcctacctgcgcctcgccgtcaatcccgacgacgacaacgccctcttgcgtgtcatcaacttcccaccgcgcggcatcggtgcacgtaccgtcgaaaatcttcagacggcctcaaacgaacaaggcatcaccctctggcaagccgcctgcaacgccggcgcgaaagccgccaaagtcgtcgccttcgtccgcctgattgaagccctgcgcaaccaagtcggacaactgtccctgtccgaaatcatcgtcggcatcctcaaagacagtggcttgaccgaacactaccgcacccaaaaaggcgacaaccaagaccgtctcgacaaccttgacgaactcgtcaacgccgccatcgaattcaaacccgaagacagcaacttcgaaatcctgcctgaaaacatttcagacgaccccgccttccccattctcgccttcctaagcaatgccgccctcgaatccggtgaaaaccaggcaggcgcaggcgaaaaggccgtccaactcatgaccgtccacgccgccaaaggcttggaatttaacgccgtcttcctcaccggcatggaagaaggccgcttccccagcgaaatgagccttgccgaacgcggcggcctcgaagaagaacgccgcctcatgtacgtcgccatcacccgcgcccgcaaacgcctctacatcaccatggcgcaacaacgcatgctgcacggacaaacccaattcggcatcgtctcccgcttcgtcgaagagatcccacccgaagtattgcactacctgtccgtcaaaaagcctgcctacgacagttacggcaacacgcgccaaaccgccgcatccaaagataaaatcatcgacgactacaaacagccccaaacctacgcaggtttccgtatcggacaaaacgtccgccacgccaaattcggcaccggcgtgattatcgatgccgcagataaaggcgaatccgcccgactgaccatcaatttcggcaaacagggcgtgaaagagttggacaccaagtttgcgaaattggaagagatgtaa

SEQ ID NO: 4289 - DNA, 102 bp, Neisseria meningitidis
gtgggctttttctatgaatcaagcccaaaatttcagacggcatttttagccgtcattatcgtggatgaagcccacgctacaatgtacacacagagcaaatag

SEQ ID NO: 4290 - DNA, 540 bp, Neisseria meningitidis
atgtcccaagtttttaaagattttgacttgtcctccgtatggaaaactaatagttgggcagatgaaaactacaaagaagccccgtttacccctgaaattttggctgccgtagaaagtgaactgggctataaattgccgcaaagttttattgaattgatggcagtacaaaacggcggaatatttgtcaaaaactgttttccgaccacgcagagaaattcgtgggcggaaaatcatgtgcaaatttgcgaggtatcgggaatcggttttgaaaaagaagggagtttgtgcggcgcgatggggcaaaaactttggctggaagaatgggaatacccgcctatcggcgtgtattttgccaacgacccgtcaggcggtcatgccatgtttgccttagactatcgggcgtgcggcaaagacggcgagccgaaagtggtgtttgtcgaacaagaatcggattttgaaatcgtcgaacttgcccccgattttgaaacctttatccgcagcttgcggcatgaagatgagtttattgacgaagaaatataa

SEQ ID NO: 4291 - DNA, 162 bp, Neisseria meningitidis
atgaatataatcaattacaaaggtgatgacattattatttctttaacaagagaagagcttcaattattgcgttcccttgttattgaaatttatgcaggtgtttgcatagatgcagaagaatttgagattgtgtcaggaattcgcaatccaaaattggtataa

SEQ ID NO: 4292 - DNA, 204 bp, Neisseria meningitidis
ttgctcaaaagaaacttgggatttgacactttcaaacttattacgatttttttcttgggaattcgaagattacaatccaaacacataagagcaatttgggatgataagtctggagcaattgtaatcagagacccaaattcaaaagatggtggaactgcatttagaccaaccttaggcaaaacttactttgacaaacaaaaataa

SEQ ID NO: 4293 - DNA, 360 bp, Neisseria meningitidis
atgattaaattggatttaaaaagcataaatttatatgatattgattttgaaaaatttacccccgaaattccagataatttccatagatggatagatttggatatcggaatcgaaggagaacaaggctcatctattttttcactttgcatttgttctcctaaatggatttcccatcattgtaataaagaaggttttttttggtctaatgcattaatattagaacagtttgatcataagattattaaaagtgaaattgataaaatattagaatattgctcaaaagaaacttgggatttgacactttcaaacttattacgatttttttcttgggaattcgaagattacaatccaaacacataa

SEQ ID NO: 4294 - DNA, 265 bp, Neisseria meningitidis
atgagaaaaagtcgtctaagccggtataaacaaaataaactcattgagctatttgtcgcaggtgtaactgcaagaacagcaacagagcccgacagcattgtttatacggattgttatcgtagctattcatttacgcaagtttaacggcattcccaaagcgcattttgagctgtatttaaaggagtgcgaatggcgttttaacaacagtgagataaaagttcaaatttccattttaaaacaattagtaaaatcgagtttatcttag

SEQ ID NO: 4295 - DNA, 621 bp, Neisseria meningitidis
atgaattcgaccgcaagtaaaaccctgaaaggattgtcgctggtgtttttcgcctctggattctgcgccctgatttaccaggtcagctggcagaggcttctattcagtcacataggtatcgatttgagttcgattactgtcattatttctgtatttatggtcggcttgggtgtaggtgcgtatttcggtggacgcattgctgaccgttttccttcaagtatcatccccctgttttgcatcgctgaagtatccatcggtctgttcggtttggtaagcaggggtctgatttccggcttggggcatcttttagttgaggctgatttgcccatcatcgctgctgccaatttcctcttattgctgcttcctacctttatgatgggcgcgaccttgcccttgctgacctgtttttttaaccggaaaatacataatgttggcgagtctatcggtaccttatattttttcaacactttgggtgcggcactcggatcgcttgccgccgccgaatttttctacgtcttttttaccctctcccaaaccattgcgctgacagcctgctttaaccttctgattgctgcttcagtatggctgcgttacagaaaggatggatatagtgaacactaa

SEQ ID NO: 4296 - DNA, 1452 bp, Neisseria meningitidis
atgctttctttccttagcggcttattgagcttgggtatagaagtcttgtgggtgaggatgttttcgttcgcagcacagtccgtgcctcaggcattttcatttacccttgcctgttttctgaccggtatcgccgtcggcgcgtattttggcaaacggatttgccgcagccgctttgttgatattccctttatcgggcagtgcttcttgtgggcgggtattgccgactttttgattttgggtgctgcgtggttgttgacgggtttttccggcttcgtccaccacgccggtatcttcattaccctgtctgccgtcgtcagagggttgattttcccgctcgtacaccatgtgggtacggatggcaacaaatccggacgacaggtttccaatgtttatttcgccaacgttgccggcagtgcattgggtccggtccttatcggctttgtgatacttgatttcttgtccacccaacagatttacctgctcatctgtttgatttctgctgctgtccctttgttttgtacactgttccaaaaaagtctccgactgaatgcagtgtcggtagcagtttccctaatgttcggcatcctcatgttcctactgccggattctgtctttcaaaatattgctgaccgtccggataggctgattgaaaacaaacacggcattgttgcggtttaccatagagatggtgataaggttgtttatggggcgaatgtatacgacggcgcatacaataccgatgtattcaatagtgtcaacggcatcgaacgtgcctatctgctaccctccctgaagtctggcatacgccgcattttcgtcgttggactgagtacaggttcgtgggcgcgcgtcttgtctgccattccggaaatgcagtcgatgatcgttgcggaaatcaatccggcataccgtagccttatcgcggacgagccgcaaatcgccccgcttttgcaggacaaacgtgttgaaattgtattggatgacggtaggaaatggctgcgtcgccatcctgatgaaaaattcgacctgattttgatgaatacgacttggtactggcgtgcctattccaccaacctgttgagtgcggaatttttaaaacaggtgcaaagccaccttaccccggatggtattgtaatgtttaataccacgcacagcccgcatgcttttgctaccgccgtacacagtattccctatgcataccgctatgggcatatggtagtcggctcggcaaccccggtagttttccctaataaagaactgctcaagcaacgtctctcccggttgatttggccggaaagcggcaggcacgtatttgacagcagcaccgtggatgctgcagcacaaaaggttgtctctcgtatgctgattcagatgacggaaccttcggctggggcggaagttattaccgacgataatatgattgtagaatacaaatacggcagagggatttaa

SEQ ID NO: 4297 - DNA, 357 bp, Neisseria meningitidis
atgttgtccgcttactttcccgtctttgtctttatcctcatcggcctcgcggccggcgtgctgtttatcctgctcggcacgattttaggcccgaaacgccactatgccgaaaaagacgcgccttacgaatgcggttttgaagcttttgaaaacgccaggatgaagttcgacgtgcgctattacctcgtcgccatcctcttcatcctgtttgatttggaggtcgcgtttatgctgccgtgggcagtcgtgttcaaagatttgggcgcgtacggcttctggtctatgctggtgtttatcgttgttctgacggtaggctttgtttacgaatggaaaaaaggtgcgctggaatgggaatag

SEQ ID NO: 4298 - DNA, 483 bp, Neisseria meningitidis
atgggaatagaaggcgttttgaaaaaaggtttcatcaccaccagcgcggatacggtgctgaactatatgcgtaccggttcgttgtggccggttactttcggcttggcctgctgcgccgtggaaatgatgcacgcgggtatggcgcgttacgaccttgaccgtttcggtattattttccgtccgtccccccgtcaggccgacctgatgattgtggcgggtacgctcaccaataaaatggcgcccgccctgcgccgagtgtacgaccagctcgccgagccgcgctgggtattgtctatgggctcatgtgccaacggcggcggctattatcactattcttattccgttgtgcgcggtgccgaccgcgtcgtgccggtagatgtttatgtgccgggttgtccgccgactgcggaagccctgatttacggcctgattcagctccaacaaaaaatcaagcgcacttccaccattgcgcgtgacgagtaa

SEQ ID NO: 4299 - DNA, 594 bp, Neisseria meningitidis
atggcaagcattcaagacttatacgaaaccgtcagccgcgttttgggcaatcaggcaggcaaagtcatttccgctttgggcgagattaccgtcgagtgtctgcccgagcactatatttcagtcatgaccgcattgcgtgaccatgaagagttgcatttcgagcttctggttgacttgtgcggtgtcgattacagcacttacaaaaacgaagcatggcagggcaaacgctttgccgtcgtcagtcagttgctttccgttaaaaacaatcaacgcatccgcgtgcgcgtctgggtttcagacgacgacttccccgtagtcgaatctgtagtcgatatttacaacagcgcggattggtacgaacgcgaagccttcgatatgtacggcatcatgttcaacaaccatccggacttgcgccgcatcctgaccgattacggcttcgtcggacatccgttccgcaaagacttcccgatttccggctatgtggaaatgcgttacgacgaagagcaaaaacgcgtgatttaccaacctgttaccattgagccgcgcgagatcacgccgcgtatcgtccgtgaggagaactacggtggccaataa

SEQ ID NO: 4300 - DNA, 1257 bp, Neisseria meningitidis
gtggccaataaattaagaaactacaccatcaacttcggcccgcaacaccctgcggcgcacggcgtattgcgtatgattttggagctggacggcgaacaaatcgtccgtgccgacccgcatatcggcctcttgcaccgaggtaccgaaaaactggcggaaaccaaaacctatctgcaagccctgccctatatggaccgcttggactatgtttccatgatggtcaatgagcaggcgtattgtttggcagtagaaaaacttgtcggtatcgatgtgcccatccgcgcccaatacatccgcgtgatgtttgccgaagtaacgcgcatcctcaatcacttgatgggcatcggttcgcatgccttcgacatcggcgcgatgaccgccattctttacgccttccgcgaccgcgaagagctgatggacttgtacgaagccgtgtccggcgcgcgtatgcacgccgcctacttccgtcccggcggcgtttaccgcgacctgcccgactttatgcccaaatacgagggcagcaaattccgcaatgccaaagtattgaagcagctcaacgaatcccgcgaaggcaccatgctcgactttatcgatgccttctgcgaacgcttccccaaaaatatcgacacactcgaaaccctcctgaccgacaaccgtatttggaaacagcgtaccgtcggcatcggcgtcgtctcccccgaacgtgccatgcaaaaaggctttaccggcgtgatgttgcgcggttcgggcgtggaatgggacgtgcgtaagacacagccttacgaagtgtacgacaaaatggatttcgacatccctgtcggcgtgaacggcgactgctacgaccgctacctctgccgtatggaagaaatgcgtcaatccgtacgcatcatcaaacaatgttccgagtggttgcgtgtcaatccgggtccggtcattaccacaaaccacaaattcgctccgcccaaacgtaccgaaatgaaaacaggtatggaagacctgattcaccatttcaaactctttaccgagggtatgcacgttcccgagggcgagacctacaccgctgtcgaacatccgaaaggcgagttcggcgtttacatcatttcagacggcgcaaacaaaccctaccgcctgaaaatccgcgcacccggcttcgcccatctgcaaggcatggacgaaatggcaaaaggccacatgctcgccgacgtcgttgccatcatcggtacgcaggacatcgtattcggggaggttgaccgataa

SEQ ID NO: 4301 - DNA, 474 bp, Neisseria meningitidis
atgttatccgcagaatctttaaaacaaatcgacatcgagttggcaaaatatcctgccgaccaacgccgctccgcgattatgggcgcattgcgtattgcccaaaccgaaaaaggctggcttgctcccgagaccatcgcttttgtcgccgactacatcggcatcacgcctgcacaagcctacgaagtcgccactttctacaatatgtacgaccttgagcctgtcggcaaatacaaactgaccgtttgtaccaacctgccctgcgccctgcgcggcggtatggctaccggcgaatacctcaaacaaaaactcggtatcggctacggcgaaactacccctgacggcaagtttacccttgtcgaaggcgaatgcatgggcgcatgcggcgacgctcccgttatgctggtcaacaaccacagcatgtgcagctttatgaccgaagaagcgattgagaagaaactggcggagttggagtag

SEQ ID NO: 4302 - DNA, 1302 bp, Neisseria meningitidis
atggctatttaccaatcaggcgtgatttttgaccaagtggataccgccaatcccgattgctggacattggacgaatacgtcaaacgcggcggctataccgccctgcgtaaaattctgtccgaaaacatctcgcaaaccgatgtgattgacgaagtcaaaacctccggtttgcgcgggcgcggcggtgcgggcttcccgaccggtttgaaatggagctttatgccccgttctttcccgggcgaaaaatatgtggtttgcaacaccgacgaaggcgaaccaggtacgtttaaagaccgcgacatcatcatgttcaatccgcatgccctgatcgaaggcatgattatcgccggttacgcgatgggcgcgaaagccggttacaactatatccacggcgaaatttttgaaggctaccaacgctttgaggccgctttggagcaggcgcgtgccgcaggctttttgggtaaaaatattttgggttcggattttgaatttgaactcttcgcccaccacggctacggcgcatatatttgcggcgaggaaaccgcattgctcgaatcgctggaaggcaaaaaaggccagccgcgctttaagccgccattccctgcttcgttcggcctgtacggcaaaccgactaccatcaacaatactgaaacgttctcctccgttccattcattatccgtgacggtggacaggcatttgccgataaaggtattccgaatgcaggcggtaccaaattattctgtatttccggccatgtcgagcgtccgggcaactatgaagtgccattgggtacgccgtttgccgaagtcttgaaaatggcgggcggtatgcgcggcggtaaaaaactcaaagccgtcattcccggcggttcgtccgcgcccgtattgcctgccgacatcatgatgcagaccaatatggactacgactcgatctccaaagcaggctccatgctcggttccggcgcgattatcgtcatggacgaagacgtgtgcatggtcaaagcccttgagcgtttgagctacttctactacgacgagtcttgcggccaatgtaccccctgccgagaaggtacgggctggctttaccgcatcgtccaccgcatcgtagaaggcaaaggtaaaatggaagatttggatttgctggattccgtcggcaaccaaatggcaggccgcaccatctgcgccctcgccgatgctgccgtcttccccgtccgcagctttaccaagcatttccgtgatgagtttgtgcattacatcgaacacggcgggccgatgaaagagcataagtggggagggtggtaa

SEQ ID NO: 4303 - DNA, 438 bp, Neisseria meningitidis
atggtggaagctaaaatttttattctatacggtgcagccaacaaaggtaagagtacgacactcaatacgctttttaatcagatttgtcggaaattttctaaatttctagtcttttttgaaagacatggaaacggcttagattttgttgcagtatttgatcatgaaggtcagagaattggtttttattcatctggtgataatgaatacgaggttaggggaaatttatacaaactttattcgcataattgtgattttatttttggcacgtcaaggacacggggtggtagttgcgatgcagtaggatgttatgcagagttattgcatggcgatgtaaatataattaattggtgtgaaaagtttgagcctacagatgaagacaatgagcgtgctgttaaagagttatttaagtcatttaaaaatataataaatgagttatag

SEQ ID NO: 4304 - DNA, 240 bp, Neisseria meningitidis
ttggcaaacggtaaaaatggaacactctatatcggtgttaccatgaatttgccggaaagggtttggcagcacaaaaaccatgtcaatattgatggctttactgcccgatatgatgtgcatgatttagtttggtatcagttttttgagaatatgcctgaagcagttgccaaagaaaaaacgatgaaaaaatggcgacgtgaatggaagattaaactgattgaagaacaaaatactgaatga

SEQ ID NO: 4305 - DNA, 2262 bp, Neisseria meningitidis
atgttacaaatcgaaatcgacggcaaacaagtatctgtggagcagggcgcgacggtgattgaagccgcgcacaagctcggtacttatattccgcatttctgttaccacaaaaaactttccatcgccgccaactgccgtatgtgtctggtgaacgtagaaaaagccccaaaacccctgcctgcctgtgccacgccggttacagacggcatgattgtgcgtacgcattcggcaaaagcccgagaggcgcaggaaggcgtgatggagttcctgctcatcaaccatccgcttgattgtccgacctgcgaccaaggcggcgaatgccagttgcaggatttggcggtgggctacggcaaaaccaccagccgctacaccgaagaaaaacgttccgtcgtcggcaaagatatggggtccttggtttccgccgaggaaatgagccgctgtatccactgcacccgctgcgttcgtttcactgaagaaatcgccggtttgcaggaaattgcgatggtgaatcgcggcgaacactccgaaatcatgccctttatcggcaaaacggtggaaaccgaattgtcgggcaacgtcattgatttgtgtcccgtcggcgcgctgaccagcaaaccgttccgcttcaacgcgcgtacttgggaattgaaccgccgcaaatccgtttccgcccacgatgctttgggcagcaacctgattgtgcagaccaaagaccataccgtccgccgcgtgttgccgttggaaaacgaagcgattaacgaatgctggctgtctgaccgcgaccgtttcgcctacgaaggcctgtatcacgaaagccgtctgaaaaacccgaaaatcaaacagggcggcgagtggatggacgtggattggaaaaccgcgttggaatatgtccgcagcgcgattgaatgtatcgccaaagacggcaagcaaaaccaagtcggcgtttgggcgaacccgatgaatacggttgaagaactgtatctggcgaagaaactcgccgacggcttgggtgttaaaaactttgcaacccgtttgcgccaacaagacaaacgtctttcagacggccttaaaggtgcgcaatggttgggacaaagcattgaatctttggctgacaacgatgccgtattggtagtcggtgcgaacttgcgcaaagaacagccgctcctgactgcccgcctgcgccgcgccgccaaagaccgtatggcattgagcgtattggccagcagtaaagaagaattgtttatgccgcttctgtctcaagaagccgcacatcccgacgagtgggcaggccgtctgaaaaacctgtctgtcaatgcggaacacgccgttaccgccagcctgaaaaatgctgaaaaagcagcggtgattttgggcgcggaagtgcaaaaccatcctgattacgccgcggtttacgccgccgcgcaagagctggctgacgcgaccggcgcagtgctgggcattttgccgcaagccgccaacagcgttggtgcggatgtcttgaatgtaaactccggcaagagcgttgtcgaaatggtaaacgcgccgaaacaggcagtcttgctgctcaacgttgagcctgaaatcgatacggcggacggtgcaaaagccgtagccgcgttgaaacaggcaaaaagcgtgatggcgtttacgccgtttgtcagcgaaacgctgctggacgtgtgcgacgtgttgttgccgattgcaccgtttaccgaaacctcaggcagcttcatcaatatggaaggccgtctgcaatccttccacggcgtggtacaaggcttcggcgattcgcgtccgctgtggaaagtgttgcgcgtattgggcaacctgtttgacctgaaaggttttgaataccacgataccgctgcgattttgaaagacgcgctggatgtggaaagcctgccgtccaaactggacaaccgcaacgcatggacaggggagggcgttcagacgacctcagaccgcctcgtccgtgtcggcggcgtcggtatttatcacaccgattctatcgtgcgccgttccgcaccgttgcaagaaaccagccatgccgccgtgcctgctgcgcgtgtaaatccaaatacattggcacgcttgggcctgcaagacggacaaaccgctgtcgccaaacaaaacggcgcaagcgtatcggttgccgtcaaagccgatgccggactgcctgaaaacgtggtgcatctgccgctgcataccgaaaatgccgcgctgggtgcgttgatggacactattgaactggcgggagcttga

SEQ ID NO: 4306 - DNA, 1077 bp, Neisseria meningitidis
atgcaggaatggttccaaaacctctttgccgcaacgctcggtctgggcgatttgggtattactgtaggcttggtggtatccgtcatcgtcaaaattgtgattatcctgattccgctgattctgaccgtcgcctacctgacttatttcgaacgtaaagtcatcggcttcatgcagcttcgcgtcggtccgaacgtaaccggcccgtggggtctgattcagccgtttgccgacgtgttcaaactcttgtttaaagaagtaacccgtccgaagctgtcaaacaaagccctgttctatatcggcccgattatgtcgcttgccccgtctttcgcggcgtgggcagtgattccgttcaatgaagaatgggtgctgaccaacatcaatatcggtcttttgtacatcctgatgattacctcgctgtcggtttacggcgtgatcatcgcgggctgggcttccaactccaaatattcgttcttgggcgcaatgcgtgcttccgcgcaaagcatttcctacgaaatcgccatgagtgccgcgctggtgtgcgtcgtgatggtgtcgggcagcatgaacttctccgacatcgttgccgcgcaggcaaaaggcatcgcaggcggttcggtattctcttggaactggctgccgctcttccccatcttcatcgtctatctgatttccgccgttgccgaaaccaaccgcgcaccgtttgacgtggcagagggcgagtctgaaatcgttgccggtcaccacgtcgaatattccggcttcgcattcgcgctgttcttccttgccgaatacattttcatgattctgattgccgcgctgacatcgttgatgttcctcggcggctggctgtctcccttcccgcaaagctggggcattgtcggtacgccttccgcattttggatgttcgcgaaaatggcggcggttctgtactggtatctgtggatacgcgccaccttcccacgctaccgttacgaccaaatcatgcgcttgggctggaaagtgctgattccgatcggcttcgcctacatcgtgattttgggcgtgtggatgatttcaccgctgaatttgtggaaataa

SEQ ID NO: 4307 - DNA, 480 bp, Neisseria meningitidis
atggctaacttagtaaaaacctttctgcttggcgaattggtaaaaggtatgggcgtaacgctcaaaaactttttcgcccgcaaagacacaatttatttccccgaagagaaaacgccgcaatccgtgcgtttccgcggtctgcacgcgcagcggcggtatccgaacggcgaagagcggtgtatcgcgtgtaagttgtgtgaggcagtgtgtccggcaatggcgattaacatcgaatcggaagaacgtgaagacggtacgcgccgcaccaagcgttacgacatcgacctgaccaagtgcatcttctgcggtttctgcgaagaggcatgcccgactgatgcgattgtggaaacccatatttttgaataccacggcgagaaaaaaggcgacttgcacatgaccaagccgattcttttggccattggcgacaaatacgaagctgaaatcgccaaacgcaaagccgctgacgcgccgtatcgttaa

SEQ ID NO: 4308 - DNA, 708 bp, Neisseria meningitidis
atggaaggactgattaatgcattgaaatatttagccgaacatgagccaatagataattttgaagaaattagaactagaaatagtccgattgagttgccaagtggattaagtaattttgaacaaaatatttttttaaaagaaaatttatccccaaaattacaaaatgatgatagcttgaagacgcattattggattatccgtgaatggggtgggattaaaagttttaaacaatctgctgaaaatagccagcttattcgtcaatttttatcggaacttaattcgggaaaattgagtagtggtttgttgaaaatttcatcattatctaaattggcttcttttatagattgtgagcgattcgccatttatgattcacgcgctattttttcgttgaattggttgttgtttaaatttacaaatgcagatttgttttttcagccacaaggtagaaatagggaactagaaatccgaaatatgaacgtattgtttcatttttctgatatcaaaccgaattatcggaaaccagacgtttcgtttcatcaatattgtgggttgttacaagatttggcgaaacaagtttatggtaaacaagcaaaaccgtatcacatagaaatgttgttattcaaaattgcgacaacgtggatttgtgcggatatggatcaactgattaagtttgattgtttgcgtaaccaggattttcagactgcttga

SEQ ID NO: 4309 - DNA, 672 bp, Neisseria meningitidis
atgactttccaactgattttattttatatttttgcagtgataattctttatggcgcgctcaaaaccgtcaccgctaaaaaccctgttcacgccgctttgcatctggtgctgaccttctgcgtgagcgcgatgctttggatgctgatgcaggctgagtttttgggcgtgacgctggtggtggtttacgtcggcgccgtgatggtgttgttcctgttcgtcgtgatgatgttgaacatcgacattgaagaaatgcgtgccggtttctggcggcacgcgcctgttgccggtgtggtcggcacattgttggcggttgcgctgatcctgattctggtcaacccgaaaaccgaccttgccgcatttggtctgatgaaagacattcctgccgattacaacaatatccgcgatttgggcagccgtatttataccgactatctgttgccgtttgaattggcggcggtattgctgttgttgggtatggtggcggcgattgcgctggttcaccgtaaaacggttaatccgaaacgcatggatcctgccgaccaagtcaaagtacgcgccgaccagggccgtatgcgtctggtgaaaatggaagcggtcaaaccgcaagtcgaatctgccgaagaaagcgaagtttcagacgacctcaagccgaaagaggagggcaaagcatga

SEQ ID NO: 4310 - DNA, 306 bp, Neisseria meningitidis
atgattaccttgacgcattatttggtattgggtgcgctcctgttcggtatcagcgcaatgggtatctttatgaaccgcaaaaacgtgctggtattgctgatgtcgatcgagctgatgcttttggcggtgaacttcaactttatcgccttctcgcaacatttgggcgatactgccggacaaattttcgtattcttcgtattgaccgttgccgctgccgaatctgccatcggtttggcgattatggtgctggtgtaccgcaaccgacaaacaatcaacgttgccgatttggacgagttgaaagggtaa

SEQ ID NO: 4311 - DNA, 576 bp, Neisseria meningitidis
atgccgtctgaaaacccgataggaaaaacgatgaaatccatagacgaacaaagcctgcataatgcccgccgcctgtttgaaagcggcgacatcgaccgtatcgaagtcggtaccaccgcgggcctgcaacagattcaccgttacctgttcggcggcttatatgattttgcgggtcaaatcagggaagacaacatttccaaaggcggttttcgttttgccaacgccatgtatttaaaagaggctttggttaaaatcgagcagatgcccgagcggacttttgaagaaatcatcgccaaatatgttgaaatgaacattgcccatccgtttttggagggtaatggcagaagtacccgcatctggctggatttggtgctgaaaaaaaacctgaaaaaagtcgtgaactggcaaaatgtaagtaaaaccctgtatttgcaggcgatggaacgcagccccgtcaacgatttagaactgcgctttctgttaaaggacaacctgactgacgatgtggacaaccgtgaaatcatctttaaaggtatcgagcagtcgtattattacgaagggtatgaaaaaggctga

SEQ ID NO: 4312 - DNA, 342 bp, Neisseria meningitidis
atgatggataaaaatcagttagaacaagaatttcataaagccatgttaaatatttatcaggaggctttgaatttgccgcaaccttacaaggcgacacgatttttacaaattgtaaatgaatttggtggtaaagaggcggcggataaattattgagtacgggggaaaagaagactcagaccggttttacagagctgattttgagtggtggcggagtccacgccttgaaatacagtatggaatatctggtgttacaaaagccgtggtgtgatttatttactgaagagcaattagctgtggcacgcaaacgattggagcgtgttggatttgtttttccgaagtaa

SEQ ID NO: 4313 - DNA, 2025 bp, Neisseria meningitidis
atgaacgatatgactttatatttgataattgcccttgttccgttggcaggctcgctgattgcgggtttgttcggcaacaaaatcggacgtgccggtgcgcatacggttacgatactcggcgtggcggtgtccgccgtgctgtcggcttatgtgctgtggggctttattgacggcagccgcgccaagtttgacgagaatgtctatacctggctgacaatgggcggcttggatttctccgtcggcttcttggtcgatacgatgacggcgatgatgatggtcgtggtaacgggcgtgtcgttgatggtgcatatctataccatcggctatatgcacgatgaaaaagtcggctaccaacgcttcttcagctatatttctttgtttacattcagtatgttgatgctgattatgagcaacaacttcattcagctcttcttcggttgggaagcggtgggcttggtgtcgtatctcttgatcggtttctatttcaaacgcccgagcgcgacatttgccaacctgaaagcctttttgatcaaccgtgtcggcgacttcggctttttgctcggtatcggcttggtgcttgcctatttcggcggcagcttgcgctatcaagatgtattcgcttatctgcccaacgtgcaaaatgccactatccaactgttccccggtgtggaatggtctttgattactgtaacctgtttgctcctgtttgtcggtgcgatgggtaaatcggcacaattcccgctgcacgtctggctgcctgattcgatggaaggcccgaccccgatttctgcattgattcacgccgcaaccatggttaccgccggtttgtttatggtgtcgcgtatgtcgccgatttatgaaatgagcagcaccgcgctgtcggtcattatggtgatcggcgcgattaccgccctgtttatgggctttttgggcgtgattcaaaacgacatcaaacgtgtagttgcgtattccaccctgtcgcaattgggctacatgaccgtggctctgggcgcgtctgcctattccgtggcgatgttccatgtgatgacccacgccttctttaaagccctgttgttcttggcggcaggcagcgcgattatcggtatgcaccacgaccaagacatgcgccatatgggcaatctgaaaaaatatatgccggttacttggctgaccatgctgatcggtaacttgtcgctgattggtacgccgttcttctccggcttctactccaaagattcgattatcgaagcggcgaaatacagcacactgccgggcagcggctttgcctattttgccgtcctcgccagcgtgtttgttaccgcgttttacgcgttccgccaatactttatggtgttccacggcgaagagaaatggcgcagcctgcccgaacaccattcagacggccacggcgaagaacatcacggtttgggtaaaaacgacaatccgcacgaaagcccgttggtggttaccctgcctttgattttgcttgccgttccgtccgtcatcatcggctacatcgccatcgaacccatgctctacggcgatttcttcaaagacgtgattttcgtcaacgccgacgcgcatccgactatacacatcatgaaggaagagttccacggcgcattggcaatggtgtcccacagcctgcattcgcccgtactctaccttgctatcgcaggcgtgttgagcgcatggcttttgtacgtcaaactgccgcacctgccagcgaaaattgcacagacgttccgtccgatttacgttttgtttgaaaacaaatactacctcgacgccctgtatttcaacgttttcgccaaaggcacacgcgcattgggcactttcttctggaaagtcggcgataccgccattattgacaacggtattgtcaacggctctgccaaactggtcggcgcgattgccgcgcaagtgcgtaaagcccaaaccggctttatctacacctacgccgccgctatggtgttcggcgtattggtcttgctcggcatgaccttctggggattgttccgataa

SEQ ID NO: 4314 - DNA, 1497 bp, Neisseria meningitidis
atgttttccaactacctactcagcttggcaatatggatacccatcgccgcaggcgtgctggttttggcaacggggtcggacagccgtgcgccgtttgcccgcgtgctcgccttcatgggtgcgcttgccggtttcttggtaacactgcccctgtttaccggtttcgaccgtttgagcggcggctatcaatttaccgagttccacgagtggattccgcttctgaaaatcaactacgcattgggcgtggacggtatttcagtgctctttatcatcttgaatgcgtttattacgctgttggtggtattggcaggttgggaagtcattcagaaacgtccggcgcagtatatggcggcattcctgatcatgtcgggtttgattaacggcgcgtttgccgcgcaggatgcgattctgttttatgtgttcttcgagggtatgctgattccgctgtacctgattatcggtgtatggggcggtccgcgccgcgtctatgcgtcggtcaagctcttcctctacacgctgatgggttcgctcctgatgctggttgcgatggtttacctttattatcaaacaggcagcttctctattgtcgatttccaaaacatcgaacagattccgttgggcgtacaacagcttttgtttgtggcgttcttcctgtcatttgccgtaaaagtgccgatgttccctgtgcacacttggttgccggatgcccacgttgaagcgccgaccggcggttcgatggtgttggcggccattacgctgaaactgggtgcgtatggtttcttgcgctttatcctgccgattatgccggatgcggcacgctattttgcccccgtgatcatcgtattaagtctgattgccgtgatttatatcggtatggtggctttggtgcaaaccgatatgaaaaaactggtggcgtattcgtccatcagccatatgggttttgtaacgcttgggatgtttttgtttgttgacgggcagttggacgactgggcattgaaaggtgcaatcattcaaatgatttcgcacggtttcgtgtctgccgcgatgtttatgtgtatcggcgtgatgtacgaccgcctgcacacgcgcaatattgctgattatggcggcgtggtcaatgtgatgcccaagtttgcggcgtttatgatgctgttcggtatggcgaacgcgggtttgcctgcgacttccggcttcgtgggcgagtttatggtgattatgggcgcggtcaaagtgaatttctgggtcggcgcgttggccgccatgaccctgatttacggtgcatcttataccctgtggatgtacaaacgcgttatttttggtgcgatccacaatccgcacgttgccgaaatgcaagacatcaattgccgcgaatttgcgattttggcaattttggcggtggctgttttgggtatgggcctgtatccgaacgcatttatcgaagtggtgcatcaggcggcaaacgatttgattgcccatgtggcacaaagcaagatttga

SEQ ID NO: 4315 - DNA, 1443 bp, Neisseria meningitidis
atgaactggtctgatttgaatttaatgcccgccatgcccgaaatcgtgctgctgtcgctgctggtgttattgttgctggcggacttgtgggtcagtgatgacaaacgcccgtggacgcattacggcgcgttggcaacggtggcggttacggctgtggtgcagttggcggtgtgggaacagggcagcacgtcttcgttcaacgggatgtatattgcagacggtatgtcgcgtttggcaaaaatggttttatatgccttgacctttgccctgtttgtctatgccaagccctacaaccaagtgcgcggtatttttaaaggcgagttttacaccctgtcattgtttgccctgttgggtatgagtgtgatggtgagcgcggggcattttttaactgcctatatcggtttggaactcttgtcgcttgccctttacgccctgattgccctgcgccgcgattccggctttgccgccgaagccgccttgaaatattttgttttgggcgcgctggcatccggcctgctgctctacggtatttctatggtttacggcgcaaccggttcgctggaatttgccggcgtgctcgcctcttccttcaatgaagaagccaacgaatggctgttgaaactgggtttggtgtttatcgtcgtcgccgtcgcgttcaaactcggtgcggtgccgttccatatgtgggtgcccgacgtgtatcacggcgcgcccacttctgttaccgccttggtcggcactgccccgaaaatcgccgccgtcgttttcactttccgcatcctcgttaccgggctgggaaccgtgcatcatgactggtctctgatgtttgccctgcttgccgccgcctcgctgctggtcggcaaccttgccgccatcatgcagaccaatatcaaacgtatgttcgcctattccaccgtatcgcatatgggtttcatcctgttggcgtttatggcgggcgcggtcggctttgcggcgggcctctattacgccattacctacgcgctgatggcggcggcagggttcggagtgttgatggtgttgtcggacggggacaacgagtgcgaaaacatcagcgatttggcagggttgaaccaacaccgcgtatggcttgcctttttgatgctgctggttatgttctctatggcgggcattccgccgctgatgggtttttacgccaaattcggcgtgattatggcactcttgaaacaaggccatgtttggttgtctgtatttgccgtcatcatgtcgctgattggtgcgttctactacctgcgcgtggtcaaagtcatctacttcgatgtgcctgatcatgaccagccggtcggcagcaactatgccgccaaatttgttctgacggtcaatgccttcttgctgctcctgtggggcatcatgccgcaaaccgttatcgactggtgcgccaaggcgttggagaacacgctgtaa

SEQ ID NO: 4316 - DNA, 387 bp, Neisseria meningitidis
atgccgttccgcaacgcggttcagacggcatcgccgccgacaacgcctaaacagaaagcccaccatgaccgcatccatgtacatccttttggtcttggcactcatctttgccaacgcccccttcctcacgaccagactgttcggcgtggccgcactcaagcgcaaacatttcggacaccacatgatcgagctggcggcaggtttcgcgctgaccgccgttcttgcctacatcctcgaatcccgtgcaggatcggtacacgatcagggttgggagttttatgccacagtcgtctgcctgtacctgatttttgcgtttccatgttttgtgtggcggtatttttggcacacgcgcaacagggaatagacaagcataggaatgccgtctga

SEQ ID NO: 4317 - DNA, 780 bp, Neisseria meningitidis
atgcgttatgcggctttggacggcggtaagcgtctgcggccgatgctggttctggcagcttcggaattaggcgaagccgtgcatgaagcagtagaacaggcaatggcggcaatcgaaatgatccacgtctattctttggttcacgacgatatgccggcgatggacaacgacagcctgcggcgcggcaaaccgacttgccacatcaaatatggcgaagcgaccgcccttctgaccggcgacgctttgcagacacaggcatttgacgtgttgagccgtccgacagaactgcccgccgcacgccagttggcaatgttgtcggtgttggcgaaagcgggcggcagcaggggtatggcgggcggtcaggcaatcgatttggcgaatgtcggcaaacaaatggttcaagccgatttggaacagatgcacagcctgaaaacgggtgcgctaatccgtgcggcggttttattgggggcgacggcgtgtcctgatctgtcagatgcggaactttccgtattggacgcttacgcggcaaaactggggctggcgttccaagtcattgacgatgtgttggattgtgaagcggacacggcgactttgggcaaaacggcgggcaaagacgcagacaacgacaagccgacttatgtgaaactgatgggcttggaagcggcgcgctcatacgcacacaaactggttgccgaagcggtcgcgctgctcgaacccttcggcgacaaagccctgcgcctgcggcagttggcagaatttgcagtcgcccgcaaatattaa

SEQ ID NO: 4318 - DNA, 225 bp, Neisseria meningitidis
atgaagaaaaacgccccgaaatcgtttgaagaagccttgtcgcgcctcgaatcgctgacgcagtctatgcagggcgaaatgcccttggaagacgcgcttgccgcctatcaggaaggcaacgaactggtcaggtactgccaaaccaaactggcacaagtcgaacaaaagctacaggttttagacacagacgggctgaaggagttaaaccttgaatccgacgaatga

SEQ ID NO: 4319 - DNA, 924 bp, Neisseria meningitidis
atgccgtccgaacacccgttttcagacggcattcccacacccaaccccaaagaaaccatgaacgacaccgcccaaattaccgccagctacggccgccgctacattgtccgcacgcccgacggcacaacctacgaagccagcacccgcaaaaaacgcgtcgatttcgcctgcggcgaccgcgtccgcatcagccccgtcaacgccgaacaagttgtgattgaagattttttaccgcgccaaagcctgctctaccgccaagacgcgtggaaaaccaaactcatcgccgccaacgttacccaactcctcatcgtaaccgccgccgtcccgagtccgagcgtgcggctgctgcaacgcgccctgcttgccgccgaagccgccggtattgaagccgtcatcgtcctgaacaaagccgacctgcccgaaaccgccctttggcgcgaaaaactcaaattctacgaaacgctgggttatcccgtcatcgaaacccgcgcactggaaaacgccggcagcctgcgccccgccctgcaagggcacagcaacatcctgctcgggcagagcggtatgggcaaatccaccctgaccaacgcccttttgggcagccaaaccgcccgcaccggcgacatttccgccgcactcgactcgggaaaacacaccaccacccacgcccggctttatgatttgaacggcgaaacccaactcatcgactccccgggtttgcaagaatttggtttacaccacctccaagccgccgatttgccgcgctatttccccgatttccgccaccttgtcgggcaatgccgcttccacaactgcacccaccgcgccgaacccggctgcgccttcaaagccgccgcgcaaaccggggcggcaagccccgaacgcctcgcctttttgcagggcatcaccgacgaactgcccgggtaa

SEQ ID NO: 4320 - DNA, 1857 bp, Neisseria meningitidis
atgttgaacaaaatattttcctggttcgagtcccgaatcgacccttatcccgaagccgccccgaaaacgccagaaaaaggcttgtggcggtttgtctggagcagcatggccggcgtgcggaaatggatagccgccctggctgcgctgaccgccggcatcggcattatggaagccctggtttttcaatttatgggcaaaatcgtggagtggctcggcaaatacgcgcccgccgaactgtttgccgaaaaaagttgggaactggcggcaatggcggcgatgatggtattttcggttgcgtgggcgtttgccgcgtccaacgtgcgcctgcaaacccttcagggcgtgttccccatgcgcctgcgctggaacttccaccgcctgatgctgaaccaaagcctcggtttttatcaggacgaatttgccggacgcgtgtccgccaaagtcatgcagaccgcgctggcgttgcgcgacgcggtgatgacggttgccgatatggtcgtttatgtgtcggtgtatttcattacctccggcgtgattctcgcctcgctcgactcatggctgctgctgccctttatcggctggattgtcggtttcgcttcggtgatgcgcctgctgattcccaaattggggcaaaccgccgcatggcaggcggatgcccgctcgctgatgaccggccgcattaccgatgcctattccaatatcgccaccgtcaaactcttctcccacggcgcgcgtgaagccgcctatgccaagcagtcgatggaagaatttatggttacggtgcgcgcccaaatgcggctggcgacgctgctgcattcgtgcagcttcatcgtcaacacctccctgaccctctccaccgccgcactgggcatctggctctggcacaacgggcaggtcggcgtgggcgcggttgctacagccaccgccatggcgttgcgcgtcaacggtttgtcgcaatacattatgtgggaatccgcgcggctgtttgaaaacatcggcaccgtcggcgacggcatggcaaccctgtccaaaccgcacaccatcctcgacaagccccgggcactgccgctgaacgtgccgcaaggcgcaatcaaatttgaacacgtcgatttctcctacgaagcgggcaaaccgctgctcaacggcttcaacctcaccatccgcccgggcgaaaaagtcggcttgatcggacgcagcggcgcgggcaaatccaccatcgtcaacctgcttttgcgcttctacgaaccgcaaagcggcacggtttcgatcgacgggcaggacataagcggcgttacccaagaatctttacgcgcccaaatcggtttggtcacgcaagatacctcgctgctgcaccgttccgtgcgcgacaacattatttacggccgccccgacgcgaccgatgccgaaatggtttctgccgccgaacgcgccgaagccgccggcttcatccccgacctttccgatgccaaagggcggcgcggctacgacgcacacgtcggcgaacgcggcgtgaaactctccggcgggcaacgccagcgcatcgccatcgcccgcgtgatgctcaaagacgcaccgattcttcttttggacgaagccaccagcgcgctcgattccgaagtcgaagccgccatccaagaaagcctcgacaaaatgatggacggcaaaaccgtcatcgccatcgcccaccgcctctccaccatcgccgcaatggacaggctcgtcgtcctcgacaaaggccgcatcatcgaagaaggcacacacgccgaactcctcgaaaaacgcgggctttacgccaaactctgggcgcaccagagcggcggcttcctcaacgaacacgtcgagtggcagcacgactga

SEQ ID NO: 4321 - DNA, 585 bp, Neisseria meningitidis
atgatcagcagactgaccggcaaactggttgaaaaaaaccctccgcaaatcgtcatcgatgtcaacggtgtcggctatgaggccgacgtatcgatgcagaccttctacaacctgccgcccgtgggtgaaagcgtacaactgtttacccagcttatcattcgggaagacgcacatcttttatttggttttgccactgcggaagaacgcaagaccttccgccaactgatcaaggtcggcggcatcggcgcgaaaacggctttgggcattttgtcggcaatgactgccgacgaactggcgcgggcggttgcagaagaagatgtcaaacgcctctcctccgccccgggaatcggcaaaaaaaccgccgaacgtatggttttggaactgcgcggcaagctggtcgcgcatacggtaacggacgggctgtttgccgccgcacccgccgccgacgaaacggaagacatcgtcagcacgctgcttgcgctgggttacagcgaacgcgaagcaaaagcggcggtcaaaggcgttccggaggggacggacgtgggcgaaggcgtgcgccttgctttgaaaaacctgctgaaataa

SEQ ID NO: 4322 - DNA, 327 bp, Neisseria meningitidis; identical to SEQ ID NO: 3493

SEQ ID NO: 4323 - DNA, 720 bp, Neisseria meningitidis; identical to SEQ ID NO: 2043

SEQ ID NO: 4324 - DNA, 465 bp, Neisseria meningitidis
atgtttaccatcgttttataccagccggaaatcccgccgaacacgggcaacatcatccgcctgtgcgccaataccggcgcggatttgcaccttgtcaaaccgctcggcttcccattggattccgccaaaatgaaacgcgccgggctcgactaccacgagttcgccagcctgacggtgcacgaaaacttcgacgactgcctcaaggcactcgcaggcaggcgcattttcgccctgaccaccaaaggcacggcgcgccccgatgaaaccgcgtttcaaaaaggcgacgttttactgttcgggccggaaacgcgcggactgcctgccgacatcctcgacagcctgcccgccgcgcaaaaaatccgcctgccgatgcagcccggcagccggagtatgaacctttccaacaccgtcgccgtgattctctttgaagcgtggcggcaacacggttacgcaggcggcgtttga

SEQ ID NO: 4325 - DNA, 726 bp, Neisseria meningitidis
atggattttctctctcgttggcggcgcatcgcagacgcgcccactatcaggcgttgcgtattatgccacggttcgtctggcgtttcagacggcatctgcgccggctgccgcgacgatttggcggcataccgcaccgacgcggcaaacagctgccccctgtgtttcagacacatccaaggcggatcggtgtgcggcggctgtcagaaaaaaccgcccgcattcgaccggatgtgggcttcgctgcattacgaaccgcccgtcagcaatatgatacacgcgctgaagcacttggctgatttgagcatggtgcagccgctggcagacctgatgatgcagaatccgcccgaccggcttgcagacgaatgtttcgatttcgtcctgcccgtaccgctaagcagggagcggctgctgcaacgcgggttcaaccaaagtgaaagcatcgtcgggctgctggcacaacgctacggctggcagatactgccccgacacaccgttttccgacaccaccgcccgccgcaaagcacgctcaaaggcggcgaacggcggcgaaacatcaaaaacgcctttgaaatccgcacaccgataccggaaaactgtaatattctgttaatcgacgatgtctttaccaccggcgcgacgctggacgaattggcaaagacgctgaaaaaatcgggcgcaaaccgaatctgctgctggacgctggcacgcacgccaatgaaaaaataa

SEQ ID NO: 4326 - DNA, 750 bp, Neisseria meningitidis
atgcctgatgccgtcaaaaaagtttacctgatacacggttggggggcgaaccgccacatgttcgacgatttgatgccgcgcctgcctgcaacgtggccggtgtccgccgtcgatttgcccggacacggggacgctccgtttgtccgacctttcgacattgcggctgcggccgacggcattgccgctcaaattgacgctccggccgacattctcggctggtcgctcggcggattggtcgcgctgtatctggcggcgcgccatcccgacaaagtccgttcgctctgcctgacggcgagtttcgcacggctgacggctgacgaagactatcccgaagggcttgccgcgcctgcattgggcaaaatggtcggtgcgttccgttcggattatgccaaacatatcaaacagtttctacaattacagcttctgcacacgcctgatgcggacggaatcataggcagaatcctgcccgatttggcgcgctgcggcacgcctcaagccttgcaggaggcgttggacgcggcggaaagggcggatgcgcggcatttgttggacaagatagatgttccggtactgctggtgttcggcggcaaagacgcgattacgccgccgcgtatgggtgaatatctgcaccgccgtttgaagggcagcaggttggttgtgatggaaaaggcggcgcatgcgccgtttttgagccatgcggaagcgtttgccgcgctgtaccgcgactttgttgaagggggtttgagatga

SEQ ID NO: 4327 - DNA, 789 bp, Neisseria meningitidis
atgaaccatcaggacgcacgctggcaggttcaccgccatcttgccgaacataccgaccaacggctgacactcgtccgcaacgcgcccaagcatatcctgcttgccggtgcggatgcggacatcagccgcagcctgctggcgaaacgctatccgcaggcggtatttgaagaatacgattcccgtgcggattttttggcggctgccgctgccgcccgcaaaggcggtttttggcaaaggtttacgggtaagggcgtggtgcaacactgccaatccccgatcgcgccgctgcccgaagcgtgtgccgatatgttgtggtcgaatctcggactgttggcggcggaacaaatccttcctgtgctgcacaactgggcgcgcgccttgaagacggacgggctgctgttttttacctgcttcgggcgagataccttggcggaactgaaatgccgtctgaaagaaaacggcattgaaagccgcagcgcgcttttccctgatatgcacgacttgggcgatatgcttgctgaaaacggcttttacgaccccgttaccgatacggcgaagctggtgttggattacaaaaaggcggaaacgttttgggcggatatggacacgctgggcgtttggcgggcgatggcgtggaacgatgaaaacgccgcgcgttcgtgtgtcgggacaatatttgagcgggaaggcggtttgggcattacgctggaaacggtgtacggacacgccgtgaaaaaactgatgctgccgcaaggggagaacgtggtgcagttttttccgaagagatga

SEQ ID NO: 4328 - DNA, 297 bp, Neisseria meningitidis
atgaacaaaaaattaaactatatttttatgttggactgtttagggttggtgatattgtttacttgtataatagctacttttgaaagagattatggatttaaaatttttactaattctaagagacctgaattttattattggattggaatgttttattatggaattatttcttgctggtttgattatcaattaatttcaacaaaggcgaattcgtataaaagaaaagttaaacaatataaaattttttcagtaatattttcagttttgatatttatttctactatagtaaaactttaa

SEQ ID NO: 4329 - DNA, 426 bp, Neisseria meningitidis
atgtattgggaacgcggtctgcacatgtataaggcaagtgccgtcgtgccgacgggatatgtacgggttgggaataccgcgccgctggtcggcgaagacacgcaacggtatgcctctttttggggcgacggctacgacgtgtaccgtcagttgagatggcagcagatacccgaaaaacagagaaaggcattcaaaaaagccgccaaaagcaaaaagaccgtgatgtttgccggacgggaatacggcatatccaaacagaatttgagcgatgtttgggatgattttgaagacgcgatggaactgaaggcgtttccctgcctgtcttcgctgtttctgaccaaatggcataaaaatctatatgatagtggattaacaaaaaccagtacggcgttgcctcgccttagctcaaagagaacgattctctaa

SEQ ID NO: 4330 - DNA, 2301 bp, Neisseria meningitidis
atgcaccgaccgaccgccaaacagattctgcacgaagtatttggttatcccgaatttcgcggcaggcaggaggctgtcatcaatactttggcaggcggcgggagtttgacggtgctgatgccgacgggcggtggcaagtctttgtgttaccagattcccgcgctgatgcgcgaaggcgtggcggttgtcgtatcgccgctgattgcgctgatgaacgaccaagtggcaaacctgcacgccgccggcatcgaagcggcggcagtcaacagcggcacatcggcagacgaggcgcgcgagattgccgaccggcttgcccaaggccgtctgaagctgctttatgtcgcgccggaacgcttggttaccgaccgctttttgcgttttctcgaccaacaaaccgtcagtctgtttgccattgatgaggcgcattgcgtcagccaatggggacacgatttccgccctgaatatcaacagctcggcatgcttgccgaacgctatccgaacgtcccgcgcatcgctctgaccgctaccgccgatgccgccacgcgcgccgacatcaagcattatctgcacttggacgatgcgcccgaatttgtctccagctttgaccgtccgaatatttattatcaggttatcgaaaaaaacaacggcaaaaaacaattgctggatttcatccgcaaagaaatgacggggcaaagcggcattgtgtattgcctaagccgcaaaaaggtggaagatgtggcgcagtttttgcgtgaaaacggattaaacgcgattccgtatcatgctggtttgagcatggacgtacgcgaggaaaaccaacgccgctttacgcatgaagacaatattatcgtggtggcgaccgtggcgttcggcatgggcatagacaaacccgacgtgcgctttgtcgcccatctcgatatgccccagagtgtcgaacatttctatcaagaatcggggcgcgccggacgggacgggctgccggccgcaagctggctgtgttacggtttgaacgattgggtgttgctgcgcgaacggattgccgaaggcaacagcgacgaggtgcaaaagcaaatcgaaatgcaaaaactcgatgccatgcttgccgtctgcgaaaccgccgcctgccgccgcgtactgctgctcaaacatttcggcgaagcatccgaaccctgcggccattgcgacaactgcctgcatccgcccgtacggtttgacggcacggtgttggtgcaaaaattactcagctgcgtgtaccgcgccggacaacgttttgccgccggttacatcaccaacattttacgaggtaaaagcgacgattggatacgcggcaaccggcacgaacaactgtccacattcggcatcggtacggagttgtccgacaaagaatggcgcagcgtcatccgccagtgtatcagcctcggctacctcaccgtcaacattacccgatatcaggcattgcaactgaccgaagccgccaaaaaagtcctcaaaggcgaaaccgaagtgatgctgcgtccgctcaagcgcgacaagcccgccgcccgcaccctcaaagacaactggctgcgtaccgaacgcgaagaacgcctgtggcaggcattgcgcgtttggcgtatgaaacaggcagaagccgaaggcatccccgcctatatgattttcggcgacaaaaccctgcgcgaccttgtcgaaaaaatgccgcaagacctcaacggtctgcacgacatctacggtttgggcgaagccaaaatcgaccgtttcggacacggcatcctcgaagtctgccgcaacgccgccggcttcagccgcgacgcggtcatccgtccgcaaaccgaacgcgaacaacaactgcgtcaaaaactcgaagcctggcggtatgaacaggcaagggcggaaaactgcgccctgcatgccgtcctctccgacgaaagccttgccgatatgcttgccgatacgcccgaaaccgaaaccgacctcgaaggcgtgtacggcttgggcagcgtacgcgccgccaaatacggacgggacatcctcgccgtctgccgtccgttttcagacggcatcgatgaaaccgccaaacgcaaacgccgcctgatgcgcgccctgatccaatggtgcggcgaaacggcaaaacacgaacagtccgaaccctaccgcattctcagcaaagccgcactgcgcgccattgccgccaaacagccggaaggcttggcggagcttgccgccgtatacggcgtaggcgaagaaaaagccgcacgttacggtgcggcggtgttggcggtattggaacgaaatgccgtctga

SEQ ID NO: 4331 - DNA, 783 bp, Neisseria meningitidis
atgaccgacatcctcaataaaatccttgccaccaaagcacaggaagttgccgctcaaaaagccgccgtcaacgccgaacacatccgcacacttgccgcagaagccgcgcccgtccgcagcttcatcgattcgatacgcggcaaacaccgcctaaacctgcccgccgtcatagccgaaatcaaaaaggcaagcccgagcaaagggttaatccgtccggacttccgccctgccgagattgcacgcgcctatgaaaacgccggagcggcgtgtttgtccgtactgaccgacgaaccctatttccaaggttcgcccgaatacctcaaacaggcgcgcgaagccgtatcgctgcccgtgctgcgcaaagacttcatcatcgacgaataccaggtttatcaggcgcgcgcatggggggcggatgccgtcctgctgattgccgcagcactggaacaggaacaattggaacgctttgaagcggtggcgcacgaattgggcatgaccgtcctactcgagctgcacgacgaaaccgaattggaaaaatgccgcaacctgaccacgccgctgtggggcgtaaacaaccgcaacctgaggacttttgaagtctccctcgaccaaaccctgtcgctgctgcccgcgctggaaggcaaaaccgtcgttaccgaaagcggcattacaggcaaggcggatgtggaatttatgcaatcgcgcggcgtgcataccttcctgatcggcgaaacgtttatgcgtgccgacgatattgaagcagaagtgggcaaactattctaa

SEQ ID NO: 4332 - DNA, 957 bp, Neisseria meningitidis; identical to SEQ ID NO: 1995

SEQ ID NO: 4333 - DNA, 1542 bp, Neisseria meningitidis
atgatgaatatgctgggagctttggcaaaagtcggcagcctgacgatggtgtcgcgcgttttgggatttgtgcgcgatacggtcattgcgcgggcattcggcgcgggtatggcgacggatgcgttttttgtcgcgttcaaactgcccaacctgcttcgccgcgtgtttgcggagggggcgtttgcccaagcgtttgtgccgattttggcggaatacaaggaaacgcgttcaaaagaggcggcggaggcttttatccgccatgtggcggggatgctgtcgtttgtactggttatcgttaccgcgctgggcatacttgccgcgccttgggtgatttatgtttccgcacccggttttgcccaagatgccgacaaatttcagctctccatcgatttgctgcggattacgtttccttatatattattgatttccctgtcttcatttgtcggctcggtactcaattcttatcataagttcggcattccggcgtttacgcccacgtttctgaacgtgtcgtttatcgtattcgcgctgtttttcgtgccgtatttcgatccgcccgttaccgcgctggcgtgggcggtctttgtcggcggcattttgcaactcggcttccaactgccctggctggcgaaactgggctttttgaaactgcccaaactgagtttcaaagatgcggcggtcaaccgcgtgatgaaacagatggcgcctgcgattttgggcgtgagcgtggcgcaggtttctttggtgatcaacacgattttcgcgtcttatctgcaatcgggcagcgtttcatggatgtattacgccgaccgcatgatggagctgcccagcggcgtgctgggggcggcactcggtacgattttgctgccgactttgtccaaacactcggcaaaccaagatacggaacagttttccgccctgctcgactggggtttgcgcctgtgcatgctgctgacgctgccggcggcggtcggactggcggtgttgtcgttcccgctggtggcgacgctgtttatgtaccgcgaatttacgctgtttgacgcgcagatgacgcaacacgcgctgattgcctattctttcggtttaatcggcttaatcatgattaaagtgttggcacccggcttctatgcgcggcaaaacatcaaaacgcccgtcaaaatcgccatcttcacgctcatctgcacgcagttgatgaaccttgcctttatcggcccactgaaacacgtcggactttcgcttgccatcggtctgggcgcgtgtatcaatgccggattgttgttttacctgttgcgcagacacggtatttaccaacctggcaagggttgggcagcgttcttagcaaaaatgctgctctcgctcgccgtgatgtgcggcggactgtgggcagcgcaggcttacctgccgtttgaatgggcgcacgccggcggaatgcggaaagcggggcagctctgcatcctgattgccgtcggcggcggactgtatttcgcatcactggcggctttgggcttccgtccgcgccatttcaaacgcgtggaaaactga

SEQ ID NO: 4334 - DNA, 699 bp, Neisseria meningitidis; identical to SEQ ID NO: 3263

SEQ ID NO: 4335 - DNA, 1005 bp, Neisseria meningitidis
atgcaacgacaaatcaaactgaaaaattggcttcagaccgtttatcccgaacgggacttcgatctgacttttgcggcggcggatgctgatttccgccgctatttccgtgcaacgttttcagacggcagcagtgtcgtctgcatggatgcaccgcccgacaagatgagtgtcgcaccttatttgaaagtgcagaaactgtttgacatggtcaatgtgccgcaggtattgcacgcggacacggatctggggtttgtggtattgaacgacttgggcaatacgacgtttttgaccgcaatgcttcaggaacagggcgaaacggcgcacaaagccctgcttttggaggcaatcggcgagttggtcgaattgcagaaggcgagccgtgaaggggttttgcccgaatatgaccgtgaaacgatgttgcgcgaaatcaacctgttcccggaatggtttgtcgcaaaagaattggggcgcgaattaacattcaaacaacgccaactttggcagcaaaccgtcgatacgctgctgccgcccctgttggcgcagcccaaagtctatgtgcaccgcgactttatcgtccgcaacctgatgctgacgcgcggcaggccgggcgttttagacttccaagacgcgctttacggcccgatttcctacgatttggtgtcgctgttgcgcgatgcctttatcgaatgggaagaagaatttgtcttggacttggttatccgctactgggaaaaggcgcgggctgccggcttgcccgtccccgaagcgtttgacgagttttaccgctggttcgaatggatgggcgtgcagcggcacttgaaggttgcaggcatcttcgcacgcctgtactaccgcgacggcaaagacaaataccgtccggaaatcccgcgtttcttaaactatctgcgccgcgtatcgcgccgttatgccgaactcgccccgctctacgcgctcttggtcgaactggtcggcgatgaagaactggaaacgggctttacgttttaa

SEQ ID NO: 4336 - DNA, 2277 bp, Neisseria meningitidis
gtgtccgaacccatacagcctaccagcctgagcctcggttcgacctgcctgttttgcagtaacgaaagcggcagccccgagagaaccgaagccgccgtccaaggcagcggcgaagcatccatccccgaagactatacgcgcattgttgccgacaggatggaaggacagtcgcaggtgcaggtgcgtgccgaaggcaacgtcgtcgtcgaacgcaaccggacgaccctcaataccgattgggcggattacgaccagtcgggcgacaccgttaccgcaggcgaccggttcgccctccaacaggacggtacgctgattcggggcgaaaccctgacctacaatctcgagcagcagaccggggaagcgcacaacgtccgcatggaaatcgaacaaggcggacggcggctgcaaagcgtcagccgcaccgccgaaatgttgggcgaagggcattacaaactgacggaaacccaattcaacacctgttccgccggcgatgccggctggtatgtcaaggcagcctctgtcgaagccgatcgggaaaaaggcataggcgttgccaaacacgccgccttcgtgttcggcggcgttcccattttctacaccccttgggcggacttcccgcttgacggcaaccgcaaaagcggcctgcttgttccctcactgtccgccggttcggacggcgtttccctttccgttccctattatttcaaccttgcccccaatctcgatgccacgttcgcgcccagcgtgatcggcgaacgcggcgcggtctttgacgggcaggtacgctacctgcggccggattatgccggccagtccgacctgacctggctgccgcacgacaagaaaagcggcaggaataaccgctatcaggcgaaatggcagcatcggcacgacatttccgacacgcttcaggcgggtgtcgatttcaaccaagtctccgacagcggctactaccgcgacttttacggcaacaaagaaatcgccggcaacgtcaacctcaaccgccgtgtatggctggattatggcggcagggcggcgggcggcagcctgaatgccggcctttcggttctgaaataccagacgctggcaaaccaaagcggctacaaagacaaaccgtatgccctcatgccgcgcctttcggtcgagtggcgtaaaaacaccggcagggcgcaaatcggcgtgtccgcacaatttacccgattcagccacgacagccgccaagacggcagccgcctggtcgtctatcccgacatcaaatgggatttcagcaacagctggggctatgtccgtcccaaactcggactgcacgccacctattacagcctcaaccgcttcggcagccaagaagcccgacgcgtcagccgcactctgcccattgtcaacatcgacagcggcgcaacttttgagcggaatacgcggatgttcggcggagaagtcctgcaaaccctcgagccgcgcctgttctacaactatattcctgccaaatcccaaaacgacctgcccaatttcgattcgtcggaaagcagcttcggctacgggcagctctttcgcgaaaacctctattacggcaacgacaggattaacaccgcaaacagcctttccgccgccgtgcaaagccgtattttggacggcgcgacgggggaagagcgtttccgcgccggcatcggtcagaaattctatttcaaggatgatgcggtgatgcttgacggcagcgtcggcaaaaaaccgcgcaaccgttccgactgggtggcatttgcctccggcagcatcggcagccgcttcatcctcgacagcagcatccactacaaccaaaacgacaaacgcgccgagaactacgccgtcggtgcaagctaccgtcccgcacagggcaaagtgctgaacgcccgctacaaatacgggcgcaacgaaaaaatctacctgaagtccgacggttcctatttttacgacaaactcagccagctcgacctgtccgcacaatggccgctgacgcgcaacctgtcggccgtcgtccgttacaactacggttttgaagccaaaaaaccgatagaggtgctggcgggtgcggaatacaaaagcagttgcggctgctggggcgcgggcgtgtacgcccaacgctacgttaccggcgaaaacacctacaaaaacgctgtctttttctcacttcagttgaaagacctcagcagtgtcggcagaaaccccgcagacaggatggatgtcgccgttcccggctatatcaccgcccactctctttccgccggacgcaacaaacgaccctga

SEQ ID NO: 4337 - DNA, 1047 bp, Neisseria meningitidis
atgatgaaaatcaaagccctgatgattgccgccgcattgctggcagcagccgatgtccacgccgcaccgcaaaaggcaaaaaccgcatccgccaaagctgccaaagctgccaaagctgccaaagttgccaaagttgccaaagttgccaaagttgccgccacggcgcaaaaagaagccgcacccgcacaacagcagggcggtatccgcttttcagacggcattgccgccgttgccgacaacgaagtcatcacgcgccgccggcttgccgaagccgttgccgaagccaaagccaacctgcccaaagacgcgcagataagcgaatccgagctgtcccgacaggtgctgatgcagcttgtcaaccaatccctgattgtacaggcgggcaaacgccgcaacattcaagcaagcgaagcggaaatcgatgccgtcgtcgcaaaaaatcccgccctcaaaaacctcagccccgcccaacgccgcgattttgccgacaacatcattgccgaaaaagtccgccagcaggcagtgatgcagaacagccgcgtgagcgaagctgaaatcgatgccttcctcgagcaggcgcaaaaacaaggcatcaccctgcccgaaggcgcaccgttgcgccaataccgcgcccaacacatcctgattaaagccgacagcgaaaacgccgccgtcggcgcggaaagcaccatccgcaaaatctacggagaggcccgcagcggcacagacttttccagcctggcgcgccaatattcgcaagacgcgagcgcgggcaacggcggagatttgggctggtttgccgacggcgtgatggttcccgcctttgaagaagccgtccacgcgctcaaacccggacaggtcggcgcgcccgtccgcacccaattcggctggcatatcatcaaattgaacgaagtgcgcgatgccggcacacctcaggaacgtatccgcaattccgtgcggcaatacatcttccaacaaaaagccgaacaggcaaccgtcaacctgttgcgtgacctgcattccggcgcgtatgtcgacatccgctaa

SEQ ID NO: 4338 - DNA, 1881 bp, Neisseria meningitidis
atgaatattttttacgaagagtccggccaattcaaaatcgccgccatcatccaaaaaaacgatgccacctaccaagtcgataccccacacggcaaacgcaccaaagtgaaggcgaacaacgtctttgccgagtttgacggcgatatggcggcgtttttggaaaacgcgcaggcacaggcggcggacatcgacaccgatttattgtgggaagtatgcggcgaagaggaatttaccgccgaagccatcgccgaagaatattacggccatgcgccgaccaaaaccgagctggcggcaactttgattgcgctttacgccgcgccgatgtatttctacaaaaaagccaaaggcgtgttcaaagccgcgcccgaagaaactttaaaacaagcacttgccgccatcgaacgcaaaaaacagcaagacgcgcaaatcgacgcttgggcagaagccttgaaacgcggcgagatgccgtctgaaatcgcggcggatttgaaaaccatcctgcacgcgcccgacaagcagtcgctgacctacaaagcctttaccaaagccgccgacgcgctgaaaacctctgcctacgaattggcgaaaaaaacgggcggcattacgtccattccccaatacctgcaagacgggtttgaaatcaaatacttccctaaaggaacaggcttccccgaccttgcccttcccgaaatgcccgacctgcccaaggccgacgttaccgccttttccattgacgacgaatcaaccaccgaagtggacgacgctttaagcctgaccgacttggacaacggcacgaagcgtgtcggcatccacatcgccgcgccgtcacttgccgttaaaccgggcgacaaaatggaaaaaaacatcatggaacgcttgagcacggtttatttccccggcggcaaaatcacgatgctgcccgaaaactggattgccgcgttcagccttgatgcaggcgcacaccgccctgccgtcagcatttatttcgatgtggacggcgagttcaacgtcggcgcgccgacctgcaaaatcgaagcggtcaacatcgccacaaacctgcgtatccaagccatcgagccgcatttcaacgccgaaaccggcttggacgaagccggcgaaatgatgttcgcccaccatcaagacctgatttggttctatcaattcgccaccgccctgcaaaaagcgcgcggcaaatacgaacccgaccgcgcgccgcaatacgattacagcatcgaattggatgaggaaggcaaggtatccgtcgtccgccgcgaacgcggctcacccatcgatacgctggtcagcgagatgatgattcttgccaacagcacttgggcacaaatgctccatgacaacgacctgcccggcctcttccgcgtccaacccaccggaaaagtacgcatgagcaccaaatccgagccgcatatcggcatgggcgtgcagcattacggctggtttacctcgccgctgcgccgcgccgccgactacatcaaccaaaagcagctgatcagcctgatagacgacactgccgagccgctgtatcaaaacagcgatgccgagcttttcgccgcactgcgcgactttgatgccgcctataccgcctacgccgatttccaacggcagatggaagcctactggagccttgtgtacctgcaacagcaaggtacaagcgagctgaccgcgaccatcctcaaagaagacctcgtccgcatcgaaggcctgccgctggtcacgcgcgcgaccggtattccgtttgacgcactgcccaaatcacaggcattgttcaaaatcaccgaattggatgccgagaagcagtttgtctcgctcaactacatcaaggcagtcgcacccgcgggtacaacggcaggcaatgccgtctga

SEQ ID NO: 4339 - DNA, 633 bp, Neisseria meningitidis
atggagaatacaaaccgtgtgccggagcaggcacgttatgatgccgaacgcaggcaggcagacgaagcattggcgggcgtgtttccggcagtcagtatcttcggcagcgcgcgcacgccgcagaatcatgcggattatgcgttcgcctgccgtctggcgcggcggctgtcggattcgggcattgccgtcatttcgggcggcgggccggggattatggaggcggcaaacaagggcgcgtttgcagggaagtcggtttcggtggggctgaacatcgttttgccgcacgagcagaaaccgaatccgtatcaggacatcgccttgcggttttcccgttttgccgaacgcaaggcggtgtttttccgctattcccaagcatatgtcgtgatgccgggcggcttcgggacgctggacgaattgtttgaaatcctgaccttggtgcagacgggcaaagtgccgccgcgtccgattgttttggtcggaaaggcgttttggtcgggcttggcggagtggataaacgcgcagcttttggcgcgcggtctgatttccgaaggggcggtctctttgtttgccatatcggacgatgaagacgaaatcgttgcgtatctgtcggaacacgggcttcagacggcatag

SEQ ID NO: 4340 - DNA, 1371 bp, Neisseria meningitidis
atgatcaaccccatcgcctcgctttcccctttagatggccgttatgcccaatccgttgaagcattgcgcccgattttttccgaatacggcctgatgaaggcgcgcgtcaaagtcgaattaaactggctcaaagccctcgccgccgagccgaagattgccgaagtgccgcccttcagtgccgaaacgcttgccgaaatcgacacggtgattgaaaacttttcattggaagacgcggccgccgtcaaagccatcgaagccaccaccaatcacgatgtcaaagccatcgaatattggctgaaaaaacgttttgccgaagtgccggaagtcgccgccgtgagtgagttcatccacttcgcctgcaccagcgaagacatcaacaacctgtcccacgctttaatgctgcaagaagcgcgtgaggctgttttgctgccgaagctggccgaaatcatcgaaaaactgaccgctatggcgcacgaccttgccgccgtcccgatgatgagccgcacccacggccagcccgccacgccgaccactttgggcaaagaaaccgccaatgtcgtgtaccgcctgcaacgccagtttaaaaacctgcaagcgcaagagttcctcggcaaaatcaacggcgcggtcggcaactacaacgcccatatggtcgcctatcctgatgtagattgggaaacccactgccgcaacttcgtcgaaatcagcctcggtctgaccttcaacccctacaccatccaaatcgaaccgcacgactatatggcggaattcttccaaaccctcagccgcatcaacacgattctcatcgactttaaccgcgacgtttggggttatatttcattgggttacttcaaacaaaaagtcaaagcaggcgaagtcggttcttccaccatgccgcacaaagtcaaccccatcgactttgaaaactccgagggcaacctcggtatggcaaacgccgtattgggctttttgtccgaaaaactgccgatttcccgctggcagcgcgacctgaccgacagcaccgtattgcgcaatatgggcgtaggcgtgggctatgccgtattgggtttcgccgcccacctgcgcggtctgaacaagctcgaacccaaccccgccgcgcttgccgccgatttggatgccacttgggagctgctcgccgagccgattcaaaccgtaatgcgccgttacggtgtcgccaatccttacgaaaaactgaaagacctgacgcgcggcaaaggcggcatcacgcccgaagtgctgaaaggctttatcggattgctggaaatccccgccgaagccaaagccaaattgcttgagctgacccccgcgctgtatgtgggcaaggctgaagcgttggcgaaacggatttga

SEQ ID NO: 4341 - DNA, 1870 bp, Neisseria meningitidis
atgcaagctgtccgatacagaccggaaattgacggattgcgggccgtcgccgtgctatccgtcatgattttccacctgaataaccgctggctgcccggaggattcctgggggtggacattttctttgtcatctcaggattcctcattaccggcatcattctttctgaaatacagaacggttctttttctttccgggatttttatacccgcaggattaagcggatttatcctgcctttattgcggccgtgtcgctggcttcggtgattgcctctcaaatcttcctttacgaagatttcaaccaaatgcggaaaaccgtggagctttctgcggttttcttgtccaatatttatctggggtttcagcaggggtatttcgatttgagtgccgacgagaaccccgtactgcatatctggtctttggcagtagaggaacagtattacctcctgtatccccttttgctgatattttgctgcaaaaaaaccaaatcgctacgggtgctgcgtaacatcagcatcatcctgtttttgattttgactgcctcatcgtttttgccaagcgggttttataccgacatcctcaaccaacccaatacttattacctttcgacactgaggtttcccgagctgttggcaggttcgctgctggcggtttacgggcaaacgcaaaacggcagacggcaaacagcaaatggaaaacggcagttgctttcatcactctgcttcggcgcattgcttgcctgcctgttcgtgattgacaaacacaatccgtttatcccgggaatgaccctgctccttccctgcctgctgacggcactgcttatccggagtatgcaatacgggacacttccgacccgcatcctgtcggcaagccccatcgtatttgtcggcaaaatctcttattccctatacctgtaccattggatttttattgctttcgcccattacattacaggcgacaaacagctcggactgcctgccgtatcggcggttgccgcgttgacggccggattttccctgttgagttattatttgattgaacagccgcttagaaaacggaagatgaccttcaaaaaggcatttttctgcctctatctcgccccgtccctgatacttgtcggttacaacctgtacgcaaggggggatattgaaacaggaacacctccgcccgttgcccggcgcgccccttgctgcggaaaatcattttccggaaaccgtcctgaccctcggcgactcgcacgccggacacctgagggggtttctggattatgtcggcagccgggaagggtggaaagccaaaatcctgtccctcgattcggagtgtttggtttgggtagatgagaagctggcagacaacccgttatgtcgaaaataccgggatgaagttgaaaaagccgaagccgttttcattgcccaattctatgatttgaggatgggcggccagcctgtgccgagatttgaagcgcaatccttcctaatacccgggttcccagcccgattcagggaaaccgtcaaaaggatagccgccgtcaaacccgtctatgtttttgcaaacaacacatcaatcagccgttcgcccctgagggaggaaaaattgaaaagatttgccgcaaaccaatatctccgccccattcaggctatgggcgacatcggcaagagcaatcaggcggtctttgatttgattaaagatattcccaatgtgcattgggtggacgcacaaaaatacctgcccaaaaacacggtcgaaatatacggccgctatctttacggcgaccaagaccacctgacctatttcggttcttattatatggggcgggaattccacaaacacgaacgcctgcttaaatcttcccacggcggcgcattgcagtag

SEQ ID NO: 4342 - DNA, 615 bp, Neisseria meningitidis
atgaactttacccgactgctcaaccaagtcttaagcacggttcaaaaaaaaggcaacacattctccgacagcccgctcaattcattcggcggaggcgcgctggttgccggtgtcgcctccatgctgctgaacggtaaaaaccgcaaaaccatcaccaaaatcggttcgaccgccgctttgggctacctcgcctaccggggctatcagatgtggcagcaaaacaaagggcgggcaaccgtaacacaaagcgatttccaacctgccggagaaactgaagaaacatacagccgtaccgtattgcgcaccatgatagccgccgccgcttcagacggcatgatagacgaagccgaacgccggactatcgaacaggaaagcggcacagaccccgaaactgccgcatggctcgccgccgaataccgccttcccgcaagcatcgaagacatcgccgccgccgtcggcaacgatgaggcgttggcggcggaggcctatctggcggcaaggttggtctgtgccgatttgtcgcggaaagaaaccgtcttcctcgcccgcctgtcgcaggctttgaaactggatgacaatctggtggagagtttggaaaggcaattggggttttga

SEQ ID NO: 4343 - DNA, 2151 bp, Neisseria meningitidis
atgctcaccgatttagaaaaaaacgccatccgcgaccattaccaaaacatcggcaaaaacctgcccggtttccgtccgcgtgcttcgcagcgggaaatgattgcggcggttgccaacgctttttcgcggacgttggcgcgcgaagaaggcggcgagccgcccaagcgcgaaggcgagagcattgccgtgatcgaagggccgaccggcgtgggcaaatcgttggcctaccttttggccggcggcatcatggcgcaaacacgcggcaagcggctgattgtgagcagcgcgacggttgccttgcaggagcagttggtagaccgcgacctgccgtttctggtcgaaaaaagcggtttggaactgaccttcgcacttgccaaagggcgcggccgctatctctgcccctacaaactctatcgactgacgcaaagcaatgcccagcaaaacctgctcggctttgaagcccccgccgtcttgtgggacagcaaacccaagcccgaagaattgaagctgctgcgcgacatcgccgacgaattttccgcccgacggttcaacggcgaccgcgacacttggccggaaaaaatcgatgacgcgatttggctcaaagtgaccaacgaccgccacggctgcctgaaaaccgcctgtcccaaccgtccggaatgtccgttttacctagcacgcgatgtcttggaaaccgtcgatgtcgtcgttgccaaccacgatcttctgcttgccgacatcagtatgggcggcggcgtgattctgcctgcgcccgaaaacagtttctattgcatcgacgaagcgcaccacctgcccaaaaaagccctcagccgttttgccgccgaacattcatggaatattgccgtttggacgctggaaaaactgccgcagctgaccggcaaaattgccgcgctgaccgataaagccgaacttgccaacctagccgacgaagccgccgcatccttgctcgacagcctgcatgaatggcaattccatttggcggaagagccgtctttaagtctgggggtgtctgaaaacgacagacgaaccaacagcgaaccgacttggctgtgggaagacggcaaaatccccgaaggcctcgaaaccaccgtttccaatacggccattgctgcgcgcagcctgctcaaacacgttatcgggctgaacgatgcgctttctgccgcacgccgcgaaaaagaacaggacggcgcgctcctcgaccgcctgaccagcgagttcggtctttttatcgcccgtatcgaacaaatcagcgcggtttgggatttgctctccactgtccccctcgagggtgaagaaccgttggcgaaatggataacccgccgcgccgacgacaaaaacgactacattttcaacgccagccccatcagcagcgcatcccaccttgccaacagcctgtggcggcgtgcggcaggcgcggtattgacttccgccaccctgcaatccttgggcaacttcaacctgatgctgcgccaaaccgggctgcaatggctgcccgaaaccaccaccctcgccctcaaaagcccctttgactttgaaaaacagggcgaactctacatcccccccatatacgccagccccaaagaccccgaagcccacaccgccgccgtcatcgaatggctgcccaagcttatttcgcccaccgaagccatcggcacgctcgtcttgttttcctcgcgcaaacaaatgcaggatgtcgccctgcgcctgcccggagactacctgccgctcttgctcgtacaaggcgaattacccaaagccgtcctcctgcaaaaacaccaccgggccatagaagaaggcaaagccagcatcatcttcggactcgacagctttgccgaaggactcgacctgcccggcaccgcctgcgtgcaagtcatcatcgccaaacttcccttcgccatgcccgacaaccccatcgaaaaaacccaaaaccgctggatagaacagcgcggcggcaaccccttcatcgaaatcaccgtccccgaagccggcatcaaactcatccaggccgtcggccgcctcatccgcaccgaacaagactacggccgcgtaaccatcctcgacaaccgcatcaaaacacagcggtacggccaacaattattggccggcctgccgccgtttaaaaggatagggtaa

SEQ ID NO: 4344 - DNA, 231 bp, Neisseria meningitidis
atggggggtgaggtgaatcgtgcggacgtggttggttttttggttgcagcgtttgaaatacccgttgttgctttggattgcggatatgttgctgtaccggttgttgggcggcgcggaaatcgaatgcggccgttgccctgtgccgccgatgacggattggcagcattttttgccggcgatgggaacggtgtcggcttgggtggcggtgatttgggcatacctgatgattga

SEQ ID NO: 4345 - DNA, 1301 bp, Neisseria meningitidis
atgccgtctgaaaccgcccgccccctttatgcggacacgtgcgccgcacacacgctcgtctggttccgccaaaacctccgcatccgcgacaacgccgccttatgcgccgccgttgccgaagtttgcccattatcggcatttggattgacgatgccgaaacagacaaccctcgccgcgccgcgttctaccgccaatccgccgccgaactcgcccaagggcttgcagggcgcggcatcccgctctacacggcggcatctcctgccgagctcgtccggctcgccgtccgcctcaatatccgcaccgtcatcgccgacgaatcccatacttttgccgacaaactcgccgacaacgccctttggcacgaattggacaaacacggcatcgcgttaaccttcgtcaacgaccgcgccgttttcggcaaaaccgacctgatacccgacggcggcacggcatatgccgatttcgaccgctaccgcgaagtatggctcgaccgcttttccaagcagccccccgccggtccggacctattcgcggcataccgccaacccttccccgaaaacctttccgccccgcagcctgccgcgctttcagacggcatcttcctgccgcaaaacagcggcgaaacggcggcttggcggcagtggcggcggtttctcgaacaggcggattcctactccgttttaaaggatttcccctcgcgcaaacacacttcgctgatgggcgcgtatttgagtgccggctgcatctcgccgcgcctgctcgcgcgggaaagcctcgaacgccgtctgaacgcgtgggcggacaacatcatccgccgcgattttttccttcaacttgccttgcagcacacggatgacgacccttcagacggcaatcctgaacacaccctgcgcctgacgctttggcagcagggccggaccggcattccgattatcgatgccgcgatgcgctgtttgcacaaaaccggcagcctccaccccgccctgagacgcttgagcgcggattttttctgccacgttttaaacctcccccgccgcgaaggcgagatatggtttgcccgacagctgaccgatttcgatgcagcaatcaaccaaggcaactggcggcttgccgcctcacggcacacctgccccgacattgccgccgccgcacacaaaaccgaccccgacggcacctttgtcagacggcacattcccgagcttgcccacctgtccgccgacaccgtccacacgccttggcggtttgcctgttcggtcgatacccacggctatcccgcccatcctgtcgccggtattccctaa

SEQ ID NO: 4346 - DNA, 912 bp, Neisseria meningitidis
atggacaccctgttcagcctcaaggttttccgccaagtcgtccaaagcggcggcttcacccgcgccgccgacgcgctcggcatctccaccgcaatggcaagcaaacacgtcagccacttggaaaacaccgtccaagccaaactcctgcaccgcaacagccgcaacctcagcctgaccgaagccggggaagaatactaccggcaatgcagttacgcgctcgacacgctcgacgatgccgcgcaaaaagccgccggggggacggaaaaaccgcaggggctgctgcgcgtaacgatgccgctgtggtttgccggcagccagatatgcaactggctggcggaataccgcgaacgttatcccgaagtggcattagaactgattttggacaaccgccacgtcgatttgattgccgaaggcgtggatttggcgttgcgcgtttcccaaaccctgtccccgtcgctgattgcgcgcccactggcggaaatcgaatttgccctgctcgcctcgcccgatttcctgaggcgcaacggcgtgccggaaacgccggaagaagtggcggggctgcccgccgtcctgccgacctacaccaaccagcagaaactcgacctcacccgcaaatcggacggcaaaaaataccggcttgaactgacccccgtcatccgtaccgacaacacgctgatgatgcgcgaaatgattaaggcgggcgcgtgcatcggttatcagccgctttgggcggcggaacacgatttgcgctgcggcacgctggtgaggctgctgcccggatacgccgtcccgaccgaccggctgaatgccgtttatgcagacagggcattcttaagcgcgaaagtccgcagcttcatcgattttctgaacgaaaaaatcgccagcaggaaaggctgccgaaatgccgtctga

SEQ ID NO: 4347 - DNA, 399 bp, Neisseria meningitidis
atgtccgattgctgcaaccgtatccaaccggttttgctttctgttttgcgtatcgtaaccgcctacctgtttttgttgcacggtacgtcgaaaatcttcgccttccccattgaaatgggcagcggttcgcccggcgggctgttgctgcttgccggtattttagaaattgtcggcggcattttgctggtgttgggcctgtttgcgcgccctgccgcgtttgttttgtccggccagatggcggttgcctattttatggcgcacgcttccggaaatgctttgttcccgattgccaacggcggcgagtccgcagtgctgttctgcttcgtattcctctatatcgcggcggcgggcggcggagcatggtcgctggacaggctgtttttcaagcgtaaagcctga

SEQ ID NO: 4348 - DNA, 606 bp, Neisseria meningitidis
atgacccgtcaatctctgcaacaggctgccgaaagccgccgttccatttattcgttaaataaaaatctgcccgtcggcaaagatgaagttgtccaaatcgtcgaacacgccgttttgcacacaccttcttcgttcaattcccaatctgcccgcgtggtcgtgctgtttggcgaagagcatgataaggtgtggcaatttgtcgaagacgcgctgcgtgccgtcgtgcctgccgacagttttgaaccgaccgcgcaaaaattgaacctgtttaaggcgggtgcggcaaccattttgttttatgaagatcaaaatgtcgtcaaaggtttgcaggagcagttccctgcttatgccgctaacttccccgtttgggcggatcaggcaaacgcgatggtgcagtatgccgtttggacgacacttgccgcggtcggcgtaggtgcaaacctgcaacattacaatcccttgcccgatgcggcgattgccaaagcgtggaatatccccgaaaactggttgttgcgcgcacaaatggttatcggcggtattgaaggggcggcaggtgaaaagacctttgaacccgttgcagaacgtttgaaagtgttcggcgcataa

SEQ ID NO: 4349 - DNA, 2112 bp, Neisseria meningitidis; identical to SEQ ID NO: 3589

SEQ ID NO: 4350 - DNA, 696 bp, Neisseria meningitidis
atgaaactgaaaaccttagctttgacttcattgaccctgttggcattggccgcttgtagcaaacaggctgaaaccagtgttccggcagacagcgcccaaagcagctcatctgctccggcagcccctgctgagttgaacgaaggtgtgaactacactgtattgtctacgcctattccgcaacagcaggccggtaaaatcgaagtattggaatttttcggctacttctgcccgcattgcgcccatcttgagccggtcttgagcgagcacatcaaaacgtttaaagacgatacctatatgcgccgggagcatgtcgtgtggggtgatgaaatgaaacctttggcacgtttggcggccgcagtggaaatggccggtgaatcagataaagccaacagccatattttcgatgcgatggttaatcaaaaaatcaatctggccgataccgataccctgaaaaaatggctgtccgagcaaacagcgtttgacggcaaaaaagtattggctgcatttgaggctcctgaaagccaagcgcgtgcggctcaaatggaagagttgaccaataaattccaaatcagcggcacaccgactgtgattgtcggcggcaaataccaagttgaatttaaagactggcagtccggtatgaccacgattgaccagttggtggataaagtacgcgaagagcagaaaaagccgcaataa

SEQ ID NO: 4351 - DNA, 1371 bp, Neisseria meningitidis
atgttagacaatttaaccggccgcttcagcaatgtcttcaaaaacatccgggggcaggccaaactgaccgaagacaatattaaagaggccttgcgcgaagtccgcctcgccctgcttgaggcggatgtcgccctgcctgtcgtcaaagagttcatcaacaacgtcaaagaaaaggccctcggtcaggaagtagcgggcagcctgacgccggatcaggcatttatcggcgtggtcaacaaagccctgaccgaactgatgggcagggaaaacaaaacgctggatttgtcggttgcgccgcccgccgtcgtgttgatggcaggtttgcagggcgcaggcaagacgacgaccgtcggcaaactcgcccgcctgttgaaaaacgatcagaagaaaaaggttttggtggtatccgccgacgtttaccgtcctgccgcgattgaacagctgcgtctgttggccgaacaggtcggcgtggattttttcccgtccgataccaaccaaaaaccggttgaaattgcaactgccgccgtcgattacgccaaaaaacatttttacgatgtattgatggtcgataccgccggccgtttggcaatcgatgaagagatgatgaacgaaatcaaagcccttcacgcggcggttaacccggtggaaactttgttcgtcatcgatgcgatgctgggtcaggatgcggtgaacactgctcaggcatttaatgaagccctgccgctgaccggagtcgtattgaccaagatggacggcgactcgcgcggcggtgcggcattgtccgtacgccacgtaaccggcaaaccgattaaatttatcggtgtcggcgaaaaaatcaacggcctcgaacctttccaccccgaccgtcttgccggccgcattttgggtatgggcgacgtattgaccctgattgaagacgttcaaaaaggtatagacgaagaagccgccgctaaaatggcgaaaaagctgcacaaaggcaaaggcttcgacctcaacgactttaaagaacaaatccagcaaatgcgcaatatgggcggtttggaaaacctgatgtcgaaaatgccgggcgaactgggtcaaatctcgaaacaaatccccgaaggaacggctgaaaaagcgatgggcaaagtagaagccatcatcaactcgatgacccctaaagaacgcgccaaccctgccctgctcaaagccagccgcaaacgccgtattgcaatgggtgcgggcacaaccgtgcaggaagtgaacaaattgctcaaacagtttgaacaaatgcaacaaatgatgaagatgttcagcggcaacggcttgggcaaactgatgcgtatggcgaaaggaatgagggggataaaagggatgttcccgggtttgtaa

SEQ ID NO: 4352 - DNA, 807 bp, Neisseria meningitidis
atgccgacagttttcatctttttgacggcggtttacgcaggattgggtgcatttgcatggcactgccaacagcaggggtgcggccgggattacccgtggaagacggaattgccggttttgggtgcggcattgaccgtccacggcgcggcactgcttatgccggtcattcaagacaaaatcatcattatgggcttcgggtattccggcagcctgattgtttggatgatgctgtttatttattttgccggcagcttcttttatccgctgcgcggagtgcagttgctgctgtatccttgcgccgcactgatgctgctgtcaggtttggtttttcctggaaaattctcgggatatgaaattaccgaccttccctttatgctgcatatcggaacttcgctgctcgcatacgggctgttcggcatcgcaacattattgtccgttttgaccctgctgctgaatcggagcctgcaccgcaggagcttctccaagctcgcaggattcctgccgtcgctgctcagtttggaaaaactcatgttccaggccatgtgggcaggtttcatcctgctgacctattccgtcgtcagtggaacattttttgccgaagccgtattcggcaaacccatgacctttacccataaaaccgtattcggcatattgtcatggctgatttacggcggactgctgctcaagcacagcatgaccgcatggcgcggcaaaaaagccgccgtgtggaccatcatcggatttgtcagccttatgattgcctatatgggcagcaagttcgtattggaaatcattctgaaaagataa

SEQ ID NO: 4353 - DNA, 99 bp, Neisseria meningitidis
atgccgtctgagtccccgagtttcagacagcatattcacaaaggcgcaccagccggaggagggagaggaaaggattgttggaggcggcgcagtatttag

SEQ ID NO: 4354 - DNA, 186 bp, Neisseria meningitidis
atgacgaatttccccaaaaaaatcccgctgaaagcattgaccgtttttccctgtgggcgtatagttcggttcttcgctgctgcagaagtggcggacgaactgaaaagtatagcacagaatgttggggatatcgagagatatcttgacaggcggaaggaatactttataattcgcaacgctctttaa

SEQ ID NO: 4355 - DNA, 447 bp, Neisseria meningitidis
atgtcggtgatggcgggacggcatccgtacggtgtccggtcgggtttgcggaggaacggcttgaaactttgggatattcattttagaatgactcgttttatcgtcgcaagatgcggtttattgtttgcaacccttaaaggaaaaaccatgaagaaaatgttcgtgctgttctgtatgctgttctcctgcgccttctcccttgcggcggtaaacatcaatgcggcttcgcagcaggagttggaggcgctgccgggcataggcccggcgaaggcgaaggccattgcggaataccgtgcgcaaaacggtgcgttcaagtctgtagacgatttgaccaaggtaaagggcatcggccctgcggtgctggcgaagctgaaggaccaggcttcggtcggcgcgcccgcaccaaaagccccagccaaaccggtgctgcccgcggataaaaaatag

SEQ ID NO: 4356 - DNA, 305 bp, Neisseria meningitidis
atggctaaaatatgtagcattatgttctgtatcgttgtttaccgcttccgcacctttgtccgccttaaagcaggtagacaccgcaatgaatcgacgcaaagaaaatgccgtctgaacatgcgttcgggcggcgttttgttggggggtatcggagcggaacgtctgaaaaagggtttcaggcggtctttgggcgtgtggtgacagtcgaaaacgtgataaggctacctgaaaagtttgggagattttcaggtagcctttggtattgggcgcaacagacgcaggtacagattagcggtgtgccgtaa

SEQ ID NO: 4357 - DNA, 207 bp, Neisseria meningitidis
atgtttgatggagcaaaggttgtacgaagggtggaaggcaacctgtgggtgtttggtatggtcgcgcttgaaaaaacgtgttttaagggacaaatgccgtctgaaaatcggtttcagacggcattttctgtttatttaaagcaaacaggaaaaggcagcaatattctgcagtcttcctattcacacaagcgttttatagttaattaa

SEQ ID NO: 4358 - DNA, 653 bp, Neisseria meningitidis
atgaagataacgcactgcaaattaaagaaaaaagtacagaaagaactgctccgttttttgtgctggaagttaccgcccgttctgccgccgatattttgggtatccatcccaattcggcagtactgttctaccgtaaaatccgcacggttatcaaccatcatttggccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaaaaagaaaatcatgccggacagtattgtttataccgatagtctgagcagctgcgacaagttggacgtgagcggttttatccattaccgcatcaaccattccaaggaatttgcagaccgtcagaaccacattaacggcattgagaatttttggaatcaggcaaaacgcgtcttgcgaaaatacaacggaatcgatcgtaaatctttcccgctgttcttgaaagaatgcgaatttcgatttaacttcggcacaccgtctcaacagcttaaaatcctgcgggattggtgtggaatttag

SEQ ID NO: 4359 - DNA, 287 bp, Neisseria meningitidis
accaagtgaatcggttccgtactatttgtactgtctgcggcttcgtcgccttgtcctgatttttgttaatccactatattttagataatgcgtgatttcaccgtatgggtgtcttacgggaaatggcggaaaaattgggacataaggtattgcctcttgcaccttattcacctgagctcaacccgattgagaaagtgtgggcgaatattaagcggtatctgcgaaccgttttgtctgattacgcccgatttgacgatgcactactgtcctattttgattttaattga

SEQ ID NO: 4360 - DNA, 258 bp, Neisseria meningitidis
atgacgacccagatgggtgcttcccgcgatgtcagcaaaagcgccaaaggttggagtgtcggtatcggtctgaatgtaggcaaacagttgaccgacagcgtcggtctcgagtttgatccatactaccgtcacaaaacaatctacaaaccccgtgagattgtcttggacggtgacaaaaccaaaatgggccgctccaaatccaacgagtacggcttccgcgtagccgcaacgttctatagtcaattaaaatcaaaatag

SEQ ID NO: 4361 - DNA, 159 bp, Neisseria meningitidis
atgttgaaaacaaaaagaactcattgcttgaaaaaagatttaatgggaatgcgggtatttcccacactttttccatttatttatcctcattataggaagaaaaacatgaaaaaaccctgcttgcactctcacttgcagccgtgtccgccgttacggtag

SEQ ID NO: 4362 - DNA, 195 bp, Neisseria meningitidis
atgttattgcaaaggtctctccttgtgtatgaaattttgccggatgtgaaggcggaatcggcagcgggggtgttctgtaccggattgtcgtggaaatgggaaaacggatgttccgtgcaggtttgtccaaatgaatggcgggtattgtttttatcaatctgtttctttttatttgaaataaaatttctaaaataa

SEQ ID NO: 4363 - DNA, 1056 bp, Neisseria meningitidis
atgacacaccattaccccacagacgatattaagattaaagaagttaaagagttgttgccgccgatagcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcgcgcagcctgttgttgtcgctgaacaatatgggtatgcctgcctctaccgagtttttggatatgattacgccgcaatattatgcggacttgatttcttggggggcaatcggtgcgcggacgaccgaaagccaagttcaccgcgaattggcaagcgggctgtcctgccccgtcggctttaaaaacggtacggacggcaatttgaagattgccatcgacgcaatcggtgcggcgagccattcgcatcatttcctgtctgtaaccaaggccgggcattccgccattgtccataccggcggcaatcccgactgtcatgtcattttgcgcggcggcaaagagccgaattatgatgcggaacacgtcagcgaggcggcggaacaactgcgtgcggcaggggtaaccgacaagctgatgatagattgcagccacgccaacagccgcaaggattacactcggcagatggaagtggcacaagacattgccgcccaattggaacaggacggcggcaatatcatgggcgtgatggtggaaagccatttggtcgaaggcagacaggacaagccggaagtgtacggcaagagcattaccgatgcgtgtatcggttggggcgcgactgaagaactgttggcattgttggcaggtgcaaacaaaaaacgtatggcgcgcgccagttga

SEQ ID NO: 4364 - DNA, 489 bp, Neisseria meningitidis
atgctcaaaataaccctaattgcggcgtgtgcggaaaacctgtgcatcggggcgggcaatgctatgccttggcacatccccgaagatttcgcatttttcaaagcctataccttgggcaaacccgtcattatggggcggaaaacgtgggaatccctgcccgtcaaacccctgcccggacggaggaacatcgtcatcagccggcaggcggattattgcgcggcaggcgcggaaacggcggcaagtttggaggcggcattggcattgtgcgcaggcgcggaagaagccgtcattatgggcggcgcgcagatatacggacaagcgatgccattggcgaccgatttgcggataaccgaagtggatttgtctgtggaaggagatgcatttttccccgcaatagaccggacgcattggaaagaagcagagcggacggaacgccgtgtcagcagcaaaggcacgcgctatgcttttgtgcattatttgagatattga

SEQ ID NO: 4365 - DNA, 477 bp, Neisseria meningitidis
atgccgatagaaatcgaacgccgttttttgattggaaacgacaactggcggcaatacgccgacgaaccgctgctgttgaggcagggttatctgtctgttgaaaaagaacgcaccgtccgtgtccgcattgccggaaaacaggcgtggctgacgctgaaaggctatatttcggaaatcagccgcagtgagtttgaatacgaaatcccgcttgccgatgcggaaaagatgatggaaacgatgtgcccgtttaaaatggaaaaatggcgttatccggtcagatggggcggcagcctgtttgaaatcgatgtttttcttggcgataatgcgcctttggtcgtcgcggaaatcgagttgcccgacgagaatgccgattttgaccgtccggactggctgggacgggaaatcactgccgacggtatgtttaccaatgcttatttgagcaggcatccgttctcaagctggaaaaatgccgtctga

SEQ ID NO: 4366 - DNA, 429 bp, Neisseria meningitidis; identical to SEQ ID NO: 759

SEQ ID NO: 4367 - DNA, 246 bp, Neisseria meningitidis
atgctcaaatccatcgaactcaattcccacatccgcaaccgccttgcagaatatctgaaaggcaggggtatggattttcagacggcaatgcaggaagaaaaaggcaacaaagaaatcgccgccatcgtccacagcggtttgcccactctggtccgcaaactgtattccgaacaaaaaatgcagaagtttttttgggaaaagcgggatttgattgccgactacatcagccgccggatgcagggatag

SEQ ID NO: 4368 - DNA, 2092 bp, Neisseria meningitidis
atgacactgaaagcaagcaagcaagcaagcaagcaagcaagcaagcggtcgggttaatctattaacattatctgttttatcgctgttttgcacgccatatgtttgaggttcggatgcgtacgatcccgtcaaagaagccgagattaaaaacaaatttattttagaagcggcggaagacagaaattcccacgtttggcgcggcccgtgcagcatatcttttgattgcttcggtatgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaattacaatagcggcatcctcgccgtcgataatatgcccgttgtcaaaaaatatattacagagaagtatggggctgatttaaagcaggcggttaaaagtcaattacaggatttatacaaaacaagaccggaagcttgggcagaaaataaaaaacggactgaggaggcgtatatagcacagtttggaacaaaatttagtacgctcaaacagacgatgcccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatacgctggaaacttccgataatgcccgcatccgcctgaacacgaaagatgaaaaactgaccgtccataaggattatgcgggcggcgcggatttcctgttcggctacgacgtgcgggagtcggacgaacccgccctgacctttgaagacaaagtcagcggacaatccggcgtggttttggaacgccggccggaaaatctgaaaacgctcgacgggcgcaaactgattgcggcaaaaacggcggattccggttcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgtttgggctgcgtgccgccgacaggggcgacgacgtgtatgccgccgatccgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagccgactggcaatcggcgtgatgggcggcagggccggccagcacgcatcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgcacgcatcggatatggcaaaaggacggacggcgacaaagaagccgcattgtcgctcaaatggctgttttga

SEQ ID NO: 4369 - DNA, 1467 bp, Neisseria meningitidis
atggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcagcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 4370 - DNA, 969 bp, Neisseria meningitidis
atgaaactcaccctcgccattccctcgctcaatttggatgaagacgaaatccgaatacctctatgcctgcacgctttcaacaaaatcctgcaatacggctcgctgcaccgccaaagctgcacggcttcggcattttacgcgcgttatttgtggtgcggcagactggtggaacgcgcggcgcaaagcctgaatatgccgtctgaagccgtcgcgctcgccacgcccgtctggcaaaagatggggatgcatcaggcaaatgtgctaacggcggaatatctgaacgtcggtacggatgaagcggaacggatctgccgcgacctgtcggcgttttacggcgacattccatggcgtttcgttcccgtcctgcccgaattatggctggtttcccttccttgcgcgtaccgctggggcgcgaagcccgttttggacttgggcggattgttgggcgctgacgatcagccggacggagaagatgcgttggaatggctgcgcgtccaaaccgaaatccaaatgtggctggcggcgcaccccgtcaaccataaccgcaagaaacgcgggctgcccgagttgaacggcttatggctttgggacggcacaaacggcggcgcgcaaggcggcacgcttttcgccgatacggtttggagccgtttccactccgaccgccgcgcattacccgacaacttccgcgcctatgaagaaacggcggcacacctgcccgacacgcaccatatcctgtttatggacgatttgcgcctgaccgccctgacaggggacagggagcggtatgcggcaatattgcagcagtgggaagaacgctggttcgcaccaatctacgaagccgtccgcaccggcaaaatcaaacggctggacatcaccacggacggacaacacggcggtacgctgaccttcaaacccgccgacaggtggaaattttggcgcggcgcgaaaacctttgacggaatctggtga

SEQ ID NO: 4371 - DNA, 1293 bp, Neisseria meningitidis; identical to SEQ ID NO: 2219

SEQ ID NO: 4372 - DNA, 687 bp, Neisseria meningitidis; identical to SEQ ID NO: 261

SEQ ID NO: 4373 - DNA, 474 bp, Neisseria meningitidis
atgtcccgcaacaacgaagagctgcaaggcatctctcttttgggcaatcaaaaaacccaatatccgaccggctacgcgcctgaaattctcgaagcattcgacaacaaacatcccgacaacgactatttcgtcaaattcgtctgtcccgagttcaccagcctctgccccatgaccgggcagcccgacttcgccaccatctacatccgctacattccgcacatcaaaatggtggaaagcaaatccctgaaactctacctcttcagcttccgcaaccacggcgattttcatgaagactgcgtcaacatcatcatgaaagacctcattgccctgatggatccgaaatacatcgaagtattcggcgagttcacaccgcgcggcggcatcgccattcatccgtttgccaactacggaaaagcaggcaccgagttcgaaacattggcacgcaaacgcttgtttgagcacgacgcacaataa

SEQ ID NO: 4374 - DNA, 1155 bp, Neisseria meningitidis
atggatacgcacacggacgaaacaaaacttcaaaacacgcaagccaaacgcaaacgccgcctgacggcattgacgctgctgttcgcgcttgccgccgcagccgccgggtcggcgttttttttatggtggcagcacgaagaggaaacggaagacgcttatgttgccggacgcgtggttcaggttacgccgcaaaagggcggtacggtgcggaaggttttgcacgacgatacggatgccgtgaaaaaaggcgacgtgctggcggtattggacgacgataatgatgtgctggcttacgagcgggcaaaaaacgagctggttcaggcggtgcggcaaaaccgccggcaaaatgccgccacttcgcaggcgggggcgcaggttgccttgcgccgggcggatttggcacgcgcacaggatgatttgcgccgccggtctgctttggcggaatcgggcgcggtgtccgccgaagagctggcacacgcccgtgcggcagtgtctcaggcgcaggcggcggtcaaagcggctttggcggaagaatcttcggcacgtgcggctttgggcggtcaggtttctttgcgcgaacagccggcggttcagacggcaatcggcaggttgaaagatgcgtggttgaaccttcagcggacgcaaatccgcgcgccggcggacggtcaggtggcgaagcgttcggtgcaggtcgggcagcaggtggcggcaggcgcgccgctgatggcggtggtgccgctgtcggatgtgtgggtggatgctaattttaaagagacgcagttgcggcatatgaaaatcggacagcctgccgagctggtgtccgatttgtacggcaaacaaattgtttatcgcggcagggtggcaggtttttcggcaggtacgggcagcgcgttttcgctgattccggcgcaaaacgcaacgggcaactggattaaagtggtgcagcgcgtccccgtccgtatcgtgctgaaccgcgaagatgtggacaggcatccgttgcgtatcggtttgtcgatgacggttaaagtggatacttccgccgcaggcgcgcctgtttcaaaaacgccgggtgcggcattgccggaaatggaaagtaccgactggtcggaagtcgatcggacggtcgatgaaatcctcgggcaatccgcgccctga

SEQ ID NO: 4375 - DNA, 1527 bp, Neisseria meningitidis
atggattatccaccgcttaagggtgcggcattggcgtgggttacgctgtctttggggcttgccgtatttatggaagttttagatacgactatcgccaatgtcgccgttcccgtcatcgccggcaacctcggtgcggcaaccactcaggggacgtgggtcatcacttccttttctgtggcaaacgccgtttccgtgccgctgacgggctttttggcaaaacgcatcggcgaggtcaaattgtttaccgccgccgctgtcggtttcgtcatcacatcgtggctgtgcggtattgcccccaaccttcagtcgctggttgttttccgcatcttgcagggctttatcgccgggccgctgattcccttgtcgcaaagcctgttaatggcatcctatccgcccgcaaaacggacgctggcactggcattgtgggcaatgaccgtcgttgtcgcccctgttctcgggccgatactcggcggctggatttccggaaactggcattggggttggattttcttcattaatatccctatcggtatcatatcggcatggattacatggaaacatttgaaatatcgggaaacggaaaccgttaaaatgccgaccgactatgtcgggcttacattgatggtagtcggtatcggcgcgttacagatgatgctggacaggggtaaggaactcgactggttcgcctctggagaaatcattaccttgggcgtagtcgcactggtgtgcttgtcgtattttattgtttgggaattgggagaaaaatatccgattgtcgatttatcgctgtttaaagatcggaattttaccgtcggcgtcattgccacgtcattgggttttatggtgtatatggggacgctgaccctgctgccgttagtgttgcagaccaacctgggctatacctccacgtgggcagggcttgccgccgcacctgtcggcatcctgcctgttttcctgtctccgttaatcggcaggttcggcaataaaatcgatatgcgcctgttcgtaactgccagcttcctgacctttgcctttactttctattggcgtacggatttttatgccgatatggatattggcaacgtcatctggccgcagttttggcagggtgtcggtgtcgccatgttttttctgccgctgaccaccatcacactgtcgcatatgaagggcgggcagattgccgccgcaggcagcctgtcgaatttcttgcgcgtgctgatgggcggtgtcggcgtatccgtcgtcagcaccctgtgggaacggcgcgaagcgttgcaccacacacgctttgccgaacacatcacgccctattccgcaacattgcacgaaacggccgctcatttgtcccagcacggcgtttccgacattcaaaccctaggcatcatcaacaataccattacccagcagggttttattatcggctcgaacgaaatctttatggcgggcagcttgttattcattatcatgatacccgtcatatggctggcaaaaccgccgttccacaacggcggcggcggtggacattga

SEQ ID NO: 4376 - DNA, 150 bp, Neisseria meningitidis
atgcagcagttcccgaaatccgctataatcgcgccccatctgtttcgcacctgcaaacgttccacagatgcgacaatcggaaggattatccgcgcaaaacagccgtttttctttaaaacacttgaactaacactgtttttcgtggtataa

SEQ ID NO: 4377 - DNA, 234 bp, Neisseria meningitidis
atggcacgagtttgcaaagtgaccggcaaacgcccgatgtccggcaacaacgtatcgcacgccaacaacaaaaccaaacgccgttttttgcccaacttgcaatcacgtcgtttttgggtagaaagtgaaaaccgctgggttcgcctgcgcgtttccaacgctgcactgcgtaccatcgacaaagtaggcattgatgtcgtattggctgatttgcgtgctcgcggcgaagcttaa

SEQ ID NO: 4378 - DNA, 156 bp, Neisseria meningitidis
atgcgcgataaaatcaaactggaatccagtgcaggtactggtcacttctacaccactaccaaaaacaaacgcactatgcccggcaaattggaaatcaaaaaatttgacccagttgcccgcaaacacgtagtgtataaagaaactaaactgaaataa

SEQ ID NO: 4379 - DNA, 1185 bp, Neisseria meningitidis
atgagtttacacagcgacatcctcgtcgtcggcgcaggcccggcgggtttaagttttgcagccgaacttgccggcagcggtttgaaagttaccctgatcgaacgcagcccactgactgttctgcaaaatcctccatatgacggacgcgaaatcgccctgacccatttttcccgcgaaatcatgcagcgtttgggtatgtgggacaaaattcccgaaaacgaaatctaccctttgcgcgatgccaaagtgctgaacggacgttccgactaccagctccactttccccaaccgactgaagcgcgcggcgaacctgccgactgtttgggctatctgatttccaaccacaatatccgccgcgccgcctatgaagtcgtatcacaactcgacaatgtcagcattctgaccgatacggttgtcaaagaagtcaaaacatctgacaacgaagcacaagtcattttggaaaacggcaaaatactgactgcacgcctgcttttggcggcagacagccgcttctcgcaaacccgtcgacaactcggtatctcctccgatatgcacgattacagccgaaccatgttcgtctgccgtatgaaacataccctttccaaccaacataccgcttacgaatgcttccattacggacgcaccatcgcactgctgccgctggaagagcacctgaccaataccgtcattaccgtcgataccgataaaatcaacagcgttcaaaacctttcgcccgaagaattggcggcaagcgtaaaagaacagctcaagggcaggctcggcgatatggaattggtcagcagcatccaccattacccccttgtcggcatgattgccaaacgtttctacggcaaacgcagcgcgctgattggcgatgccgccgtcggtatgcaccccgttacagcacacggtttcaacttggggctttccagcgcagatattttggcaaaactgatactcgaagccgaacagcgcggtcaagacatcggtgcatcttcattattggaaaaatacagcagcaaacatatgctgcacgcccatccgctttatcacggaaccaatatgatgctgaaactgtttaccaatgagaccgcaccggcaaaactgttgcgcggcttggtattgcgtgccagcaacaatttcccaccgctgaagaaactgatcaccaaacaactgaccggttga

SEQ ID NO: 4380 - DNA, 273 bp, Neisseria meningitidis
atggcaagtaaaaaagcaggcggcagcacccgcaacggtcgcgattcagaagccaaacgcttgggcgttaaagcctacggcaacgagctgattcccgcaggttccatcatcgtacgccaacgcggtaccaaattccacgcaggcgacaacgtaggtatgggcaaagaccacactttgttcgccaaagttgacggttatgtcgaattcaaaaccaaaggcgcgctgaaccgtaaaactgtcagcatccgtccttacaccggttctgaagaataa

SEQ ID NO: 4381 - DNA, 309 bp, Neisseria meningitidis
atgtacgcggtcgtaaaaaccggcggcaaacagtataaagtttccgtcggcgaaaaattgaaagtagaacagataccagccgaactcgacagccaaatcgaactgaccgaagttttgatgattgctgacggcgaatctgtaaaagttggcgcaccctttatcgaaggtgcaaaagtaacggctaaagtagtggcacacggtcgtggcgaaaaagtccgcatcttcaaaatgcgccgccgcaaacactaccaaaaacgccaaggccaccgccaaaatttcacccaaatcgaaatcgtggcaatcgcctaa

SEQ ID NO: 4382 - DNA, 975 bp, Neisseria meningitidis
atgctcgagaatctgccctatttccagcgacatctgcctgaagaccttgccaaagtcaatgaagtcatcaaccgtgcggtgcaatccgatgtcgcactgatttcgcaaatcggtacatatatcatcagcgcgggcggcaaacgcctgcgtccgattatgacgattttggcgggtaaggcggtcggttatgatgacgagaaactgtattcgctggcggcgatggtcgagtttatccacacttccaccctcctgcacgacgatgtcgtcgatgaaagcgatttgcgccgtgggcgggcaacggcaaacaatctgttcggcaatgcggcggctgtgttggttggcgactttttatacacgcgcgcctttcaactgatggttgcctcgggcagtatgcgcgttttggaagtgatggcggatgcaaccaacattattgccgagggcgaagtcatgcagctgatgaacatcggcaatacggacattaccgaagaacaatatatccaagtcatccaatataaaacggcaaaattgtttgaagctgccgctcaagtcggcgcaattttgggcaaggcttcccccgaacacgaacgggcgttgaaagactacggtatgtatgtcggtacggcattccaaattattgacgatgtgctggactattctggcgaaaccgaagaaaccggcaaaaacgtcggcgacgatttggcggaaggaaaaccgactttgcctttgatttatctgatgcgtcagggttccgaacaggttgcgaacgatgtgcgtactgctttggaaaatgcagatcgcagctattttgagaaaatccacgattatgtcgtccgttcggatgcgttggcatattcgataggcgaggcgcgcaaagcagtcgattgtgccgttaccgccttggatgccctgcccgacagcgaagtgaaggatgccatgattcagctggcgaaggaatctttggtcagggtgtcttga

SEQ ID NO: 4383 - DNA, 448 bp, Neisseria meningitidis
atgaatttcagttttgttcccctgtttctggttacgctgattctgttgggggtggtcagcaacaacaattcgattaccatctcggcaaccatattgctgctgatgcagcagacggcattgatacagtttgtcccgttggtcgagaagcacgggttgaatctcggtatcattcttttgaccataggggttttgagtccgttggtttcaggaaaggcgcaggttcctcccgttgccgaatttttgaattttaaaatgatatccgccgtttttatcggtattttcgtggcttggctggcgggacgcggcgtgccttatgatgggacagcagcctgttttaattacagggctgttaatcgggacggttatcggggtggcatttatgggcggtatccctgtcgggccgctgattgcggccggcatcttgtcttttgtcgtcggaaagggttaa

SEQ ID NO: 4384 - DNA, 105 bp, Neisseria meningitidis
gtgttgcgggaagtttccgatataaggcctttcagtgttggagggcttttttgccatctgaaaactttttcttcctgcttgaaaaaccgacctttaggacggtag

SEQ ID NO: 4385 - DNA, 1677 bp, Neisseria meningitidis
atgagcgtaggtttgctgaggattctggttcaaaaccaggtggttactgttgagcaggccgagcattactacaatgagtcgcaggcgggtaaggaagtgttgccgatgctgttttcagacggtgtcatttcgcccaagtcgcttgcggcattgattgcgagggtgttcagttattcgattcttgatttgcgtcattatccgcgccacagggtgctgatgggggtgttgacggaggagcagatggtggagttccactgtgtgccggttttccgtcggggcgacaaagtattttttgcggtttccgatccgacacagatgccgcaaattcagaaaaccgtttctgccgcagggattgaggttgagttggtcattgtcgaggatgaccagttggcgggtttgctcgattgggtgggttcgcgttcgacatcgctgcttcaggagcttggggaggggcaggaggaagaggaaagccacaccctgtatatcgacaacgaggaggcagaagacggccctgttccgaggtttatccataagactttgtcggatgccttgcgcagcggggcatcggacatccatttcgagttttacgaacacaatgcccgtatccgtttccgtgtggacgggcagctccgcgaggtggttcagccgcccattgcggtaagggggcagcttgcttcacggattaaggtaatgtcgcgtttggacatttccgaaaaacggataccgcaggacggcaggatgcagctgacctttcaaaagggcggcaagcctgtcgatttccgtgtcagcacattgccgacgctgtttggcgaaaaggtcgtgatgcggattttgaattccgatgccgcgtctttgaacatcgaccagctcggttttgagccgtttcagaaaaaattgttgttggaagcgattcaccgtccctacgggatggtgctggtaaccggtccgacgggttcgggtaagacggtgtcgctctatacctgtttgaatattttgaatacggagtcggtaaatattgcaacggcggaagaccctgccgagattaacctgccgggcatcaatcaggttaacgtcaatgataagcagggcctgacttttgccgctgctttgaagtctttcctgcgtcaggacccggacatcattatggtcggtgagattcgtgatttggaaactgccgatattgcgattaaggcggcacaaacagggcatatggtgttttccaccctgcacaccaataatgcgccggcgacgttgtcgcgtatgctgaatatgggtgtcgcgccgtttaatattgccagttcggtcagcctgattatggcgcagcgtcttttacgcaggctgtgttcgagctgcaaacaggaagtggaacgcccgtctgcctctgctttgaaggaagtcggcttcaccgatgaggaccttgcaaaagattggaaactttaccgcgccgtcggttgcgaccgttgccgggggcagggttataaggggcgtgcgggcgtgtatgaggttatgcccatcagcgaagaaatgcagcgtgtgattatgaacaacggtacggaagtggatattttggacgttgcctataaggagggtatggtggatttgcgccgggccggtattttgaaagttatgcagggcattacttcattggaagaggtaacggcaaataccaacgattag

SEQ ID NO: 4386 - DNA, 210 bp, Neisseria meningitidis
atgactgaatcgcggcaaacacgccttcaagtcaaatgtccgacctgtcaaacagcagtagtatggaaacccgaaaacgcattccgccccttctgttcgcaacgctgcaaactgatcgacttgggcggatgggcagacgggaaatatacggtttccggccaaacggaaagtttgccggaaatatccgaacccgacatggcataccgctga

SEQ ID NO: 4387 - DNA, 633 bp, Neisseria meningitidis
atgacggtatgggtcggactgaccggcggaatcggcagcggcaaatcggcagccgcgcaatgttttgccgatttgggcgtgccgcgcatcgatgcagacgcggcggcgcactcgctgacggcttcagacggcatcgccctgccggaaatcaggcggctgttcggcgacaccgtttttgacacacagggtttgttgcggcgcgacatattgcgtaaagaagtctttgcctccccatcgcgaaaagccttgctcgaatccgtgatgttgccgctgattttctcagaaatcaaaaaacagcaagaaacctttactgatgcagcttacggcattgtcgaaattccgctgctgacggaaaagcgtcaatttatcagcctgatacggcgtgtcctgaccataagtgcccctgtggaaaaacgtatcggcagggtgatggcccgcagcgggctgacgcgcggcgaggtggcggccgtcatcagccatcaggcatccgaatccgaacgcctgctgcttgcagacgatgtgctgctcaatgacggcagcctcaaaagcctgcgtgagaaaacaatgcgcctgcacgcgttttattcagggattttcgcctcaaaaccaacacaaggaaaacacaatgactga

SEQ ID NO: 4388 - DNA, 861 bp, Neisseria meningitidis
atgtctgatttgtctgtattgtcgccgtttgccgtgcctttggcagcggtgttcgggctgctggtcggaagtttcttaaatgtcgtcatttaccgcgtgccggtcatgatggaacgcggctggacggtatttgccaaagaatatttaaacctgccgctgaccgaagaggaaagccgtaccttcaacctgatgaaaccggattcctgctgtcccaaatgccgcgtgccgatacgcgcgtggcagaacatcccgattgtcagctacctgctcctgcgcggcaaatgcgcttcctgccaaaccaaaatcagcatacgttatcccttaatcgagctgctgaccggcgtattgttcgggctggtcgcctggcaatacggctggtcttggattacgctgggcggattggtactgaccgcgtttctgatttccctgacctttatcgatgcggacacccaatacctgcccgactcgatgacactgcccttaatttggctgggtctgatatttaatttggacggcggcttcgtgcctttgcagtctgccgttttaggtgcggtcgccggctatggttcattatggctcttatgtgcagtgtataaactgctcacaggaaaaaccggtatgggcaacggagatttcaaactgattgccgcattgggcgcgtggctcggcatatccgcattgcccgtactgatttttgtttcctcgctgatcggtttggtcgcggcaatcgttatgcgcgtcgccaaggggcagcattttgccttcggccccgcactgacagtttcgggctggataatttttacggcaaacgattccgtatggcgggcggtcaactggtggctgacccatccggtgctgtaa

SEQ ID NO: 4389 - DNA, 1233 bp, Neisseria meningitidis
atggctaaaaacggaggattttctttgttcgcaaagaaagaaaaacgctttatctttgaaggcaggcattccgcctccgacaaactggtcaacggcgaagtatccgcgtttaccgaagaagaggcgcgcaaaaaactggcaaaacgcggcatccgcccgttgcagattacccgtgtgaaaacaagctccaagcgcaaaatcacacaagaagacatcaccgttttcacccgccagctgtccacgatgattaaagcgggcctgccgctgatgcaggcatttgaaatcgtggcgcgcggacacggcaacccgtctatgacggaaatgctgatggaaatccgaggcgaagtggaacagggcagctcgttgagccgcgcattctcaaaccacccaaaatatttcgaccgcttctactgcaatctggttgcggcgggcgaaacgggcggcgtattggaaagcctgctggacaaattggcaatttacaaagaaaaaacccaggccatccgcaaaaaggtaaaaaccgcactgacctatccggtatccgtcatcgccgtcgccatcggtttggtattcgtgatgatgattttcgtactgcccgcctttaaagaagtttacgccaatatgggcgcggagcttcccgcactgacccaaacagtgatggatatgtccgactttttcgtctcatacggctggatggtgctgatcgcactgggctttgccatatacggcttccttaaattgaaggcgcgttcgattaaaatccaacggcgtatggatgccatactgctgcgtatgccgattttcggagacattgtccgcaaaggaacgattgcccgctggggcaggacgacggcgacgctgattgcggcaggcgtgcctttggtcgatgtattggactccactgccggcgcggcgggcaatttaatctatgaagaagccacccgggaaatccgtacgcgcgtcatccaaggtttgtctatgacttcggggatgcgtgcgacggaactgttccccaatatgatgttgcagatgtcttccatcggcgaggaatcgggttctttggacgatatgctcaacaaagccgccgaattttacgaagacgaggtggacaatgcggtcggcaggctgtccgctatgatggagccgatcattatcgtgattttaggcttggtcatcggcacgcttctggtcgccatgtatctgccgctgtttaatttgggcaacgtggtcgcctga

SEQ ID NO: 4390 - DNA, 1644 bp, Neisseria meningitidis
atgaatgcttttacccgtgcatggtatgcgctcgaacgccattatcaggatacgcgtcatgtccttttgcgcgaccgctttgcctgcgaaccggaccggtttgagcgtatgcacgagcgtttggacgggatgttgttcgattacagcaaaaaccgtttgggcgaagatacgctgcaactgctctgcaatcttgccgacgcggcggatttggaagggaaaatgcgtgctttgcggacgggtgcgaaagtcaacggcagcgaggggcgtgccgcgctgcatacggctttgcgcctgcccgacggtgcggatgccgtttatgtggacggcagggacgtgttgcccgaaatccgccgcgagttaaatcgtgcgttgaagtttgcacacagtttggacgacggttcgtatcaggggataaccggaaaacggattacggattttgtccacatcggcataggcggatccgacctcgggccggcaatgtgcgtgcaggcacttgagccgttcagacggcatatcaccgtccattttgccgccaacgccgatcctgcctgcctggatgcggttttatgccgtctgaaccccgaaacgacagtgttttgcgttgccagcaagtccttcaaaacaccggaaaccctgctcaatgcacaggcagtcaaggcgtggtatcgcggtgcagggttctcggaatccgaaacggcgtgccatttttgcgcggtgtctgccgacactgcggcagctgcggcttttggtatcgcggcggaacgcgtgtttgcgatgtacgactgggtgggcggacgctattccgtctggtcgcccgtcggtttgcccgtgatggttgcggtcggcggggcgcgtttccgcgagttgttggcgggggcgcacgcgatggacaggcattttttcagtacgccgacgcgtcataatatccccgttttaatggcactgattgccgtgtggtacaacaatttccagcacgcggacgggcagaccgccgttccgtacagccacaacctgcgcctgctgccggcgtggctgaaccagctcgatatggagagtttgggcaaaagccgcgcttcagacggcagtcccgccgtgtgcaaaacgggcggcatcgtgttcggtggtgaaggggtcaactgccagcacgcctatttccaactgctccaccaaggcacgcgcctgattccctgcgattttatcgtcccgatgacggcgcagggcagagaggacggacgcagccgttttaccgttgccaacgcctttgcccaagcggaagccttgatgaagggcaaaaccttggacgaagcacgcgccgaactggcagatttgcccgaagcggaacgcgaacgcctcgcgccgcacaaagagttccccggcaaccgccccagcaacagcattttgattgaccgcctcacgccctacaatttgggtatgctgatggcggcttacgaacacaaaaccttcgtccaaggcgcgatatggaacgtcaaccccttcgatcagtggggggtggaatacggcaaacagttggcaaaaaccatcatcggcgaactggaaggcggcacgtccgtacacgatgcctcgaccgaagggctgatggcgttttaccgcgaatgccgtctgaaaggcggcggcgcggcataa

SEQ ID NO: 4391 - DNA, 822 bp, Neisseria meningitidis
atgtctttgcaaaacattatcgaaaccgcctttgaaaaccgcgcggacatcaccccgaccaccgttactcccgaagtcaaagaagccgtgttggaaaccatccgccaactcgattccggcaaactgcgcgttgccgaacgtttgggcgtgggtgagtggaaagtcaacgaatgggcgaaaaaagccgtgttgctgtccttccgcatccaagacaacgaagtcctcaacgacggcgtgaacaaatacttcgacaaagtgccgaccaagtttgccgactggtctgaagacgagttcaaaaacgcaggcttccgcgcagttccgggtgcggttgcccgacgcggcagctttgtggcgaaaaatgtcgtgctgatgccatcttatgtcaacatcggcgcatacgtcgacgaaggcgcgatggtcgatacttgggcaaccgtcggctcttgcgcgcaaatcggtaaaaacgtgcacttgagcgggggcgtcggcatcggtggtgtactcgaacccctgcaggccgcacccaccatcattgaagacaactgcttcatcggtgcgcgttctgaaatcgttgagggcgtgattgtcgaagaaggcagcgtgatttctatgggcgtgttcatcggtcaatccaccaaaatctttgaccgtacaaccggcgaaatctatcaaggccgcgtaccggcaggttcggttgtcgtatccggcagtatgccttccaaagacggcagccacagcctttactgcgccgtcatcgtcaaacgcgtggacgcgcaaacccgtgcgaaaaccagcgtcaacgaattgttgcgcggcatctga

SEQ ID NO: 4392 - DNA, 786 bp, Neisseria meningitidis
atgggttttctgcaaggcaaaaaaattctgattaccggcatgatttccgagcgttccatcgcttacggcatcgccaaagcctgccgcgaacaaggcgcggaactggcgtttacctacgttgtggacaaactggaagagcgcgtccgcaaaatggcggcggaattggattccgaacttgtattccgctgcgatgtcgccagcgacgacgaaatcaaccaagtgttcgccgacttgggcaaacattgggacggcttggacggtttggtgcattccatcggttttgcgccgaaagaagccttgagcggcgacttcctcgacagcatcagccgcgaagcgttcaacaccgcacacgaaatttccgcatacagcctgcccgcgttggcaaaagccgcccgtccgatgatgcgcggcagaaattccgccatcgtcgccctgagctacttgggcgcggtgcgcgcgattccgaattacaacgtgatgggtatggcaaaagccagccttgaggcaggcatccgctttaccgctgcctgtctgggtaaagagggcatccgctgcaacggtatttccgccggcccgattaaaacgcttgccgcctccggcatcgccgatttcggcaaactcttgggacacgtcgccgcccacaacccgctccgccgcaacgttaccattgaagaagtcggcaataccgccgccttcctgctgtccgacctgtcgtccggcattaccggcgaaatcacttacgttgacggcggttacagcattaatgccttgagcaccgagggataa

SEQ ID NO: 4393 - DNA, 999 bp, Neisseria meningitidis
atgagcagacccgtacccgccgtattcggcagcgtttttcacagtcaaatgcccgtcctcgcctaccgcgaaggcaaatggcagccgaccgaatggcaatcttcccaagacctctccctcgcaccgggcgcgcacgccctgcactacggcagcgaatgtttcgagggactgaaagccttccgtcaggcagacggcaaaatcgtgctgttccgtccgactgccaatatcgcgcgtatgcggcaaagtgcggacattttgcacctgccgcgccccgaaaccgaagcttatcttgacgcgctaatcaaattggtcaaacgtgccgccgatgaaattcccgatgcgcctgccgccctgtacctgcgtccgaccttaatcggtaccgatcccgttatcggcaaggccggttctccttccgaaaccgccctgctgtatattttggcttcccccgtcggcgactatttcaaagtcggatcgcccgtcaaaattttggtggaaaccgaacacatccgctgcgccccgcatatgggccgcgtcaaatgcggcggcaactacgcttccgccatgcactgggtgctgaaggcgaaagccgaatatggcgcaaatcaagtcctgttctgcccgaacggcgacgtgcaggaaaccggcgcgtccaactttatcctgattaacggcgatgaaatcattaccaaaccgctgaccgacgagtttttgcacggcgtaacccgcgattccgtactgacggttgccaaagatttgggctataccgtcagcgaacgcaatttcacggttgacgaactcaaagctgcggtggaaaacggtgcggaagccattttgaccggtacggcagccgtcatctcgcccgttacttccttcgtcatcggcggcaaagaaatcgaagtgaaaagccaagaacgcggctatgccatccgtaaggcgattaccgacatccagtatggtttggcggaagacaaatacggctggctggttgaagtgtgctga

SEQ ID NO: 4394 - DNA, 483 bp, Neisseria meningitidis; identical to SEQ ID NO: 2733

SEQ ID NO: 4395 - DNA, 1170 bp, Neisseria meningitidis
atggacaacgaattgtggattatcctgctgccgattatccttttgcccgtcttcttcgcgatgggctggtttgccgcccgcgtggatatgaaaaccgtattgaagcaggcaaaaagcatcccttcgggattttataaaagcttggacgctttggtcgaccgcaacagcgggcgcgcggcaagggagttggcggaagtcgtcgacggccggccgcaatcgtatgatttgaacctcaccctcggcaaactttaccgccagcgtggcgaaaacgacaaagccatcaacatacaccggacaatgctcgattctcccgatacggtcggcgaaaagcgcgcgcgcgtcctgtttgaattggcgcaaaactaccaaagtgcggggttggtcgatcgtgccgaacagatttttttggggctgcaagacggtaaaatggcgcgtgaagccagacagcacctgctcaatatctaccaacaggacagggattgggaaaaagcggttgaaaccgcccggctgctcagccatgacgatcagacctatcagtttgaaatcgcccagttttattgcgaacttgcccaagccgcgctgttcaagtccaatttcgatgtcgcgcgtttcaatgtcggcaaggcactcgaagccaacaaaaaatgcacccgcgccaacatgattttgggcgacatcgaacaccgacaaggcaatttccctgccgccgtcgaagcctatgccgccatcgagcagcaaaaccatgcatacttgagcatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagtgcgagaaagaagccgcgcaaaccgccgtcgagcttgtccgccgcaagcccgaccttaacggcgtgtaccgcctgctcggtttgaaactcagcgatatgaatccggcttggaaagccgatgccgacatgatgcgttcggttatcggacggcagctacagcgcagcgtgatgtaccgttgccgcaactgccacttcaaatcccaagtctttttctggcactgccccgcctgcaacaaatggcagacgtttaccccgaataaaatcgaagtttaa

SEQ ID NO: 4396 - DNA, 417 bp, Neisseria meningitidis
atgcgcttactccatactatgctccgcgtgggcaatctcgaaaaatccctcgatttctaccaaaacgttttgggtatgaaactgctccgccgaaaagattatcccgaaggcagatttacccttgccttcgtcggttacggcgatgaaaccgacagcacggttttggaactgacgcacaactgggatacggaacgatacgacttgggcaacgcctacggacacatcgcggttgaagtggacgatgcctacgaagcctgcgaacgtgtgaagcggcagggcggaaacgtcgtccgcgaagccggcccgatgaaacacggcacaaccgtgatagccttcgtcgaagaccccgacggatacaaaatcgagttcattcaaaagaaaagcggcgacgattcggttgcctatcaaactgcctga

SEQ ID NO: 4397 - DNA, 2628 bp, Neisseria meningitidis
atgcccgccggccgactgccccgccgatgcccgatgatgacgaaatttacagactgtacgcggtcaaaccgtattcagccgccaacccacaggggatacatcttgaaaaacaacagacaaatcaaactgattgccgcctccgtcgcagttgccgcatcctttcaggcacatgctggactgggcggactgaatatccagtccaaccttgacgaacccttttccggcagcattaccgtaaccggcgaagaagccaaagccctgctaggcggcggcagcgttaccgtttccgaaaaaggcctgaccgccaaagtccacaagttgggcgacaaagccgtcattgccgtttcttccgaacaggcagtccgcgatcccgtcctggtgttccgcatcggcgcaggcgcacaggtacgcgaatacaccgccatcctcgatcctgtcggctactcgcccaaaaccaaatctgcactttcagacggcaagacacaccgcaaaaccgctccgacagcagagtcccaagaaaatcaaaacgccaaagccctccgcaaaaccgataaaaaagacagcgcgaacgcagccgtcaaaccggcatacaacggcaaaacccataccgtccgcaaaggcgaaacggtcaaacagattgccgccgccatccgcccgaaacacctgacgctcgaacaggttgccgatgcgctgctgaaggcaaacccaaatgtttccgcacacggcagactgcgtgcgggcagcgtgcttcacattccgaatctgaacaggatcaaagcggaacaacccaaaccgcaaacggcgaaacccaaagccgaaaccgcatccatgccgtccgaaccgtccaaacaggcaacggtagagaaaccggttgaaaaacctgaagcaaaagttgccgcgcccgaagcaaaagcggaaaaaccggccgttcgacccgaacctgtacccgctgcaaatactgccgcatcggaaaccgctgccgaatccgccccccaagaagccgccgcttctgccatcgacacgccgaccgacgaaaccggtaacgccgtttccgaacctgtcgaacaggtttctgccgaagaagaaaccgaaagcggactgtttgacggtctgttcggcggttcgtacaccttgctgcttgccggcggaggcgcggcattaatcgccctgctgctgcttttgcgccttgcccaatccaaacgcgcgcgccgtaccgaagaatccgtccctgaggaagagcctgaccttgacgacgcggcagacgacggcatagaaatcacctttgccgaagtcgaaactccggcaacgcccgaacccgctccgaaaaacgatgtaaacgacacacttgccttagatggggaatctgaagaagagttatcggcaaaacaaacgttcgatgtcgaaaccgatacgccttccaaccgcatcgacttggatttcgacagcctggcagccgcgcaaaacggcattttatccggcgcacttacgcaggatgaagaaacccaaaaacgcgcggatgccgattggaacgccatcgaatccacagacagcgtgtacgagcccgagaccttcaacccgtacaaccctgtcgaaatcgtcatcgacacgcccgaaccggaatctgtcgcccaaactgccgaaaacaaaccggaaaccgtcgataccgatttctccgacaacctgccctcaaacaaccatatcggcacagaagaaacagcttccgcaaaacctgcctcaccctccggactggcaggcttcctgaaggcttcctcgcccgaaaccatcttggaaaaaacagttgccgaagtccaaacaccggaagagttgcacgatttcctgaaagtgtacgaaaccgatgccgtcgcggaaactgcgcctgaaacgcccgatttcaacgccgccgcagacgatttgtccgcattgcttcaacctgccgaagcaccgtccgttgaggaaaatataacggaaaccgttgccgaaacacccgacttcaacgccaccgcagacgatttgtccgcattacttcaaccttctaaagtacctgccgttgaggaaaatgcagcggaaaccgttgccgatgatttgtccgcactgttgcaacctgctgaagcaccggccgttgaggaaaatgtaacggaaaccgttgccgaaacacccgatttcaacgccaccgcagacgatttgtccgcattacttcaaccttctgaagcacctgccgttgaggaaaatgcagcggaaaccgttgccgatgatttgtccgcactgttgcaacctgctgaagcaccggccgttgaggaaaatgcagcggaaatcactttggaaacgcctgattccaacacctctgaggcagacgctttgcccgacttcctgaaagacggcgaggaggaaacggtagattggagcatctacctctcggaagaaaatatcccaaataatgcagataccagtttcccttcggaatctgtaggttctgacgcgccttccgaagcgaaatacgaccttgccgaaatgtatctcgaaatcggcgaccgcgatgccgctgccgagacagtgcagaaattgctggaagaagcggaaggcgacgtactcaaacgtgcccaagcattggcgcaggaattgggtatttga

SEQ ID NO: 4398 - DNA, 531 bp, Neisseria meningitidis
atgaaattcgtcagcgaccttttgtccgtcatcctgtttttcgccacctataccgttaccaaaaacatgattgccgcaacggcggtcgcattggttgccggtgtggttcaggcggcttttctgtattggaaatataaaaagctggatacgatgcagtgggtcggattggtgctgattgtggtattcggcggcgcaaccattgttttgggcgacagccgcttcattatgtggaagccgagcgttttgttttggctgggcgcgctgttcctgtggggcagccacctcgccggtaaaaacggcttgaaggcgagtatcggcagggagattcagcttccggatgccgtatgggcgaaattgacgtatatgtgggtcggtttcctgatttttatgggtatcgccaactggtttgtgtttacccggttcgagtcgcaatgggtcaactataaaatgttcggctcgactgcactgatgcttgttttctttattattcagggtatttatctgagtacctgtctgaaaaaggaggattga

SEQ ID NO: 4399 - DNA, 279 bp, Neisseria meningitidis
atgttgctggcaacagacggggaggatgtgcacgaggcgcgtatggcggcacgtcccgaacacctcaaacggctggagacgctgaagtcggaaggccggctgttgacggcaggcccgaatcctttgccggaggactccaaccgcgtttcgggcagtttgattgtggcgcagttcgagtctttggatgcggcgcaggcttgggcggaagacgatccctatgttcatgcaggcgtgtacagcgaagtgctgatcaagccgtttaaagcggtgttcaaataa

SEQ ID NO: 4400 - DNA, 279 bp, Neisseria meningitidis
atgccggccgtcgatttgatccgcgaacgcctgcagacgctcgatccgctggtgttggaaatcggcgatgagagccatctgcacaaaggacacgcgggcaataccggcggcggacattatgccgttttggtcgttagcggccgttttgaaggcgtaagccgcctgaaccgccagaaaacggtcaaatcgctgctcaaagatttgttttcaggcggcatgattcacgcgctcggcatccgggcggctacccctgacgagtatttccatacggcggactga

SEQ ID NO: 4401 - DNA, 867 bp, Neisseria meningitidis; identical to SEQ ID NO: 3333

SEQ ID NO: 4402 - DNA, 759 bp, Neisseria meningitidis; identical to SEQ ID NO: 297

SEQ ID NO: 4403 - DNA, 492 bp, Neisseria meningitidis
atgcgtgcggtcatacagaaaacggtaggtgcaaaggtggatgtcgtgtccgaagccggcacggaaacctgtggcaaaatcgacggcgggtttgtcgtgttactcggcgtaacgcatagcgacacagaaaaagatgcacgctatatcgccgacaaaatcgcccatttgcgcgtgtttgaagacgaagcgggcaagctgaacctgtctttgaaagatgtcggcggcgcggtgctgctggtgtcgcagtttacgctttatgccgacgcggcaagcgggcggcggccttcgttttcccaagccgcacctgcagaacaggcgcagcagctttacctgcgaacggcggaactgttgcgcggacacgggattcatgtcgaaacagggcgtttccgcacgcatatgcaggtgtcgctctgcaacgatgggccggtaaccatactgctggactctttcatgacgcggatttccccaaaaatgaaggttgttccggattga

SEQ ID NO: 4404 - DNA, 1011 bp, Neisseria meningitidis
atgaacgacaatacacacacccttcccccgcgccacctgtccgtcgcccccatgctcgactggacggacaggcactaccgttaccttgcccgccagattacccgaaatacttggctgtacagcgaaatggtcaatgccggtgcgattgtttacggcgacaaagaccgctttttgatgttcaacgaaggcgagcagcccgtcgccctgcaactgggcggcagcgatccgtccgatttggcgaaagccgccaaagccgccgaggcatacggttacaacgaggtcaacctcaactgcggctgccccagtccgcgcgtgcagaaaggctcgttcggcgcgtgtctgatgaacgaagtcgggctggttgccgactgcctcaacgccatgcaggatgcggtcaagattcccgttaccgtcaaacaccgcatcggtgtggacaggcagaccgaataccaaaccgttgccgatttcgtcggcacgctgcgcgacaaaaccgcctgcaaaacctttatcgtccacgcccgcaacgcttggctggacggtctttcccccaaagaaaaccgcgacgttcccccgttgaaatacgattacgtttaccgcctcaagcaggagtttcccgggctggaaatcatcatcaacggcggcatcaccaccaacgaagcaatcgcaggacacctgcaacacgttgacggcgtgatggtcgggcgcgaggcgtaccacaacccgatggtgatgcgcgaatgggacaggctgttttacggcgatacccgcagcccgattgaatacgccgatttggtgcagcgtctctacacatacagccaagcccaaatccaagccggacgcggcacaatcttgcgtcacatcgtccgccacagccttgggctgatgcacggtctgaaaggcgcgcggacttggcggcgtatgctttccgacgcaacgctcttgaaagacaacgacggcagcctgattctcgaagcgtggaaagaggtcgaacgggcaaatatgcgcgaatag

SEQ ID NO: 4405 - DNA, 888 bp, Neisseria meningitidis
atgtacacaggacgttttgcccccagcccgaccgggctgctccacatcggctcgctgctgaccgccgtcgcttcctatgccgatgcgcgcgcgcacggcggcaaatggctgatccgcatggaagacctcgatccgccgcgcgaaatgccgggggcggcaagccatatcctgcacacgcttgaggcattcggattcgagtgggacggagaagtcgcctatcagagccgccgttacgccctgtatgaagaaaccctatgccgcctgaaaaccgccggactggtctatccctgccattgcagccgcaaagactggcaggccggggcaaggcggggcgcagacgggttcgtctataacggacgttgccgccaccccggccaacgccctgcactgcaaggcaaacagccggcgtggcgcatccgcgtccccgaccgcattatcggtttttcagacggcatcgtcggcggttacgcccaaaacctcgcccgcgacatcggcgatttcgtcctgcttcgtgcagacggttactgggcataccagctcgccgtcgttgccgacgatgccgaacagggcgttacccacatcgtccgcggacaagacctgctcgtttccacgccgcgccaaatctatttgcagcagtgtttggacgttccgacaccgcaatatgcccacctgccgctgctgaccaacgcacaagggcagaaatggtcgaaacagacgctcgcccccgcattggatttaaaccgccgcgaacaactcctccgccaagtgttccgttacctcaagctgcccgaagcaccggaaaccgaccgccctgccgaactgctcgactgggcggtggcacactgggatatggacaaagtgccgaaacacgccgttaccgccccctaa

SEQ ID NO: 4406 - DNA, 453 bp, Neisseria meningitidis
atggcaaaagcaatcgaaatcatttcacccaatgaaatttattcagatctgatttttaaggatccggtacctccccatactattgaatataaaatgattaacctagaattgaaagccatcaatctttacgattgtgcctttgaagatttcgttcccgaaatcaaagacaatttttgtgtgggaattgatttagacataggaactgatgatagtgatgctgcagatatattttctgttcgcatatgctctcctaaatggattttgcataattgtttccaaaatcaaagggttaaatggggggcgggtatgatgattatgaatgaatttaatcattctgttattaaatcggaaattgagaaaattcttaaagaatgttcaaaagaaacttgggaaaagtcattgacttatttacttcgttttttttcgtgggaatttgaagattatcagtgctaa

SEQ ID NO: 4407 - DNA, 1056 bp, Neisseria meningitidis
atgaccattttatcggacgttaaagcattaggacaacaaatctggctggacaacctttcccgctcgctagtgcaaagcggcgaattggcgcaaatgttgaaacagggcgtgtgcggcgtaacttccaatcccgccatcttccaaaaagccttcgccggcgacgcgctttacgccgatgaaatcgccgccctcaagcagcaaaacctcagccccaaacaacgctacgaaacaatggcggttgccgatgtgcgtgccgcctgcgacgtttgccttgccgaacacgaatccaccggcggcaaaaccggcttcgtcagcctcgaagtttcgcccgaattgtccaaagacgcgcaaggcacggttgaagaagcgcgccgcctctacgccgccatcgggtgcaaaaacgcgatgattaaagtgcctgccaccgacgcaggcatcgatgcgctcgaaaccctcgtttcagacggcatcagcgtgaacctgaccctgctgttctcacgcgcccaaaccctcaaagcctacgccgcctacgcgcgcggcatcgccaaacgcttagcagccggacaaagcgttgcccatatccaagttgtcgccagcttcttcatctcccgtgtggacggcgcgctggacacaacactgcccgaccacctcaaaggcaaaatcgccatcgcccttgccaaagccgcctaccaagactgggcgcaatacttcggcagccccgaatttgccgcgctggaaaccaaaggcgcaaaccgcgtgcagcttttatgggcatctaccggcgtgaaaaacccggcctatcccgacacgctctacgttgacagcctgatcggcgcgcacaccgtcaacaccgttcccgatgccacgctcaaagcctttatcgaccacggcacagccaaagccacgctgaccgaaggcgtagaagaagcacaagcgcagctcgccgaaaccgccgcgctcggcatcgatgtcgaaaccttggcaacgcgtttgcaggaagacggtttgaaacagtttgaagaagcgtttgaaaaactgctcgcgcctttggcttag

SEQ ID NO: 4408 - DNA, 975 bp, Neisseria meningitidis
atggcagaaaacggaaaatatctcgactgggcacgcgaagtgttgcacgccgaagcggaaggcttgcgcgaaattgcagcggaattggacaaaaacttcgtccttgcggcagacgcgttgttgcactgcaagggcagggtcgttatcacgggcatgggcaagtcgggacatatcgggcgcaaaatggcggcaactatggcctcgaccggcacgcctgcgtttttcgtccaccctgcggaagcggcacacggcgatttgggtatgattgtggacaacgacgtggtcgtcgcgatttccaattccggcgaaagcgacgaaatcgccgccatcatccccgcactcaaacgcaaagacatcacgcttgtctgcatcaccgcccgccccgattcaaccatggcgcgccatgccgacatccacatcacggcgtcggtttccaaagaagcctgcccgctggggcttgccccgaccaccagcaccaccgccgtcatggctttgggcgatgcgttggcggtcgtcctgctgcgcgcacgcgcgttcacgcccgacgatttcgccttgagccatcctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcaggcaaaccatgtgaacgggcttctggttaccgatgcagatggcgtgctgatcggcgcgctgaatatgcacgacctgctggcggcacggattgtatag

SEQ ID NO: 4409 - DNA, 537 bp, Neisseria meningitidis
atgcaggcaatttctcccgaattacaggcgcgcgccgccaaaatcaaactgttgatcctggatgtggacggcgttttgaccgacgggcgcatctttatccgcgataacggcgaagaaatcaaatcgtttcacacactggacggacacggtctgaaaatgcttcaggcaagcggcgtgcagactgcgattatcacgggccgggacgcgccctccgtcggcatccgcgtcaaacagttgggcataaattactatttcaaaggtatcagcgacaaacgtgccgcctatgaagaattgcgcgcgcaggcgggcgtggaagaagccgagtgcgcctttgtcggcgacgacgtggtcgatttgccggtaatggtgcgctgcggattgccggttgccgtccccggcgcgcattggtttacgcggcaacacgccgcctatatcacggaacacgcgggcggcgcaggcgcggtgcgcgaagtgtgcgacctgattatgcaggcgcaagggactttgggcgcggctttgaacgagtacatcaaatga

SEQ ID NO: 4410 - DNA, 582 bp, Neisseria meningitidis
atgaaagtaagatggcggtacggaattgcgttcccattgatattggcggttgccttgggcagcctgtcggcatggttgggtcgtatcagcgaagtcgagattgaagaagtcaggctcaatcccgacgaaccgcaatacacaatggacggcttggacggcaggcggtttgacgaacagggatacttgaaagaacatttgagcgcgaagggcgcgaaacagtttccggaaagcagcgacatccattttgattcgccgcatctcgtgttcttccaagaaggcaggttgttgtacgaagtcggcagcgacgaagccgtttaccataccgaaaacaaacaggttctttttaaaaacaacgttgtgctgaccaaaaccgccgacggcaaacggcaggcgggtaaagttgaagccgaaaagctgcacgtcgataccgaatctcaatatgcccaaaccgatacgcctgtcagtttccaatatggtgcatcgcacggtcaggcgggcggcatgacttacgaccacaaaacaggcatgttgaacttctcatctaaagtgaaagccacgatttatgatacaaaagatatgtaa

SEQ ID NO: 4411 - DNA, 531 bp, Neisseria meningitidis; identical to SEQ ID NO: 1729

SEQ ID NO: 4412 - DNA, 765 bp, Neisseria meningitidis
atgccgaccgaagatattgaagagatatttatgagtgcaaacgtcagccgccttgttgttcaaaacctgcaaaaaagtttcaaaaaacgccaagtcgttaaaagcttctccctcgaaatcgaaagcggcgaagtcatcggactgctcgggcccaacggtgcgggtaaaaccaccagcttctacatgattgtcggactcatcgccgccgacgcaggcagcgtaaccctagacggacaagaattgcgccacctgcccatacacgaacgcgcccgcctcggtgtcggctacctgccgcaggaagcctcgatattccgcaaaatgaccgtcgaacaaaacatccgcgccatcttggaaatcagaaccaaagataaaaatcaaatcgacagggaaatcgaaaaactgctcgccgacctcaatatcggacacttacgccgcagccccgcgccgtcgctgtccggcggcgaacggcggcgcgtcgaaatcgcccgcgtactcgccatgaaaccgcattttattttgttggacgaaccttttgccggcgtcgatccgattgccgtcatcgacatccagaaaatcatcggtttcctcaaatcgcgcggtatcggcgtactgattaccgaccacaacgtacgcgaaaccctcagcatctgcgatcgggcctacattatttcagacggcacggtgttggcatcgggaaaacctgatgatttggtcggaaacgaacaggttcgttctgtttatctgggtaagaacttcaaatattga

SEQ ID NO: 4413 - DNA, 702 bp, Neisseria meningitidis; identical to SEQ ID NO: 3665

SEQ ID NO: 4414 - DNA, 810 bp, Neisseria meningitidis
atgaccgccctcccccgctacgccgttttcggcaaccccgtcgcccacagcaaatcgccgcaaattcatcaacaatttgcccttcaggaaggcgttgacattgaatacgaacgcatttgcgccgacatcggcggtttcgcgcaggcggtttcgacattttttgaaacaggcggttgcggggcaaacgttaccgtaccgttcaaacaggaagcgtttcatctggcggacgagcattccgaacgcgcattggcggcaggtgcggtcaatacgctgattccgttgaaaaacggcaagctgcgtggcgacaacaccgacggtatcggtttgaccaacgacatcacgcaggtcaaaaatattgccatcgagggcaaaaccattttgcttttgggcgcaggcggcgcggtgcgcggcgtgattcctgttttgaaagaacaccgtcctgcccgtatcgtcattgccaaccgtacccgcgccaaagccgaggaattggcgcagcttttcggcattgaagccgtcccgatggcggacgtgaacggcggttttgatatcatcatcaacggcacgtcgggcggtctaaacggtcagattcccgatattccgcccgatatttttcaaaactgcgcgcttgcctacgatatggtgtacggctgcgcggcaaaaccgtttttagattttgcacgacaatcgggtgcgaaaaaaactgccgacggactgggtatgctagtcggtcaagcggcggcttcctacgccctctggcgcggatttacgcccgatatccgccccgttatcgaatacatgaaagccctataa

SEQ ID NO: 4415 - DNA, 1419 bp, Neisseria meningitidis
atgtctattaaaaacgccgtaaaattgattgaagaaagcgaagcccgctttgtcgatttgcgctttaccgataccaaaggcaagcagcaccactttaccgtgcctgcgcgcatcgtgttggaagaccccgaagagtggttcgaaaacggtcaggcgtttgacggttcgtctatcggcggctggaaaggcattcaggcttccgatatgcagttgcgccccgatgcgtctacagccttcgtcgatcctttttatgatgatgcgactgttgtgttgacttgcgacgttatcgatcccgccgacggtcagggttacgaccgcgacccgcgctccatcgcccgccgagccgaagcctatttgaaatcttccggcatcggcgagaccgcctatttcggtcccgaacccgagtttttcgtattcgacggcatagaatttgaaaccgatatgcacaaaacccgttacgaaatcacgtccgaaagcggcgcgtgggcaagcggtctgcatatggacggtcaaaacaccggccaccgcccgaccgtcaaaggcggttacgcacctgttgcaccgattgactgcggtcaggatttgcgttcggcgatggtaaacattttggaagaactcggtattgaagtggaagtgcaccacagcgaagtcggcaccggcagccaaatggaaatcggcacgcgctttgctactttggtcaaacgcgccgaccaaacccaagacatgaaatatgtgattcaaaacgttgcccacaacttcggcaaaaccgccactttcatgcccaaacccattatgggcgacaacggcagcggtatgcacgttcaccaatccatttggaaagacggtcaaaacctgttcgcaggcgacggctatgccggcttgagcgacaccgcgctctactacatcggcggcatcatcaaacacgccaaagccttgaacgcgattaccaatccgtccaccaactcctacaaacgcctcgtgccgcactttgaagcgccgaccaaactggcatactccgccaaaaaccgttccgcttccatccgcattccgtccgtgaacagcagcaaggcgcgccgcatcgaagcgcgtttccccgatccgaccgccaacccgtatttggcatttgccgccctgttgatggcgggtttggacggcattcaaaacaaaatccatccgggcgaccctgccgataaaaacctgtacgatctgccgccggaagaagatgcattggtgccgaccgtttgcgcttctttggaagaagcactggccgccctcaaagccgaccacgaattcctcctgcgcggcggcgtgttcagcaaagactggatcgacagctacatcgctttcaaagaagaagacgtacgccgcatccgcatggcgccgcacccgctggaatttgaaatgtattacagcctgtaa

SEQ ID NO: 4416 - DNA, 1284 bp, Neisseria meningitidis
atgactgcatcgaaatcaggttttatcgggcaaatcttttcccgcaatatgcttgtctgtatttttacggggtttacctcggggctgccgctgtactttctgattaacctgattccggcgtggttgcgcagcgagcaggtggatttgaagagcatcgggctgatggcgttaatcggtctgccgtttacttggaaatttttgtggtcgccgctgatggacgcggtcaggctgcccgttttgggacggcggcgcgggtggatgctgctgacgcaggcagggttgctggcggctttggcggtctatgcctttttaaacccccgtaatcatctgccgctgattgccggcttgtcggtgcttgtcgcttttttttccgccagtcaggatattgtattggatgcgttcaggcgcgagattttgtcagacgaagaattgggtttgggcaactcggttcatgtgaacgcctaccggattgccgccctgattcccggttcattgagtttggtgttggcagacaggatgccgtggttagaagtatttgttatcacttcattatttatgctgcccggccttctgatgacgctgtttcttgcgcgcgaacccgtgttgcctcctgccgttcctaaaacgttgaagcagaccgtggtagagccgtttaaagaattttttacgcgcaagggcatcgcttcggcggtgtgcgtgctgctgtttatcttcctttacaaactcggcgacagtatggcaaccgcgttggcaacgccgttttatctggatatgggtttcagcaagaccgacatcggtttgattgcgaaaaatgcaggactgtggccggcagtggcggcaggtatcttgggcggtgtgtggatgctgaaaatcggcgtaaacaaagccttgtggctattcggcgcggtgcaggctgtaaccgttttggggtttgtatggctggcagggttcggacctttcgacacggtcggcacaggcgagaggctgatgctggcggcagttatcggcgcggaagcggtcggcgtggggttggggacggcggcgttcgtatcgtatatggcgcgtgaaaccaatcccgcatttaccgcaacgcagcttgcgctgtttaccagcctgtccgccgtcccgcgcacggtcatcaattcctttgccggttatctgattgaatggctcggttatgtaccgtttttccaactgtgtttcgcactcgccctaccgggtatgctgctgctgctgaaagttgcgccttggaacggggagaaaactcaggatgcaggcagatga

SEQ ID NO: 4417 - DNA, 276 bp, Neisseria meningitidis
atgaacgcgtcaaactggagcgtttacctgatattgtgtgaaaacagcgcgttctattgcggcatcagcccgaatccgcaacagcggcttgccgcccacacaaccggtaaaggcgcgaaatatacccgcgtattcaaaccggtggcgatgcgtatcgttgcaggcgggatggataaaggaacggcactcaggcaggaaatcgccgtcaaaaaactgaccgccgcacaaaaacggcaattgtgggagcaggcagaaaaaatgccgtctgaaacctga

SEQ ID NO: 4418 - DNA, 81 bp, Neisseria meningitidis
atgaaagtgaaggcatatatcagtattttttatacgccaacagaaaagaatacgatgaactgtttgttggatttgtattga

SEQ ID NO: 4419 - DNA, 138 bp, Neisseria meningitidis
atgaaacggcttcgggctgaaatatatgctgatgccctgtccttcccgtatatcttgtgtgttgtcaaagtgcaggctgctttgaaatcggtattgccatctatgaaccaccactttgttttatttcagcgggcttga

SEQ ID NO: 4420 - DNA, 774 bp, Neisseria meningitidis
atgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaaaacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatatgaagcttatgaagataaaagacatattcctgaaaatccatattttcatgaattttactatattaaaaaaggagaaaatccggcgattattactcatcggaataatcgaataaaccaaactgaagaagatagttatagcactagcgtaggttcctgtattaacggtttcacggtacggtattacccgtttattcgggaaaagcagcagctcacacagcaggagttggtaggttatcaccaacaagtagagcaattggtacagagttttgtaaacaattcaagtaaaaaataa

SEQ ID NO: 4421 - DNA, 276 bp, Neisseria meningitidis
atgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggggtggaaaacctatgggatgatacggtcggtaaaaagacccgtttaatgtgtatttccgttttttggattgtggttttcaatttgtag

SEQ ID NO: 4422 - DNA, 1134 bp, Neisseria meningitidis; identical to SEQ ID NO: 3441

SEQ ID NO: 4423 - DNA, 387 bp, Neisseria meningitidis
atgtgtattatgtgtgagttaaaaaacttcagaagaaatattacttgttttgaggggtatgacgaaaattcatttattggcaaatggtatgatgacggggtgtgggatgatgaagaatattggaagttggagaatgatttaatcgaggttagaaaaaaatatccttatccgatggacataccaagatatgttgtcattggaatcggtaccattattgatttcttaatggttccaaattggaaactttttgaaattaaagcttccccttggctacctgatagcgtaggaattaatgaacgttatgaaaggcttaaaacaatgctccgttatatttttaccgagaaagacatagtcaacgtgcaatttgattattacaacaaaaaatag

SEQ ID NO: 4424 - DNA, 459 bp, Neisseria meningitidis
atggtcgacgcggtcgttaaaactcccgaatttttaccttttacttctgtaggaatattccgttttggtgcggatataacacagtacaaaaacatactggaaacttttatgtatgaacctcctgatgagtttagaacagaatattatgaatctcccgactcaaatttactcatttccgtcaaaaaaaaaaacaaaattatttcgatattttgttatcaggagctatattttatgggcgttaatataataggtctgaattttgaagattttaaacagcttttccattaccctaaatcatacggtgttgataaatattatttatcaaatgaatcttatccgacatatgtctatgagtttgatgaaataggagtacaagcttgggaagcaaaagggaaaattgttactatcattgccgggggcaaagacaattattcaacagaaccttactacgatgaataa

SEQ ID NO: 4425 - DNA, 390 bp, Neisseria meningitidis
ttgaaagcgggaagcaggctgttatccgaaagcggcagaacccaaaccgtccgcaaaaccgttgtcaaaccaaaaccgctcaaagcctacaatctgaccgttgccgattggcatacttacttcgtcaagggtaatcaggcggaaacggaaggggtttgggttcataattcttgtccgcctaaaagaacaggaagctccaagaatgaaaaacatggagatggcggtcgaagtcaaatatcagcggaatcaaaaattgctgaattaacaaataaaattattcccggaatgtccaaaaatgaacgcttaaagattaagcaaaaaatcagaaatattgccaaaaatgccaatcgaaaaacaaaaggagaagagcatggtcgacgcggtcgttaa

SEQ ID NO: 4426 - DNA, 378 bp, Neisseria meningitidis; identical to SEQ ID NO: 1407

SEQ ID NO: 4427 - DNA, 408 bp, Neisseria meningitidis
atgtgcgagttcaaggattttagaagaaacatcccttgttttaaggagtatgacgaaaattcatttattggcaaatggtatgatgacggggtgtgggatgatgaagaatattggaaattggagaatgatttaattgaggttagaaaaaaatatccttatccgatggatataccaagggacatcgtgattggaatcggtaccattattgattttttaatggttcaaaattggaaactttttgaaattaaagcttctacttggttgcctaaaagtgtcaaaattaatgagcgttatgaaaggttcagggtaatgctccgttatatttttactgatctagatgtagaggactggaaatttttttactttccaatacaacatagtaaaggtagattgagacgaaaagtttaa

SEQ ID NO: 4428 - DNA, 678 bp, Neisseria meningitidis
ttggtcaaaacggcagacggctacaaagccattgcccgtatccgaaccggcgaccgcgtcttcgccaaggacgaggcaagcggaaaaacgggatacaaacccgttaccgcccgatacggcaatccgtatcaagaaaccgtttacattgaaatttcagacggcatcggcaacaaccaaaccctgatttccaataaaatccacccgttttacagtcaaggaaaatggatacaggcaggtcgtctgaaaaaaggcgacaccctgctttccgaaagcggtgcaaaacagacggttcaaaacattaccctcaaacagcagccgctcaaagcctacaatctgaccgttgccgactggcatacttacttcgtcaagggcaatcgggcggaaacggaaggggtttgggttcataatgattgtccgccaagaaaaacaccatctacccccatatatgggaatgattcagaagcatatgcagcagcaaaggaattgggatatagaaaaataaaagaaagaacgagaaatgatgctgctatttttaaaaaaggaaagagttatatatcacgcgatgtagattcacataatggaggtgcttggaaagaggcatcttcacccgaaaaactgaacagaaaagaaacaagaaacggtacatttgataaaaacctaaatcgtattggagattaa

SEQ ID NO: 4429 - DNA, 360 bp, Neisseria meningitidis
atggcatcatatgtttccataaaaggatggattgaatgctctgacgatgatataaaaatcatccaagaaaacattaataatttttggaataattgtccctttaatatcgaagagaaagaatctgcaaaaatatataaaagcgggtgggttttcccgacaaatagttttaattggagcagctatattttttttggtgcatgcgtaaaatcttatttcattatttattttgaaaaatgtattaaaacaataatggaattggatattgaaatatcaggtttttttgaattagattattatgaagataattataaagtaaattggaaaataaataatggaaatttgatacaaacgactaattaa

SEQ ID NO: 4430 - DNA, 1404 bp, Neisseria meningitidis; identical to SEQ ID NO: 3453

SEQ ID NO: 4431 - DNA, 942 bp, Neisseria meningitidis; identical to SEQ ID NO: 313

SEQ ID NO: 4432 - DNA, 117 bp, Neisseria meningitidis
atgccgtctgaaagccatttccgccgctcagacggcattttcgccccttttgtttacaaacccttaaaatccctttacactcaaaatccgttcaacatcaaacaaaccccgctatga

SEQ ID NO: 4433 - DNA, 1131 bp, Neisseria meningitidis
atggcgttttgcaccagtttgggagtgatgatggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcggaacggacgcggatttttaccgtcggcgacttccgcagccgcgaccttgcggccggcggacaaggcgcgccactcgtccccgcctttcacgaagccctgttccgcgacaacagggaaacacgcgcggtactgaacatcggcgggattgccaacatcagcgtactcccccccgacgcacccgccttcggcttcgacacagggccgggcaatatgctgatggacgcgtggacgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgacctgaacctcgatccgcaatgggtggaagccgccgcatttgcgtggttggcggcgtgttggattaatcgcattcccggtagtccgcacaaagcaaccggcgcatccaaaccgtgtattctgggcgcgggatattattattga

SEQ ID NO: 4434 - DNA, 1575 bp, Neisseria meningitidis
atggctcaaatccaaatgagcgcaaatgttaaaaccatcaacgccgtctttgccgccatgctggtaggtacagtcggctattttatttattggggcttgggttatacccattacaattacgccgccttattcattattgccacgatgttcggcgtgtttatggcgttcaacatcggcggcaacgatgttgccaattctttcggcaccagcgtcggtgcgggtacgctgaccatcccgcaggctttgctgattgcggcggtatttgaggtcagcggcgcggtcatcgcgggcggcgaggtaaccaataccatacgcaaaggcatcgtcgatttgaagggtgttgatttcgaacccatacagtttgtgtttattatgatgtccgcgcttttggcggcggcgttgtggctgttgtttgcctcgaaaaaagggcttccggtatctaccacccattccattatcggcggcattgtcggcagcgcggtatgtatggcggtaatgaacgatgccgcatcgggcgatttgatacgttggggcaagctgggcggtattggtgtttcttgggtattgtcgcccgtgttgggcggcgcggtgtcctattttctgttttcgcgcgtcaagaaaaacgtcttagattacaacgcttgggcggaaggcacgctcaagggcatcaagcaggaaaaaaaggcctataaagaacggcaccgcctgtttttcgagggtttgtccgaagccgaaaaagtcgagtacgccaccaaaatggcgcacgacgcgcaaatttacgacgaacccgaattcgatccgcaagagctgcaatcggagtattaccgcggtctttatgcgttcgacaaccgtaaaaacaatgtcgattcctacaaggcactgcattcttggattccctttatcgcttcgttcggcgcgatgatgatttccgctatgctgattttcaagggcttgaaaaacctgcatttggggatgagcaacgtcaacagcttcctgaccatctttatgataggcgcggcggtgtggatggggacgtttgtttttgccaaaagcctcaagcgtaaagacttgggcaaatcgacctttcagatgttttcatggatgcaggtctttaccgcctgcggcttcgcattcagccacggtgcgaacgatatcgccaacgccatcggtccgtttgccgcgattatggatgttttgcgtaccaacagcgttgccgcgcaaaatgtcgtccccccgattgcgatgctgactttcggcatcgcgctgattgtcggtttgtggtttgtcggtaaagaggtgattaaaaccgtcggtacgagtttggcggaaatgcatcctgcttcgggttttaccgccgaactgtccgccgcctccgtcgtgatgggcgcgtcgctgatggggctgcccgtgtccagtacgcatatcttggtcggcgcggtactcggtatcggtctggtcaaccgcaatgccaactggaaactgatgaagcccatcggtttggcgtgggtcattaccctgcctgccgccgccgtattgtcggttgtctgctacttggttttacaggcagtattctga

SEQ ID NO: 4435 - DNA, 1422 bp, Neisseria meningitidis
atgaaaatcattcagatacagaacaatcacaatgtaaacgatgaccgccccgagtttgaccgcgcgctgattgccagcctgcccgccagcggcccgcgctacacttcctaccctaccgccgaccgtttccatgacggtttccgcgaaggcgaatatatcaaagctttacatttgcgcggtatgggcgcgttaaacaaaccgctttccctttacattcacattccgttctgcaacaccatctgctactactgcggctgcaacaaaatcatcaccaaagacaaaagccgcgccgatgcctacatcgaatatcttgaaaaagaaatggaactgctcgctccacatctgaacggacggcaccagcttgcccaactgcacttcggcggcggcacgccgacctttttgagcgacgaacagatcgaacgtgtcttccgcatgatacgcaaacatttcgagttaatccccaccggcgaatactccatcgaaatcgacccgcgcaaagtcagccgcgacaccgtcctcatgctcggcagactcggcttcaaccgcatgagcatcggcattcaggatttcgaccccaaagtgcaggcggcggtcaaccgcatccaaagttacgaagaaaccaaagaagtcatcgatgcggcgcgcgaagcggggttcaaatccgtcagcgtcgatttgatttacggcctgccgcaccagacttcggaaagcatcaaaaccaccatcgataccgttttgtcgctcgatcccgaccgcctcgccctttatcactacgcccacctgccgcacgtgttcaaaccgcaacgccgcatcgataccgccgccgttcccgacagcgaagagaagctcgatatgctgcaatactgcgtccaaaccctaaccgaacgcggctacgtcttcatcggcatggatcatttcgccaaacctgacgacgaactctccatcgccctcaaagaaggcttcctccagcgcaacttccaaggctattcgacctacgcggattgcgatttggtcgccatcggcgtgtcgtccatcggcaaaatcggcagcacctattcccaaaacgaacgcgacatcgatgcctactatgccgccatcgacgaaggcagactgcccatcatgcgcggctaccagctcaatcaggacgacatcctgcgccgcaacatcattcaggatttgatgtgccgtttcgcgctcgactatcggatttacgaaagtatgttcggcatcccgttcgaccgctacttcaaagacgaactggcggatttggaaaaactcgccggtttgggattggtgcgcctgaacagccacgggctgaccgttaccccgaaaggacgcttcctcatccgcaacatcgccatggtcttcgattaccacctgcgccataaagaaaccaaggcgaaatattcgcaaacagtgtga

SEQ ID NO: 4436 - DNA, 735 bp, Neisseria meningitidis
atggcttcgcataatactacacatcagatgaaaacgctgtgttcttcctgttctttgcgggaactctgcctgcctgtcgggctgctgcccaacgagctcagccaactcgatgccgtcatccgtcaaagccgccgcctgaaaaagggcgaatacctgttctgtgtcggcgaagcctttacctcgctctttgccatccgttcgggcttcttcaaaacaaccgtcgccagtcaggacggccgcgatcaggtaacgggtttctttatgtcgggcgaactcatcggcatggacggcatctgttcccatgtgcacagttgcgacgcggtcgccttggaagacagcgaagtgtgcgaactgccgtttacccacatcgaagaactggggcaaaacatccccagcctgcgtacgcacttcttccgcatgatgagccgtgaaatcgtgcgcgaccaaggtgttatgctgctgttgggcaatatgcgcgccgaagagcggattgccgccttcctgctgaacctttcccaacgcctttattcccgaggttttgctgccaacgacttcatcttaagaatgtcccgcgaagaaatcggcagttatctcgggctgaaacttgaaaccgtcagccgcacattatctaaatttcatcaggaaggattgatttccgtcgagcataagcacatcaaaatcctcaatctgcaggtgttgaaaaaaatggtgtccggctgctcgcacgccatttga

SEQ ID NO: 4437 - DNA, 951 bp, Neisseria meningitidis
atgaaattacaacaattgaaatacgccttagaagtttaccagcacaacctgaacgtttccgaagcggccgaagccttgtttacttcgcaacccggcatctccaaacaaatcaaattgctggaagaagaaatcggcattcagatttttatccgcagcggcaagcgcgtggtttcggtctcgcagccgggcaaggtggttttggatattgcggaacgtattttgcgcgatgttcagaacattaaaaatatcggcagcgagtttaccggacaggacagcggttcgctgacggttgccacgacgcatactcaggcacgctatgccctacccttgattgttgccgattttgtgaaacgctatccgaaagtcaacctgaccatcaaacaggggagccctgccgccatcgcacgtatggttacctcaggcgaggcggacttggcgattgttacggaacggatagacgaccatcccgaactgggaaaacttccctgctatgactggactcatgcggttatcgtaccgaacgaccaccccttgctcgaatgcagaaaccccctccgtattgaagatttggcgaggtttccgctgattacttatgaatttgcattcaatgcgggcagcagcatcgcgcgggcattttccaaagcccgtttggaacaacccgatgtcgcattggctgcggcagatacggacgtattgaagacttatgtgcgcttgggtttgggcgtgggactgatggcgaaaatggcgtacaacccggatacggacggcgatttgcagcttgtggatgcggcacacctgttcgagccgtcgccgacgtggattgctttgcgcagcgatacttatttgcgcggatatgcctacgactttatccaagcgttcgcgccgcacctgacacgcgagaaggtggataggattctgtacacgcccatcagcgaggatttttcgatttag

SEQ ID NO: 4438 - DNA, 729 bp, Neisseria meningitidis
atgaccaaacagctgaaattaagcgcattattcgttgcattgctcgcttccggcactgctgttgcgggcgaggcgtccgttcagggttacaccgtaagcggccagtcgaacgaaatcgtacgcaacaactatggcgaatgctggaaaaacgcctactttgataaagcaagccaaggtcgcgtagaatgcggcgatgcggttgctgcccccgaacccgagccagaacccgaacccgcacccgcgcctgtcgtcgttgtggagcaggctccgcaatatgttgatgaaaccatttccctgtctgccaaaaccctgttcggtttcgataaggattcattgcgcgccgaagctcaagacaacctgaaagtattggcgcaacgcctgagtcgaaccaatgtccaatctgtccgcgtcgaaggccataccgactttatgggttctgacaaatacaatcaggccctgtccgaacgccgcgcatacgtagtggcaaacaacctggtcagcaacggcgtacctgtttctagaatttctgctgtcggcttgggcgaatctcaagcgcaaatgactcaagtttgtgaagccgaagttgccaaactgggtgcgaaagtctctaaagccaaaaaacgtgaggctctgattgcatgtatcgaacctgaccgccgtgtggatgtgaaaatccgcagcatcgtaacccgtcaggttgtgccggcacacaatcatcaccaacactaa

SEQ ID NO: 4439 - DNA, 228 bp, Neisseria meningitidis
atgcatgaggttagtggattttgtaccaggtactgttgcaatattcgtgaaacgtcggtcggcatcgatgatgtgaaacaaacccccgcttttgcggggtttgtttttttgggtggttttctgaaacggctatcgtcagaatcggggtgcaggttcggattcggattcagattcagattcagattcagattcagattcaggtttgtgtcccattgccgcgctttatag

SEQ ID NO: 4440 - DNA, 297 bp, Neisseria meningitidis
atggatggaatcgtgccagatgtgtgcggcactgtatgccggatatggttttatcatcagcccttttcggttgaaaccccgtcagttgcagcgattgagcctaatcggtggcggaagttgccgctttgcattcggggcggcgtgcagtgcggtgctttgatatgccgtttgtgtgttgaaacagggtggtcggtgcatacgggtacggtatggccaaagctaaaagtgaaatacgctgaaacactgaatgagccgctttattgtttgtacggcctttgctgccttgctatgatttaa

SEQ ID NO: 4441 - DNA, 957 bp, Neisseria meningitidis
atgaaagaatttgacttcatcaaacggtatttgcaaacaggcacggataatgatgtcgtattgggcataggcgacgatgcggcgattgtccgcccgcgtgaaggcttcgatttgtgtttcagtgcggatatgcttttgaaggacaggcatttttttgcagatgtcaaacctgaagacttggcttggaaggttttggccgtcaatatttcagatatggcggcgatgggtgcgataccgcgttgggtgttgctgagcgcggctttgcccgaattggatgaggtatggctgaaacggttttgcggcagctttttcggtttggcaaaaaagtttggcgtaacgttaatcggcggcgatacgaccaagggcgatatggcgttcaatgtaaccattatcggcgaattgccgaagggtagggcgttgcggcgtgatgcggcggttgcgggcgacgatatttgggtgtcggggcgtatcggtatggcggcggcggctttgaactgccgtctgaaacggtgtgtgttgccagatgaagtgtttgccgaatgcgaacaaaagctgctccatcctgaaccaagggttgggctggggcttgcgctgttgccgtttgccagggcggcgcaggatgtttcagacggcctcgcgcaagatttggggcatatcctgaccgcttctggcaagggtgcggaaatttgggccgattcgctgccgtctttatccgtattgaaagatattttgccccgagcgcaatggctgtcttatactttggcgggcggcgacgattacgagctggtgtttaccgcgccggaaagttgccgcagccgcgtatttgatgcggcggaacggtgcggcgtgccggtaacgcgcatcggcaaaatcaacggaggatgccgtctgaaggttttagatgccgacggcagggaattggaactacattctttaggattcgatcattttggctga

SEQ ID NO: 4442 - DNA, 486 bp, Neisseria meningitidis
ttggctgattttaaacctgactttgcgtggctgttgaaacggccgttgtgttttttggctttcggtttcggcagcgggctggctccgttcgcgccgggcacattcggcactttggcggcactgcctttggcgtttgtgctgattttgctcggcatagacgggctactgctggcttttttgtgtatcgtgctgtttatgtggggcatacgcatttgcgcttatgcggaacgtgaaacgggtgtcagcgaccacggtgggattgtttgggacgagattgtcgccatgctgtttgtgctggcgtttgtgccgttcaggtggacgtggtggctggcggcatttgtcctattccgtctgtttgacgcgctcaaaccgtctcccgtcggttggtttgacaagaatctgcacggcggtttgggcattatggcggacgatatggcggctgcggtgatgactttgattgtcttgaggattgcaatgctgttttaa

SEQ ID NO: 4443 - DNA, 1677 bp, Neisseria meningitidis; identical to SEQ ID NO: 2855

SEQ ID NO: 4444 - DNA, 1356 bp, Neisseria meningitidis; identical to SEQ ID NO: 149

SEQ ID NO: 4445 - DNA, 1011 bp, Neisseria meningitidis
atgagcgatacccccgctacccgcgatttcggtctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgatgatgcggcttcctatgcggacaatccgtttcagattaacaaacagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctgcaacagtcggccgacggttatcccaacgatttggatttggatatttcctaccgcttggacgaggacgaccggcttaccgttagctatcgcgccaccgcgctcggcgacacggtgttcgacccgacgctgcacatttactggcggctggacgcgggcctgcacgatgcggttctgcatattccgcagggcggacatatgccggccgatgccgaaaaactgcccgtctcaacggtttcagacgacctcgaagtatttgatttcagccggcccaagccgctggatgccgccgttgccgccctgcgccgcgaaacgggtcgggccggttttgacgacgcttaccgcgtgccgtccgatataggccgtcccgccgctgtgttgcaagccggacgccgccgtcgtatcagcatatacagcgaccgcaatggcttggtcatctttaccgccgccccgcaggatttcgcgcggcacgatgcgggcgtttacgacgcgctggcgaccgaggcgcagacgctgcccgacagcctgaattggcccgagttcggcaatattcgtctgaacaagggtgataccagggaggcgacgattgcttacggcatcgaatccctttcttag

SEQ ID NO: 4446 - DNA, 2259 bp, Neisseria meningitidis
atgtacacaagaatcatggaaatcagcccttggacgctgcgttcggcaaaactggaaaaagaacacaaacggctgcaagagagcctgaccagcttgggcaacggctatatgggtatgcgcggcagctttgaggaaacctattccgccgacagccacttaggcacctacatcgccggcgtgtggttccccgacaaaacccgcgtcggctggtggaaaaacggctatcccaaatatttcggcaaagccatcaacgcgttcaatttcagcaaagtcaaaatctttgtcgacgggcaggaagtggacttggcgaaaaacgacgttgctggcttctccgtcgaactcgatatgcagcacggcgtgttgcgccgctcgttcaccgtattcggtgtgcgtttcaatgtgtgcaaattcctgtctgtcgcacaaaaagagctggcggtcatccgctgggaagccgtatccgttgacggtaaaacccaccaagtccgcatcgattccatcatcgatgccgacgtgaaaaacgaagactccaactacgaagaaaaattctggcaggtattggacaaaggcgtttcagacagtctctcctacattgccgcccaaaccgtcgccaatcccttcggcgtggaacaattcatcgtcaacgccgagcaaacctttgccggcagcttcaaagccctcggcggcagccaaaccgactggcaggtctccaattcttttgaatccgaagtcggcagcacacccgaaacctttgaaaaacgcgtgattgttaccaccagccgcgattatcagagcttggaagcagtgaaagccgcaggccgcgccttgtcggaaaaaattgcaggcgttgcgtttgaaaccttgctggacgcgcacaaagcaggctggctgcaccgttgggaaatcgccgacgtggtcatcgaaggcagcgacgaagcgcagcagggcatccgcttcaacctgttccaactgttctccacctactacggcgaagacgcgcgactgaacatcggcccgaaaggctttaccggcgaaaaatacggcggcgcgacctattgggacaccgaagcctacgccgtaccgctctacctcgcactggccgaacccgaagttacccgcaacctgctgcaataccgccgcaaccaactgccgcaggcgcagcacaacgcgcgcgaacagggcttggcgggcgcactctatccgatggtaacgtttacgggcatcgagtgccacaacgaatgggaaatcaccttcgaggaaatccaccgcaacggcgcgattccttacgccatctacaactacaccaactacaccggcgacgagggctatcttgccaaagaaggcttggaagttttggtcgaagtgtcccgcttctgggcggaccgcgtccacttctccaaacgcaacggcaaatacatgattcacggcgtaaccggtccgaacgaatacgaaaacaacatcaacaacaactggtacaccaacaccctcgccgcatgggtattggactacacccgcgaagccttggcgaaatacccgcgtccggatttgaacgtgcgtgccgacgagttggaaaaatgggcggacatcagcgcgaatatgtaccgtccgcatgacgaagaactcggcgtattcgtgcagcacgacggcttcctcgacaaagacatccgccccgtgtccgcgctttcgcccgacgatttgccgctcaaccaaaaatggtcgtgggacaaaatcctgcgttcgccctttatcaaacaggcggacgtattgcaaggcatctacttcttcagcgaccgtttcaatatcgacgaaaaacgccgcaacttcgacttctacgaaccgatgaccgtgcatgaaagctcgctgtcgccctgtattcactctattctcgccgccgaactgggcaaagaagaaaaagccgtggaaatgtaccagcgcaccgcccgcctggacttggacaactacaacaacgacaccgaagacggcctgcacatcacctccatgaccggctcgtggctcgccatcgtccaaggtttcgcccaaatgaaaacctggggcggcaaactcagcttcgcaccgttcctgccgagtgcgtggacaggctacgccttccacatcaactaccgcggccgtctgattaaagtcgccgtcggcaaagaaaacgtcgtcttcactctgctcaaaggcgagtcgctcgatttgcaggtgtacggcaaagacatcacgctcgacggcagccacaccgttgcgttggaaaaataa

SEQ ID NO: 4447 - DNA, 666 bp, Neisseria meningitidis
atgactttcactgcagtcctatttgacctcgacggcgtcatcaccgacaccgccgaataccactaccgcgcatggaaaaagctcgccgaagaactgggcatcagcattgaccgcaagtttaacgagcagctcaaaggcgtgtcgcgcgacgattcgctcaaacgcatcctcgcgcacggcggcaaaaccgtcagcgaagccgagttcgccgaactgacccgccgtaaaaacgacaactacgtcgagatgattcaggcagtcaaacccgaagacgtgtatcccggcattttgcccctgctggaagcattgagggcaaacggcaaaaaaatcgcccttgcgtccgccagtaaaaacggcccgttcctgctggaacgcatggggctgacccacttcttcgacgccattgccgaccctgccgccgtcgcacattccaaacccgcccccgacatcttcctcgcagcagccgagggcgtagatgcggacatccgccaatgcatcggcattgaagacgccgccgccggcgtcgccgccatcaaagccgccggcgccttgcccatcggcgtgggcaaagccgaagacttgggcagcgacatcgcgctggtctccggcaccgccgagctgacctacgcctacctgcaaagcgtgtgggaacagtcgggcaggtaa

SEQ ID NO: 4448 - DNA, 1509 bp, Neisseria meningitidis
atgcaaaccgattgcgacgtattgattgccggaaacgggctggcggcactgacgctcgccctgtcgctgcctgaatcgttccgcatcgttattttgtgcaaaaaccggctggacgacaccgccagccgtcatgcgcaaggcgggattgcggcggcgtggtcgggagaggacgacatcgaaaaacacgttgccgatactttggaagcgggcgcgggtttgtgtgatgaagccgccgtccgcgccatcctgtcgcagggcaaaccggcaatcgaatggctgctggcgcagggcgtggcgttcgaccggaatcataacggcctgcacctgacgcgtgaaggcgggcatacctgccgacgaatcgcccacgtcgccgactacacgggcgaagccgtcatgcagagcctgattgcccaaatacgccgccgcccgaacatccgcgtttgcgagcggcagatggcgttggacattcaaaccgaatcaggcgcggcgtgcggactgaccgtcctcgactgccgaacacaagaaacctaccgcatccgcgcccgccataccgtactcgcaggcggcggcttgggacagatttacgccgccaccaccacgccgcccgaatgcacgggcgacgccatcgccatggcgatacgcgcaggctgcgcagttggaaacctcgaatttatccaattccaccccacaggcttggcaagaccgtctgaaaacggacgcaccttcctcatttccgaagccgtgcgcggcgaaggcggcatcctgaccaaccaagcgggcgaacgatttatgccgcattacgaccgccgcgccgaactcgcaccgcgcgacatcgttgcccgcgccatcgcagccgaaatcgccaaacaaacgcaagacttcgtctcgctcgacatcagccatcaacccgcagcgttcgtccgccggcatttcccatccatccatcgacactgtttatcccaatgcggcctagacatcacgcgccaagccatccccgtccgccccgtgcaacactacacctgcggcggcatccaaaccgacccctgcggcagaacctccctgccgcagctctacgccttgggcgaaaccgcctgcactgggctgcacggagccaaccgccttgccagcaactccctgctcgaatgcgtcgtgaccgcaaggctctgcgcccaagccatcgcagacggacaagcattccaagccgaaccattccaaaggccgtctgaaagcctctccgccgaagcaggcatcttttcagacgaccttcaaaacacattcagccgccccgtcctgcaaacgttcaaccaacgccatctaggcatcctacgcaacgataccggcctgcgccgcgccatcgcccaactgcagctttggaagcaaaaccaagccgaaccgcacaccgcgtccgaatacgaaaaccgcaacctgctcgaatgcagcctcgccgtcgcccaagccgcatacaggcggagacagaacatcggcgcgcattttaatagtgattgttaa

SEQ ID NO: 4449 - DNA, 336 bp, Neisseria meningitidis
atgcaaatgcactggctctttctgactgtagcaattttaagcgaagtctgcggttcttccatgctcaaactgagtggcgggtttagcaaactgtggccttctattggcgtggtagtcagcttttcggtgtgtttttgggccttgtctatgacactgaaaaccatgccgctggctacagcatacgccatttgggcaggcgtgggactggttttaacggctttagtcagcgtggtgtttttcggtgagaaagctgatttcattgggattgtcagcatcggtttgattttgctgggcgtggtgcttctcaataccatgtcgcatatgtcggggcattga

SEQ ID NO: 4450 - DNA, 1113 bp, Neisseria meningitidis
atgcaaaccgccgcccgccgctcgttcgactacgatatgccactcatccaaacgccgacttccgcctgccaaatccgtcaggcgtgggcgaaggttgccgacacgcccgaccgcgagacggcagatcgtctgaaagacgaaatcaaggctttgctgaaggagaaaaacgcggtcttggtggcgcattattacgttgatccgctgattcaggatttggctttggagacgggcggatgcgtgggcgattcgctggaaatggcgcgcttcggtgcggaacacgaagccggtacgctggtggtggctggtgtgcgcttcatgggcgagagcgcgaaaatcctctgccctgaaaaaacggtgctgatgcctgatttggaggcggaatgttctttggatttgggttgcccggaagaagcgttttcagcgttttgcgaccaacaccccgaccgcacggtggtggtgtacgccaacacttccgccgccgtgaaagcgcgtgccgattgggtggtaacgtcttcggtggcgttagaaatcgtatcgtatttgaaatcacgcggcgagaagctgatttggggacccgaccgccacctcggcgactacatctgccgcgaaacgggcgcggatatgctgttgtggcagggttcgtgcatcgttcacaacgaattcaaagggcaagagctggcggcgttgaaggcggaacaccccgaagcggtggtgctggttcatcctgaatcgccgcaaagcgtcatcgaactgggcgacgtggtcggctcgaccagcaaactgctcaaagccgccgtatcgcgtcctgaaaaaaaattcatcgtggcgaccgatttgggcatcctgcacgaaatgcaaaagcaggcgcccgacaaacaatttatcgccgcgccgacggcgggcaacggtggaagctgtaaaagctgcgcgttctgcccgtggatggcgatgaattcgctgggcggcatcaaatacgccctgacaagcggacgtaacgaaatcctgttggacaggaagctgggcgaagccgccaaactgcctttgcagcgtatgctcgactttgcggcagggctgaagaaaaaagatgtgttcaacggcatgggccccgcctga

SEQ ID NO: 4451 - DNA, 939 bp, Neisseria meningitidis
atggatgcctaccccgaagccgaagccccgccgcaaagcatcgtcgagctggttcccgtattgattgccgttaccgacggcggcctgcgggtattgaccgtcgcccaaggcatgctcctgcccaacggcccgctctcccccctgcgcaattccttgcaggcaggcgtaaaactgtgggtcgccaagcagacttcgcagcctatgggctatgtggaacagctttacacctttgtcgatacccaccgccgcaacgaacacggcatgcccgtgctgtacgtcagctatttggggctggtgcgcgaggcagccgacagcatcctgcacccggatgcgaaatggcaggactgctacggctatttcccgtgggaagacttgcgcaccgacggcgggcagcgcgacgccgtcgtcggccgcctgcgcatttgggcaaactcggcggacacggaggaagtgcgccaaaagcggctcaagcgcattcatttgtgctggggggtcgaaccggaaaactggtcggaagaatacgttttgcaacgctatgaaatgctgtatgaaagcggcctgatagcggaagccgccgagccgcaggcaaacttcgacttcgcgcttacggggcagcccatgcgccacgaccaccgccgcgtactggcgaccgccctgtctcgcctgcgcgccaaaatcaaataccgccccgtgatttttgaactgatgccgcccgaattcacgctgctgcaactgcaaaacagcgtcgaagccatcagcggcagattgctgcacaagcaaaacttccgccgccagattcagcagcaaaacctcatcgagccgtcggataccggcgtatcgggcagcaaaggccgtcccgcgcagctttgccgcttccgcgacgacgtcctgcccgacaggctgatttcggacatcggactgccgctgggcagccgttag

SEQ ID NO: 4452 - DNA, 882 bp, Neisseria meningitidis
atgccgtctgaaaaaaccctctttcccctgcccgacaccctgttgcgccccatagtagaacaagccttgagcgaagacttgggcaggcgcggcgatattacgtccgccgccgtcatcgcccccgacaaaaccgccaaactcttccttgtcagccgcgaagacggcgttatcgccggcatggacttggcgcgtctcgcctttcagacgatggatccgtccgtccgcttccaagccgaaatccgagacgggcaagccgtccgcgcaggtcagacgcttgccgccgtcgaaggcaacgcccgcgcgctgctcgccgccgaacgcaccgcgctcaactacctcacgcacttaagcggcatcgccaccgccaccgcgcgtgccgttgccgaagtcgccgaatacggtacagacatcgtgtgcagccgcaaaaccatccccctgctgcgtgtcctgcaaaaatacgccgtcagggcaggcggcggtgtgaaccaccgcatgggtttggacgacgccgtgctcatcaaagacaaccacctcgcctattgcggcagcatcgcccaagccgtgcagcaggcaaaacaggctgtcggagcattgacctgcgtggaaatcgaagtggatacgttggcacaactggacgaagccatcgcagcgggcgcggaacggattttgctggataacatggacgacgaaaccctgaaagaagcggcaaaccgctgccacacgcaaaccgcccacccccacaccatctattgcgaagcatcgggcggcatcggcttcgaccgcctgaagcgcgtggcgcaaaccggagtggacggcatcgccctcggctatctgacccacagcagccgttcgttggacataggtttggatttcgtggcgtga

SEQ ID NO: 4453 - DNA, 288 bp, Neisseria meningitidis
atgtcaggcaaggaaccgcttaaccctaatccggttattgcctcagggaggaaatgccgtctgaaagattcttcagacggcatttttcgtaaaggtcgtgatgctttagaaaaaacagcatttcaggcaggtattttgtttgcccgacagcgcggcggcatcggtagggcaggaaaaaggacggggggcggcagttttatgccgtctgaaagcccgcctttacgcttgtttgcaaaaaaagtgggaaaaggaacatacaatcctgtacaatcatccataaatatttga

SEQ ID NO: 4454 - DNA, 282 bp, Neisseria meningitidis
atgaacacaataccgctccacaccatactcaaacttatggcgcatcccgaacgtatggcgatactgattcaattgttggacagcgaacgcaatatcgccgaactggcaaaatccttatccctgccggccaccgcagtttccaaccatttgaaccgcctgcgcgtggaaggtctagtcgattttacgcgttaccaccgcattatcgaataccgcctggtttccgaagaagcggcggcgattctgcacacggttcgcgatttggaaaacaaacgcgtggcatag

SEQ ID NO: 4455 - DNA, 771 bp, Neisseria meningitidis
atgaaaatcaccacttggaatgtcaattcgctcaatgtgcggctgccgcaggtgcaaaacctgcttgccgacaatccgcccgatattttggttttgcaggaactcaaactcgatcaggacaaatttccggccgccgctttgcaaatgatgggctggcactgtgtttggagcgggcagaaaacctacaacggcgtggcaatcgtcagccgcagcgtgccgcaggacgtgcatttcggtttgcccgcactgccggacgatccgcaacggcgcgtgattgcggcaaccgtcagcggcgtgcgcgtcatcaatgtctattgcgtcaacggcgaggctttggacagccccaaattcaaatataaggaacagtggtttgccgcactgacggagtttgtccgcgatgaaatgacccgccacggcaaactggtgttgctgggcgatttcaatatcgcgcctgccgatgcggactgttacgaccctgaaaaatggcacgaaaaaatccactgttcgtccgtcgaacggcagtggtttcaaaacctgctggatttgggactgaccgacagcctgcgccaagtccatcccgaaggcgcgttctatacctggttcgactatcgcggcgcgatgttccaacgcaaactgggcctgcgtatcgaccatattttggtgtcgcctgcgatggcggcggcgttgaaggatgtccgcgtcgatttggagacgcgcgcgctggagcgtccgagcgaccacgcgccggtgacggcagaattcgattggtaa

SEQ ID NO: 4456 - DNA, 573 bp, Neisseria meningitidis
ttgccgtactatttgtactgtctgcggcttcgtcgccttgtcctgatttttgttaatccactatatctgcatcagtttcatgaaacgcaagtcggaagcgtcaaacaactgattgcccattttgaccggctgattgacgaattggacaaacaaatcgacgaccacacccacacgcattttgacggcaaagcccaagtggcagaacaaatcaaaggcatcggttcgataacgacggctacgctgatggcgatgctgcccgaattgaggcggctgtcgcacaaacggatagcgggtttggccggcattgccccgcacccgagggagagcggggaaaccaaattcaaaagccgctgctttggcggaaggtctgcggtgcgtaaggcactgtatatggctaccgtggcagcgacacgttttgaaccgcttattcgggatttccaccaacgcccgctgtccgagggtaagccgtataaggttgccgttacggcatgtatgcgcaaactgctgacgatatcgaatgcccggatgcgtgattattttgccgaaaacgataccgccgaaaacggtatctaa

SEQ ID NO: 4457 - DNA, 3606 bp, Neisseria meningitidis
atgtttcattttgcatttccggcacaaactgccctgcgccaagcgataaccgatgcctaccgccgtaatgaaatcgaagccgtacaggatatgttgcaacgtgcacagatgagcgacgaagagcgcaacgccgcctccgagcttgcccgccgtttggttacccaagtccgcgccggccgcaccaaagccggcggcgtggatgcgctgatgcacgagttttcactctccagcgaagaaggcatcgcgctgatgtgtctggcagaagccctgctgcgtatccccgacaacgccacgcgcgaccgcctgattgccgacaagatttcagacggcaactggaaaagccatttgaacaacagcccttccctcttcgtcaatgctgccgcctggggcctgctgattaccggcaaactgaccgccacaaacgacaaacaaatgagttccgcactcagccgcctgatcagcaaaggcggcgcaccgctcatccgccaaggcgtaaattacgccatgcggcttctgggcaaacagttcgtaaccggacagaccattgaagaagccctgcaaaacggcaaagaacgcgaaaaaatgggctaccgcttctccttcgatatgttgggcgaagccgcctacacccaagccgatgccgaccgctactaccgcgactatgtcgaagccatccacgccatcggcaaagatgcggcaggacaaggcgtttacgaaggtaacggtatttccgtcaaactttccgccatccatccgcgctactcgcgcacccaacacggccgcgtgatgggcgaactgttgccgcgcctgaaagagctgttccttttgggtaaaaaatacgatatcggtatcaacatcgatgccgaagaagccaaccgtctggagctgtctttggatttgatggaggctttggtttcagaccctgacttggctggctacaaaggtatcggtttcgttgtccaagcctaccaaaaacgttgtccgttcgttatcgactacctgatcgaccttgcccgccgcaacaaccaaaaactaatgatccgcctcgtcaaaggcgcgtattgggacagcgaaatcaaatgggcgcaagtggacggcttgaacggctatccgacctacacccgcaaagtccacaccgacatctcctacctcgcctgcgcgcgcaaactgctttccgcgcaagacgcggtattcccgcaatttgccacccacaacgcctacactttgggcgcaatctaccaaatgggtaaaggcaaagattttgaacaccaatgcctgcacggtatgggcgaaaccctgtacgaccaagtcgtcggcccgcaaaacttaggccgccgcgtgcgcgtgtacgccccagtcggcacacacgaaaccctgctcgcctacttggtgcgccgcctgttggaaaacggcgcgaactcgtctttcgtcaaccaaatcgtcgatgaaaacatcagcatcgacacgctcatccgcagcccgttcgacaccatcgccgaacaaggcatccacctgcacaacgccctgccgctgccgcgcgatttgtacggcaaatgccgtctgaactcgcaaggcgtggacttgagcaacgaaaacgtattgcagcagcttcaagaacagatgaacaaagccgccgcgcaagacttccacgccgcatccatcgtcaacggcaaagcccgcgatgtcggcgaagcgcaaccgattaaaaaccctgccgaccacgacgacatcgtcggcacagtcagctttgccgatgccgcgcttgcccaagaagcggttggcgcagccgttgccgcgttccccgaatggagtgcgacacctgccgccgaacgcgccgcctgcctgcgccgttttgccgatttgctggagcagcacaccccagcactgatgatgcttgccgtgcgcgaagcaggcaaaacgctgaacaacgccattgccgaagtgcgcgaagccgtcgatttctgccgctactacgcaaacgaagccgaacataccctgcctcaagacgcaaaagccgtcggcgcgattgtcgccatcagcccgtggaacttcccgctcgccatctttaccggcgaagtcgtttccgcattggcggcaggcaacaccgtcatcgccaaacccgccgaacaaaccagcctgattgccggttatgccgtttccctcatgcacgaagccggcatcccgacttccgccctgcaactcgtcctcggcgcaggcgacgtgggtgcggcattgaccaacgatgcccgcatcggcggcgtgattttcaccggctcgaccgaagtggcgcgcctgatcaacaaagcccttgccaaacgcggcgacaatcccgtcctgattgccgaaaccggcggacaaaacgccatgattgtcgattccaccgcacttgccgagcaagtctgcgccgacgtattgaactccgccttcgacagcgcgggacaacgctgctccgccctgcgcattttgtgcgtccaagaagacgttgccgaccgtatgctcgacatgatcaaaggcgctatggacgaactcgtcgtcggcaaaccgattcagctcactaccgatgtcggccccgtcatcgatgccgaagcacagcaaaacctgttgaaccacatcaacaaaatgaaaggtgttgccaagtcctaccacgaagtcaaaaccgccgccgatgtcgattccaaaaaatccacgttcgttcgccccatcctgtttgaattgaacaacctcaacgaactgcaacgcgaagtcttcggtcccgtcctgcacgtcgtccgctaccgcgccgacgaactcgacaacgtcatcgaccaaatcaacagcaaaggctacgccctgacccacggcgtacacagccgcatcgaaggcacggtacgccacatccgcagccgcatcgaagccggcaacgtttacgtcaaccgcaacatcgtcggcgcagtcgtcggcgtacagcccttcggcggacacggtctgtccggcacaggccccaaagcaggcggttcgttctacctgcaaaaactgacccgcgccggcgaatgggttgccccgaccctgagccaaatcggacaggcggacgaagccgcactcaaacgcctcgaagcactggttcacaaactaccgttcaacgccgaagagaaaaaagccgcagcggccgctttgggacacgcccgcatccgcaccctgcgccgtgccgaaaccgtccttaccggaccgaccggcgagcgcaacagcatctcatggcacgcgcccaaacgcgtttggatacacggcggcagcacggttcaagcctttgccgcactgaccgaacttgccgcctccggcatacaggcagtggtcgaacccgacagccccttggcttcctacactgccgacttggaaggtctgctgctggtcaacggcaaacccgaaaccgccggcatcagccacgttgccgccctgtcgcctttggacagcgcgcgcaaacaggaacttgccgcccacgacggcgcactcatccgcatcctcccttcggaaaacggactcgacatcctgcaagtgtttgaagaaatctcttgcagcgtcaacaccacagccgccggcggcaacgccagcctgatggcggtcgccgactga

SEQ ID NO: 4458 - DNA, 1527 bp, Neisseria meningitidis
atgaatcccatgtacattacttttgcaatctatctggttgcagtccttctcatcgggcttgccgcctatttttctacgcgcaatttcgacgattatattttgggcgggcgcagcctaggcccgtttgttaccgcgatgtcggcaggcgcgtccgatatgtccggctggcttttgatgggtctgccgggcgcgatttatttgagcggtttgaatgaggcttggattgccatcggcctcttggtcggcgcgtatttcaactggcttttggtggcgggccgtctgcgcgtacataccgaatacgccaacaacgcgctgacgctgccggattatttcttccaccgctttggcgcgggcggacacttgatgaaagtggtttccgcactgattatcctgtttttcttcacgatttattgcgcctcgggcattgtggcgggcgcaaccctgttccaaagcctgtttgaaggtatgacttacaatcaggcaatgtggctgggcgcgggcgcgaccatcgcctataccttcttgggcggctttttggcggtaagctggacggatacgctgcaggcttctttgatgattttcgcgctgattttaacgcctgtgatggtctatctgggcttgggcggcgcggaacagatgtctgccgcgattcaaagtgtcgccgcaggcacgggcaaagaatacggcagcctgtttgccggtacgaccgtcatcggcatcatttccaccgccgcatggggcttgggctatttcggacagccgcacattttggcgcgctttatggcggccgaaagcgcgaaatcgctggtatccgcacgccgcatcggtatgacttggatggcgttgtgccttgcgggcgcggtagcggtcggttatttcggcattgcgtatttcggtgcaaatcccgacaaagtttcttctatgagcggcaaccacgaacgcatcttcatcgcgctttccaccctgctgttcaacccttggattgccggcattattttgagcgcgattttggcggcggtgatgtccaccctgtcctgccagcttttggtttgctccagcgcgattaccgaagacttctacaaaggctttttgcgtaaaaacgcgcaacagtcggaattggtatgggtcggccgcctgatggtcttggcgattgccgtgatttccatcctgattgcttccgatccgaacagcaaagtattgggactggtgtcttacgcgtgggcaggtttcggcgcggcattcggcccgattgtgattctgtccgtattgtggaaacgcatcactgcctacggcgcgttgtcgggtatggttgcaggtgcgttaaccgtagtcgtatgggcggaatgggtgaaaaaaccggctcaagcggcaggagaaagcggcttgttgacgatgtacgaaatcgtgccgggctttattgtttgcttgatcgttgccgtgttggtttccctgttcaacaaagaaccttcgcgcgaaacccaagaacgctttgaaaaagccgacgcagattaccgcgccacccgataa

SEQ ID NO: 4459 - DNA, 93 bp, Neisseria meningitidis
atgccgtctgaaaacgggcggcggataatcggcaaaacataccgcgcctcctttgcggttgctaaattacacctcaaaacacctgccgcctga

SEQ ID NO: 4460 - DNA, 321 bp, Neisseria meningitidis
atgttcggcaagcagctttttgaggaagtcggctcgaaaatcagcgaaaccatcgccaacagccctgccaaagatgtggaaaaaaatattaaggcgatgctgggcggcgcgttcaaccgtatggatctggttacgcgcgaagaattcgacatccagcagcaggttttaatcaaaacccgtaccaaactggcggctttggaagcgcgtttggaaaaactcgaagccgcgcaaaatcccgaacgggcagcattggaagcggctgaagccgctgccgaagaagccgtcgccgaaatcaggcagcaaaccgaagccggcgaataa

SEQ ID NO: 4461 - DNA, 1497 bp, Neisseria meningitidis
atgtcgcttgccttggtttacagccgcgccttgagcggtatgaatgcgccgttggtcgaagtggaagcccaccttgccaacggcctgccacatttcaacatcgtcggactgcccgatatggaagtaaaggaaagtcgcgaccgtgtccgtgccgccattattcaaagcggttttgaattccccgccaaaaaaattaccgtcaacctcgcccccgccgacctgcccaaagagtcggggcgtttcgatttgccgattgcaatcggcatccttgccgcatcggggcaggttgcgcccgaaaaactggaggaatacgagtttgcgggggaattggcactgtcggggctgttgcgccccgtgcgtggcgcgttggcgatggcgtggcagggtatgcaggcaaaacgtgcatttgttttgcctgaagaaaatgcaggacaagccgccgtgatgcgcggcattaccgtttacggcgcgcgctctttgggcgaagtcgccgcccatttgaacggcatcgaacctttggcgcaaaccgaatgccaagttcctcagatgccgtttgaacatggcggacaacctgatttgtgcgatgtgaaaggtcagcacaccgcgcgccttgctttggaaatcgctgccgcaggcggacacagcctcttgatgatgggtccgccgggaacgggcaagtctatgctctcccaacggctgcccggcatcctgccgccgctgaccgaagacgaattggtagaagtttgggcattgcgttcgctcctgcccaaccaccaacaacaactcgacagcaaccgtcctttccgcagtccgcatcacagcgccagcgcggcggctatggtcggcggcggttcggatccgcgtccgggcgaaatttcattggcgcaccacggcgttttgtttttggacgagctgcccgagtttgaccgcaaagttttggaagttttgcgcgaaccgttggaaaacggcgaaatccacatttcccgcgcggcgcgccaagccgtctatcctgccaaattccaacttgttgccgccatgaacccctgcccgtgcggttatctcgggcatcccgtcaaaccctgccgctgcacgcccgaaagcgtcgcgcgttaccgcagcaagatttccgggccgctgctcgaccgcatcgatttgaccatcgaagtcccgagcctgtccgccgccgaactgatgcagcaggaagcaggggaaagcagcgcgtccgttttggaacgcgttatcgccgctagagacaaacaatacgcacggcaaggcaaagtgaatgccgccttgagtgtcagtgaactcgacacatccgcccgcattcaaaaagaagcgcaggaagcattgggcggcctgctggaaaaactctccctttccgcccgcagcttccaccgcattatgcgcgtggcgcgtacattggcggatttggcgggcgacgaagaagtcggcagaagccacgtcatgaaagccataggtttccgtcgtgctttatag

SEQ ID NO: 4462 - DNA, 870 bp, Neisseria meningitidis; identical to SEQ ID NO: 383

SEQ ID NO: 4463 - DNA, 645 bp, Neisseria meningitidis; identical to SEQ ID NO: 3611

SEQ ID NO: 4464 - DNA, 822 bp, Neisseria meningitidis
atggattttctgattgtcctgaaagccctgatgatgggcttggtagaaggttttaccgaatttttaccgatttccagcaccggacatttgattgtgttcggcaatctgattggttttcacagcaatcacaaggtttttgaaattgccatccagctcggtgcagttttggcggtagtgtttgaataccggcaacgtttcagcaatgtgttgcacggcttgggaaaagaccggaaagccaaccgcttcgtccttaatcttgccattgcttttatacctgccgccgtgatggggctgttgttcggcaaacaaatcaaagagtatctgtttaaccccttgagtgttgcagtcatgctggttttgggcggtttttttattttgtgggtggagaaacgccaaagccgagcagagcctaaaattgccgatgttgatgcattgcgtccgattgatgccttgatgatcggcgttgcccaagtgtttgcactggttccgggtacgtcccgttcgggcagtacgattatgggcgggatgctttggggcatcgaacggaaaactgcgacagaattctcgtttttcttggctgtgccgatgatggttgccgcaacggcttatgatgtcctgaaacattaccgatttttcaccctgcatgatgtcggtttgattctgataggctttattgctgcctttgtttcaggcttggtagcggtaaaagcgttgctgaggtttgtttccaagaaaaattatattccttttgcctattaccgcattgtttttggtattgccatcattatattgtggctgtcaggctggataagttgggaatga

SEQ ID NO: 4465 - DNA, 1212 bp, Neisseria meningitidis
atgacagcacccgtaccaacgtgtaatatgtcgggaaatccaataaatttacacaagctaacacttatcatgcccctcccctctcccgaagcacggcaattctcgctcaaactgcaaaccctcattgccgaaaaaatcggcaaacacggcaactggattccattttcacgttttatggaattggttttatacgctccgcaatacggctactacaccggcggcagccataaaatcggcaataccggggattttattaccgcaccgaccctcacctctctgtttgcacagacactggcacgccaacttcaagaacttctatcccaaacggcgggcaatatctatgaattcggcgcgggaaccggacagcttgccgccgatttgttgggcagcatttcggacggcatcagccgttactatattattgaaatatcgccggagctggcagcacgtcagaaaaacctgattcaagcacgcgcaccggaagcatctcaaaaagttgtccacttgaccgcacttcccgaagcgtttgacggcatcatcatcggcaacgaagtactcgatgccatgcctgtcgaaatcgtccgtaaaaatgaaggcggctcattcgagcatgtcggcgtttgcctagataatgaccgttttacctattcggcacgaccgctgcacgacttgcagctatctgccttggcttccctctattttcctcaaacagattatccctataccagcgaactacatccgcaacaatatgcctttatccgcacccttgcctcaagactcgaacacggctgcatgatattcatcgactacggttttgatgcagcgcagtattaccaccctcaacgcaatcaaggtactctgatcggacactaccgacatcacattatccacaatccttttgacttcatcggattggccgacctgaccgcacatgtcaactttaccgacattgcacaagcagggacggatgccggattagatttgataggttaccttccccaatcccatttcttattgaacttgggcattaccgagctattggcacagacggggaaaacggattcggcagcctacatctgtgaagctgctgccgttcagaaactgattgaccagcatgaaatgggcgaactgtttaaagtcatcgcattcggaaaaaatatcggcatcgactgggcaggattccgcttcggcgacatctgccacaaactctaa

SEQ ID NO: 4466 - DNA, 456 bp, Neisseria meningitidis
atgttcggcggcgcacacgaattaagcatcgacagtaaggggcggttggctgttcctgccaaattccgtgacattctgtcgcgcctctatacgcctgccgtagtggtaacgctcgagtcgaaacacaagctgttgatgtaccctgttgcggagtgggaaaaggttgcggcgcaacttttaaacttaaaagtggcggataaccctgttttgcggcggtttcaaaatcttttgctgcataacgcggaaattttggaatgggacagcgccggccgggtgctggtttctgccggactgaggaagagggtggatttcgaccgtgaagtcgttttggtcggtcgtgccaaccgtttggagctttggggtcgcgagcagtgggaggctgagatggttcaggctttggatgacgatcctgacgaacttgccttccagttgagtcagacggatttgcaattgtga

SEQ ID NO: 4467 - DNA, 987 bp, Neisseria meningitidis
gtgagtggagcagaaagttaccggcatatcacggtcttgctgaatgaggcggtggatgcgcttgccgtgcgcgaagacggtgtctatgtggacggtacgttcggcaggggagggcattcccggctgattttgtcgcgtttgggcgatgcggggcggttgattgttttcgacaaagacccgcaggcgattgctgtggcagaagagctggcgcgttcggacaaacgggtcggtgtcgtgcatggcggttttgcttcgtttcagacggcattggacggtttgggtatcggcaaggtggacggtgcgctgtttgatttggggatttcgtccccgcaaatcgatgacggcagccgcggtttcagcttccgtttcgatgcccctttggatatgcgtatggatacgacgcgcggtatgtctgccgcagagtggatagcggttgcgtcggaacaggatttgcacgaggtaatcaagaattatggtgaagagcggtttagccgccggattgcgcgcgccattgttgcgcaacgggcggaaagtccaatcgatacaacccgcaagctggcgcagatcgtggcacaaaacgtccgtactcgcgagcgggggcaggatcctgcgacgcgcaccttccaggcggtccgcatctttattaaccgcgagcttgaagaagtaggggcagtattgccgcaggtcatgtgtcgtctgaaagagggcggacgtttggcggtcattgctttccattcgttggaagatcgcattgtgaagcagtttgtcaaaaaatattcgcaacacgcgcccctgccgcgctgggcggcggtcagggaagcggatttgcccgagctgcccctgaaaatcgtgggcagggcattaaagccgggtgaggcggaaattgccgccaatccgagggcgagaagtgcggttttgcgtgtggcggagcggactgccggtccgataccggaacaatcacagagaaaaacgtctgaatggcaatga

SEQ ID NO: 4468 - DNA, 270 bp, Neisseria meningitidis
atggcaatgaacaaattgaatttccttctgctgcttgcggtgtgcgtttccgctttttccgttgtgatgcagcaaaaccagtacaggctcaatttcacagctttggataaggcgaaaaaacaggaaatcgccttggagcaggattatgcgcaaatgaggctgcaacaggcgcgtttggcgaaccacgaagcgatcagggcggcggcagaaaaacaaaacctccatccgccggtttcgggcaatacctttatggtggagcatcaaagatag

SEQ ID NO: 4469 - DNA, 1746 bp, Neisseria meningitidis; identical to SEQ ID NO: 3671

SEQ ID NO: 4470 - DNA, 1479 bp, Neisseria meningitidis
atgttcagcaagttaacccctttggctgaaaccggcatcccgactctgtcgtgtgcaaacgcggcagggcgtttgttgcattcagacagccgccaaatcaaacaaggcgatattttcgttgcctgtccgggcgaatatgccgacggacgcagttatatccccgccgccgttgccaacggcgcggcttttgttttttgggacgacgacggcaaatttgcgtggaatcccgaatggaaagtccccaatcaaggcatcaaagatttgaaacaccgtgccggcatattggcggcgcaagtttacggcaacgtttcagacggcctcaaagtttggggcgtagccggaaccaacggcaaaacctccatcacacaatggctggcgcaagctgccgatttgttgggcgaaaaaaccgccattgtcggcacggtcggcaacggcttttggggtgcattggaagaaaccacgcataccacacccgcccccgtcgatgtccaaaccctgctctaccgtttccgtcaacaaggcgcaacagtcgccgcgatggaagtctccagccacgggcttgaccagtcgcgcgtcaacggcgtgtcattccgcagcgcaatctttaccaacctcacccgcgaccacctcgactaccacggcacgatggaagcctacggtgccatcaagtcgcgcctgttttactggcacggcttgaaacacgcagtcatcaacgtggatgacgaatacggcgcggaactcgtaggtcgtctgaaaaaagactgtcccgatttggccgtttacagctatggtttcagcgaacacgccgacatccgcattaccgactttaccgcctcttcagacggcatagcagccgtattccaaaccccgtggggcgaagggaaatgccgcacgcgcctgctcggacggttcaacgcgcaaaacctcgccgcctgcatcgccttgctgtgcgccaacggctatccgcttgataaggtattggatgtgctggcaaaaatccgtcccgcttcagggcgcatggactgcatcatgaacagcggcaagcccttggtcgttgtcgattatgcccacacgcccgacgcattggaaaaagcactcgccaccttgcaggaaatcaaaccgcagggtgcggctttatggtgcgtattcggttgcggcggcaaccgcgatcgcggcaaacgcccgctgatgggcgcggcagccgtacagggcgcggataaagtcgtcgtcaccagcgacaacccgcgtttggaaaatccgcacgacatcatcaacgacatcctgcctgccgttcccgcgcccgaatgcgtcgaagccgaccgtgccgccgccgtccgttatgcggttgaacaagccgccgcaaacgacatcatcctgattgccggcaaagggcatgaaaactatcaggatgtacaaggcgtgaagcaccgtttttccgatcttgaaatcgtcggacaggctttgttaactcgtaaataa

SEQ ID NO: 4471 - DNA, 1648 bp, Neisseria meningitidis
atgaaacaatccgcccgaataaaaaatatgaatcagacattaaaaaatacattgggcatttgcgcgcttttagccttttgttttggcgcggccatcgcatcaggttatcacttggaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatcgggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataaaaattatgttgtggttatcggtgagagcgcgcgttcggattatatgaatgtttacggtttcccattgcccgatacgccttttttgagtcagaccaaagggctgttgataaacggttaccaatcgaccgcccacgcgacgaatctttcgctgccgcagactttggggctgccgggagaaccgaacaataacatcgtcagcttggcgaagcaggcgggttttcggacggcgtggctgtctaatcaaggaatgttggggcattttgccaacgaaatttccacctatgccctacgcagcgattatccgtggtttacccaaaggggtgattatggcaaaagcgcggggttgagcgaccgccttttgttgccggcgttcaaacgggttttgataggaaatgcaggcacgaagcctcggctgattgtgatgcacctgatgggttcgcacagtgatttttgcacacgtttggataaggatgcgcggcggtttcagtatcaaactgaaaaaatatcctgctatgtttccaccatcgcgcaaaccgataaatttttagaagatacagttaagatattgaatgaaaataaagaaagctggtctttggtttacttttccgaccacggtttgatgcatgtcggtaaaggcggcgagcgaacgttgacacatggtgcgtggaagcgtcaaagctacggcgtgccgctggttaaaatttcgtccgatgacacgcggcgcgaaatgattaaagtgaggcgcagcgcgtttaattttttacgcggattcggcagttggacgggtatcgaaaccgacgagttgcccgatgacggctatgatttttgggggaatgttcccgatgtgcagggcgaaggcaataaccttgcctttatcgacggactgcccgacgaccccgcgccgtggtatgcgggaaaaggcaaatcgactaaaaatacgtctaaaaaatga

SEQ ID NO: 4472 - DNA, 1368 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgagcggtttgacgcgcatgattttgttgaagacgtattggctgctggtgcggcggcggttgtggtttcgcgcgaagattgtgctgcaatggatggcgcgttgaaagtcgatgacacgcttgccgcattgcaaacgctggcaaaggcgtggcgtgaaaatgtgaatccgtttgtgttcggcattaccggttcgggcggcaagacgacggtgaaggaaatgctggctgcggtattgcgccgccgtttcggcgatgatgccgtgttggcgacggcaggcaacttcaacaaccatatcggattgccgctgactttgttgaagttaaacgaaaaacaccgctatgccgtgattgaaatgggcatgaaccatttcggcgaactggcggttttaacgcaaatcgccaaaccaaatgccgcattggtcaacaacgccatgcgcgcccatgtcggctgcggtttcgacggagtgggcgatattgccaaagcgaaaagcgagatttaccaaggtttatgttcagacggcattgcactgattcctcaagaagatgccaatatggctgtcttcaaaacggcaacgcttaatttgaatacgcgcactttcggcatcgatagcggcgatgttcacgcggaaaatattgtgctgaaaccgttgtcgtgcgaatttgatttggtgtgcggcgatgagcgcgccgccgtggtgctgcctgttcccggccgccacaatgtccacaacgccgccgctgccgccgcgctggctttggctgcgggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcgattgacgtgttggcgcgtatgcctgcgccgcgtattttcgtgatgggcgatatgggcgaactgggcgaactgggcgaggacgaagccgccgctatgcacgccgaagtcggcgcgtatgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 4473 - DNA, 177 bp, Neisseria meningitidis
atgaaaagccgacgtttttttaaagccttattgctgattgccgcgctggtcggcgcgttttatgccggaatgcggacgcaggcgtatctttatgaagatttatgtttagacttgggcggcggtaaaaatccggggagttacccaatttgcgtgattgagaaagtccctgcacgttaa

SEQ ID NO: 4474 - DNA, 1083 bp, Neisseria meningitidis
atgtttttatggctcgcacatttcagcaactggttaaccggtctgaatatttttcaatacaccacattccgcgccgtcatggcggcgttgaccgccttagcgttttccctgatgttcggcccgtggacgatacgcaggctgaccgcgctcaaatgcgggcaggcagtgcgtaccgacggtccgcaaacccacctcgtcaaaaacggcacgccgacgatgggcggttcgctgattctgaccgccattaccgtgtccaccctgttgtggggcaactgggcaaacccgtatatctggattctcttgggcgtattgctcgccacgggcgcactcggtttttacgacgactggcgcaaagtcgtctataaagaccccaacggcgtgtccgccaaattcaaaatggtgtggcagtcaagcgttgccattatcgccagtttggcattgttttaccttgccgccaattccgccaacaatattttgattgtcccgttcttcaaacaaatcgccctgccgctgggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgttatcgtccgccaagagtttgtcctcgtcattatgggcggattatttgtcgtagaagccgtatccgttatgcttcaggttggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctga

SEQ ID NO: 4475 - DNA, 597 bp, Neisseria meningitidis; identical to SEQ ID NO: 3

SEQ ID NO: 4476 - DNA, 1338 bp, Neisseria meningitidis
atgacttttcaaaacaaaaaaatcctcgtcgccggactcggcggtacgggtatttccatgattgcctacctgcgcaaaaacggcgcggaggttgctgcgtatgatgcggagctgaagccggaacgcgtgtcgcaaatcggtaagatgtttgacgggttggtgttttacacgggccgtctgaaagatgcgctggacaacggtttcgatattctggctctcagtcccggcatcagcgagcggcagccggatattgaggcgttcaagcaaaacggcggacgcgtgttgggcgacatcgaattgctggcggacattgtgaaccgccgggacgacaaggtaattgcgattaccggcagcaacggcaaaaccacggtaacgagcctggtcggctatctctgtatcaagtgcgggctggataccgttatcgcgggcaatatcggcacgccggttttggaggcggaatggcagcgcgaaggcaaaaaggcggacgtgtgggtgttggagctttccagcttccaactggaaaacaccgaaagcctgcgtccgactgcggcgacggtgctgaacatttccgaagaccatctcgaccgctacgacgacttgctcgactatgcgcataccaaagccaagattttccgtggcgacggcgtgcaggttttgaatgcggacgatgcgttctgccgcgcgatgaagcgtgccgggcgcgaggtaaaatggttttcgttggaacacgaagctgatttctggttggaacgcgagacaggccgcctgaaacaaggcaatgaagatttgattgtcacgcaagacattccgttgcaaggtctgcacaacgccgctaacgtcatggctgccgtggctttgtgtgaggccatcggtttgtcgcgcgaagcattgctcgaacacgtcaaaaccttccaaggcctgccgcaccgcgtggaaaaaatcggcgagaaaaacggcgtggtgtttatcgacgacagcaaaggcacgaatgtcggcgcgactgccgccgcgattgccggtttgcaaaatccgctcttcgtgattttgggcggcatgggtaaagggcaggacttcacgcccctgcgcgatgcactggtaggcaaggcaaaaggcgtgttcttgattggtgtcgatgcgccgcaaatccgccgcgatttggacggctgcggcttgaatatgaccgactgcgccactttgggagaagccgttcagacggcatatgcccaagccgaagcaggcgatattgtgttgctcagccccgcctgcgcgagctttgatatgttcaaaggctacgcgcaccgttcggaagtgtttatcgaagcgtttaaggctttgtga

SEQ ID NO: 4477 - DNA, 1272 bp, Neisseria meningitidis
gtgggcgacggtgtccacactctgctgctcgacaggccgattgtgcgcgacggcaggaaattcgacgcgccgcttttgtggatggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatagattatgaaaaccgccggaaaatgcgcggttatcgggtggagtaa

SEQ ID NO: 4478 - DNA, 1068 bp, Neisseria meningitidis
atgggcggtaaaacctttatgctgatggcgggcggaacgggcggacatattttccccgcgctggcggtggcggattcattgcgcgcgcgcggccatcatgtgatttggctgggcagcaaggattcgatggaagagcgtatcgtgccgcaatacggcatacgcttggaaacgctggcgattaaaggcgtgcgcggcaacggcatcaaacgcaaactgatgctgccggttactttgtatcaaaccgtccgcgaagcgcagcggattatccgcaaacaccgtgtcgagtgcgtcatcggcttcggcggcttcgttaccttccccggcggtttggcggcgaagctattaggcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcaggcattggctttgctgcccgacaatgcgcgtccgcagatgtaccaccaatcgggacggggcaagctgggcagcttgcaggcggattacgacgcgctgggcgtgaaagccgaatgcgtggaatttattaccgacatggtgtccgcctaccgcgatgccgatttggtgatttgccgtgccggcgcgctgacgattgccgagttgacggcggcgggattgggtgcgttgttagtgccgtatcctcacgcggttgacgatcaccaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgtggcggaagccgcgattgcgtgtgcggcgtaa

SEQ ID NO: 4479 - DNA, 1410 bp, Neisseria meningitidis
atgatgaaaaatcgagttaccaacatccattttgtcggtatcggcggcgtcggcatgagcggcatcgccgaagtcttgcacaatttgggctttaaagtttccggttcggatcaggcgcgaaatgccgctaccgagcatttgggcagcctgggcattcaagtttatcccggccataccgccgaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcactaacgcccgcttgggcaaaggcgaatacatcgttgccgaagccgacgagtcggatgcatcctttctgcacctgacaccgattatgtccgtcgttaccaatatcgacgaagaccatatggatacctacgggcacagcgtcgaaaaactgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgcgctcttggtggacgactacggacaccaccccgtcgaaatggcggcgacccttgccgccgcacgcggcgcgtatctggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgccgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggcgcgggaagcatcaaccgcgtccccgccgcgctgctggcattgtcgaaacagatttga

SEQ ID NO: 4480 - DNA, 915 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcctaaagaaaccccattgtctgaattgaaggcacaaggttttcagacggcattcaacatccttcacggtacttacggcgaagacggggcggttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcattcccgcaaccgagttttacgactacgaagccaagtacaaccgcgacgacaccatttatcaatgtccttcggaagatttgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgacgagccatagtttagtaccgaaatccgctgccgttacgggcgtgggttttgccgatttatgtattgaaattttgaagaccgcacatgtgggataa

SEQ ID NO: 4481 - DNA, 708 bp, Neisseria meningitidis
atggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaagacattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcagcatctgttgcgtaaaaataaaaatcggttatcctatgtggatatgaggtataaggacggattttcagtccgctatgcttccgacggtttacccgaaaaagaatccgaagaatag

SEQ ID NO: 4482 - DNA, 1245 bp, Neisseria meningitidis
atggaacagcagcaaagatacatcagcgtactggatatcggtacgtctaaagtcctcgcactgatcggggaagttcaagatgacgacaaaatcaacatcgtcggtttggggcaggctccttcacggggcttgcgcgcgggcatggtaaccaatatcgatgccaccgtccaagccatcaggcaggcggtcaatgatgccgagctgatggcggataccaaaattactcacgttaccacaggtatcgcaggcaaccacatccgcagtctcaattcgcaaggtgtggttaaaattaaagatggggaagtcacgcaggcagacatcgatcgcgccattgaaacggcaaaggcaatcaatatcccgcccgatcaaaaaattctcgatgccgtggttcaagactacattattgacacccaacttggcgtgagggagcccatcggtatgagcggtgtgcgtctggatacgcgggtgcacatcattaccggtgcaagtacggcagtgcagaatgtccaaaaatgtatcgagcggtgcggtttgaaaagcgatcagatcatgcttcagccgttggcaagcgggcaggcggtgctgactgaagatgaaaaagacctcggcgtatgcgtcatcgacattggtggcggaacgaccgatattgccgtttatatgaacggtgccatccgccatacgtccgtcattccggccggtggtaatctgattaccaaagatttgtccaaatcgttgagaacacctctcgatgccgccgagtacattaaaatccattatggcgtggcatcatgcgatacggaaggcttgggtgagatgattgaagttccgggcgtgggtgaccggacatcgcgtcaggtttccagtaaggttctggcagcaatcatcagtgcacggattcaggagatttttggcgtagtgctgggcgagctgcaaaaatcgggtttccccaaagaagtgctgaatgcgggtatcgttctgaccggcggtgtgtccatgatgaccgggattgtggaatttgccgaaaaaatcttcgatttgcctgtacgcaccggtgcaccccaagaaatgggcggtttgtccgaccgcgtccgcacaccgcgtttttctaccgctatcgggctgcttcatgcagcatgcaagctggaaggaaacttgccgcagccggaaaacggtgcagtgcaagagagggaagggggcggcggtttgttggcaagattgaaacggtggattgaaaacagcttctga

SEQ ID NO: 4483 - DNA, 1179 bp, Neisseria meningitidis
atggaatttgtttacgacgtggcagaatcggcagtcagccctgcggtgattaaagtaatcggcttgggcggcggcggttgcaatgcaatcaataacatggttgccaacaatgtgcgcggtgtggagtttatcagtgccaatacggatgcgcagtctctggcaaaaaaccatgcggcgaagagaatccagttgggtacgaatctgacacgcggtttgggcgcgggcgcgaatcccgatatcggccgtgcggcagcccaggaagaccgggaagccattgaagaagccattcgcggtgcgaatatgctgtttatcacgaccggtatgggcggcggtaccggtaccggttccgcgccggttgttgctgagattgccaagtctttgggcattctgaccgttgccgtggttacccgaccgttcgcatatgaaggtaagcgcgtccatgtcgcacaggcagggttggaacagttgaaagaacacgtcgattcgctgattatcatcccgaacgacaaactgatgactgcattgggtgaagacgtaacgatgcgcgaagccttccgtgccgccgacaatgtattgcgcgatgcggtcgcaggcatttccgaagtggtaacttgcccgagcgaaatcatcaacctcgactttgccgacgtgaaaaccgtgatgagcaaccgcggtatcgctatgatgggttcgggttatgcccaaggtatcgaccgtgcgcgtatggcgaccgaccaggccatttccagtccgctgctggacgatgtaaccttggacggagcgcgcggtgtgctggtcaatattacgactgctccgggttgcttgaaaatgtccgagttgtccgaagtcatgaaaatcgtcaaccaaagcgcgcatcccgatttggaatgcaaattcggtgcggctgaagacgagaccatgagcgaagatgccatccggattaccattatcgctaccggtctgaaagaaaaaggcgcggtcgattttgttccggcaagggaggtagaagcggttgctccgtccaaacaggagcaaagccacaatgtcgaaggtatgatccgcaccaatcgcggtatccgcacgatgaaccttaccgctgcggatttcgacaatcagtccgtacttgacgactttgaaatccctgcgattttgcgtcgtcaacacaattcagacaaataa

SEQ ID NO: 4484 - DNA, 1311 bp, Neisseria meningitidis
atggacacttcaaaacaaacactgttggacgggatttttaagctgaaggcaaacggtacgacggtgcgtaccgagttgatggcgggtttgacaacttttttgacgatgtgctacatcgttatcgtcaaccctctgattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgatttttatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggtttgggcgatattcatcagccgtccgcgttgttggcattgttcggttttgctatggtggtcgtattgggacatttccgcgttcaaggcgcaatcatcatcaccatcttgaccattaccgtcattgccagcctgatgggtttgaatgaatttcacggcatcatcggcgaagtaccgagcattgcgccgacttttatgcagatggattttgaaggcctgtttaccgtcagcatggtcagtgtgattttcgtcttcttcttggtcgatctatttgacagtaccggaacgctggtcggcatatcccaccgtgccgggctgctggtggacggtaagctgccccgcctgaaacgcgcactgcttgcagactctaccgccattgtggcaggtgcggctttgggtacttcttccaccacgccttatgtggaaagcgcggcgggcgtatcggcaggcggacggaccggcctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggatattgattgggacgatatgacggaagccgcacctgcgttcctgaccattgttttcatgccgtttacttattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 4485 - DNA, 105 bp, Neisseria meningitidis
atgaaaccaattcagatgttttccccttttctgaataatccccttgttttcttcttgtctgcggttttgccgcataattccgaacggtctgctgtttttctttga

SEQ ID NO: 4486 - DNA, 879 bp, Neisseria meningitidis
atgatgagtcaacactctgccggagcacgtttccgccaagccgtgaaagaatcgaatccgcttgccgtcgccggttgcgtcaatgcttattttgcacgattggccacccaaagcggtttcaaagccatctatctgtccggcggcggcgtggcagcctgttcttgcggtatccctgatttgggcattaccacaatggaagatgtgctgatcgacgcacgacgcattacggacaacgtggatacgcctctgctggtggacatcgatgtgggttggggcggtgcattcaatattgcccgtaccattcgcaactttgaacgcgccggtgttgcagcggttcacatcgaagatcaggtagcgcaaaaacgctgcggccaccgtccgaacaaagccattgtatctaaagatgaaatggtcgaccgtatcaaagctgccgtagatgcgcgcgttgatgagaacttcgtgattatggcgcgtaccgatgcgctggcggtagaaggtttggatgccgctatcgaacgcgcccaagcttgtgtcgaagccggtgcggacatgattttccctgaagccatgaccgatttgaacatgtaccgccaatttgcagatgcggtgaaagtgcccgtgttggcgaacattaccgagtttggttccactccgctttatacccaaagcgagctggctgaaaacggcgtgtcgctggtgctgtatccgctgtcatcgttccgtgcagcaagcaaagccgctctgaatgtttacgaagcgattatgcgcgatggcactcaggcggcggtggtggacagtatgcaaacccgtgccgagctgtacgagcatctgaactatcatgccttcgagcaaaaactggataaattgtttcaaaaatga

SEQ ID NO: 4487 - DNA, 1155 bp, Neisseria meningitidis
atgactgaaactactcaaaccccgaccctcaaacctaaaaaatccgttgcgctttctggcgttgcggccggtaataccgctttgtgtaccgttggccgtaccggcaacgatttgagctatcgcggttacgacattctggatttggcacaaaaatgcgagtttgaagaagtcgcccacctgctgattcacggccatctgcccaacaaattcgagctggccgcttataaaaccaagctcaaatccatgcgcggcctgcctatccgtgtgattaaagttttggaaagcctgcctgcacatacccatccgatggacgtaatgcgtaccggcgtatccatgctgggctgcgttcatcctgaacgtgaaagccatccggaaagtgaagcgcgcgacatcgccgacaaactgatcgccagcctcggcagcatcctcttgtactggtatcaatattcgcacaacggcaaacgcattgaggttgaaagcgacgaagagaccatcggcggtcatttcctgcaactgttgcacggcaaacgcccaagcgaatcacacatcaaagccatgcacgtttcactgattctgtatgccgaacacgagttcaacgcttctacctttaccgcccgcgtgatcgccggtacaggctctgatatgtactccagcattaccggagcaatcggcgcgttgaaaggtccgaaacacggcggcgcgaacgaagtggcttacgatattcaaaaacgctaccgcaatgccgacgaagctgaagccgacatccgcgaacgcatcggccgcaaagaaatcgtgatcggtttcggtcatccggtgtacaccatttccgaccctcgcaacgttgtcattaaagaagtggcacgcggtttgagcaaagaaaccggcgatatgcgcctctttgacattgccgaacgtttggaaagcgtgatgtgggaagagaaaaaaatgttcccgaatctggactggttctctgccgtttcctaccaaaaattgggcgtaccgaccgctatgttcacaccgctgttcgtaatttcccgtacaaccggttggagcgcacacgttcttgagcaacgcaaagacggcaaaatcatccgtccgagcgcaaactacacaggccctgaagatttggcgtttgtggagattgaagaacgataa

SEQ ID NO: 4488 - DNA, 789 bp, Neisseria meningitidis; identical to SEQ ID NO: 433

SEQ ID NO: 4489 - DNA, 2607 bp, Neisseria meningitidis
atggctgccaaccaacgttaccgcaaaccgctgcccggtacggatttggaatactacgacgcgcgtgcggcgtgtgaggacatcaagcccggctcttacgacaagctgccttacacgagccgcattttggcggagaatttggtcaaccgcgcggacaaagtcgatttgccgacgctgcaaagctggctggggcagttgatagaagggaagcaggaaatcgactttccgtggtatccggcgcgggtggtgtgccacgatattctggggcagaccgcgttggtggatttggcaggcctgcgcgatgcgattgccgaaaaaggcggcgatcctgccaaagtgaatccggtggtgcaaacccagctcatcgtcgaccactctctggcggtggagtgcggcggttacgatcctgatgccttccgcaaaaaccgcgaaatcgaagaccgccgtaacgaagaccgtttccacttcatcaactggacaaaaaccgcgtttgaaaatgtggacgtgattccggcgggcaacggcatcatgcaccaaatcaatctagaaaaaatgtcgcccgtcgtccaagtcaaaaacggcgtggctttccccgatacctgcgtcggtactgactcacatacgccgcacgtcgattcattgggcgtgatttccgtgggcgtgggcggattggaagcggaaaccgtaatgctgggacgcgcgtccatgatgcgcctgcccgatattgtcggcgttgagctgaacggcaaacggcaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatcctcgcgttttgaaatttgatttgagcagcgtaacgcgcaatatggcaggcccaagtaacccgcatgcccgttttgcgaccgccgatttggcggcgaaagggctggcgaagccttacgaagagccttcggacggccaaatgcccgacggctcggtcatcatcgccgcgattaccagttgcaccaacacttccaacccgcgcaacgttgttgccgccgcgctcttggcacgcaatgccaaccgtctcggcttgaaacgcaaaccttgggtgaaatcttcgtttgccccgggttcaaaagtagccgaaatctatttgaaagaagcgggcctgttgcccgaaatggaaaaactcggcttcggtatcgtcgccttcgcctgcaccacctgcaacggcatgagtggcgcgctggatccgaaaatccagaaagaaatcatcgaccgcgatttgtacgccaccgccgtattatcaggcaaccgcaacttcgacggccgtatccacccgtatgcgaaacaggctttcctcgcttcgcctccgttggtcgttgcctacgcgctggcaggcagtatccgtttcgatattgaaaacgacgtactcggcgttgcagacggcaaggaaatccgcctgaaagacatttggcctgccgatgaagaaatcgatgccgtcgttgccgaatatgtgaaaccgcagcagttccgcgatgtgtatgtaccgatgttcgacaccggcacagcgcaaaaagcacccagtccgctgtacgattggcgtccgatgtccacctacatccgccgtccgccttactgggaaggcgcgctggcaggggaacgcacattaagaggtatgcgtccgctggcgattttgcccgacaacatcaccaccgaccacctctcgccgtccaatgcgattttggccgtcagtgccgcaggcgagtatttggcgaaaatgggtttgcctgaagaagacttcaactcttacgcaacccaccgcggcgaccacttgaccgcccaacgcgctaccttcgccaatccgaaactgtttaacgaaatggtgaaaaacgaagacggcagcgtgcgccaaggctcgttcgcccgcgtcgaacccgaaggcgaaaccatgcgcatgtgggaagccatcgaaacctatatgaaccgcaaacagccgctcatcatcattgccggtgcggactatggtcaaggctcaagccgcgactgggctgcaaaaggcgtacgcctcgccggcgtagaagcgattgttgccgaaggcttcgagcgtatccaccgcaccaaccttatcggcatgggcgtgttgccgctgcagttcaaacccgacaccaaccgccataccctgcaactggacggtacggaaacctacgacgtggtcggcgaacgcacaccgcgctgcgacctgaccctcgtgattcaccgtaaaaacggcgaaaccgttgaagttcccgttacctgctgcctcgatactgcagaagaagtattggtatatgaagccggcggcgtgttgcaacggtttgcacaggattttttggaagggaacgcggcttag

SEQ ID NO: 4490 - DNA, 1170 bp, Neisseria meningitidis
atgccgcaaattaaaattcccgccgtttactaccgtggcggtacatcaaaaggcgtgtttttcaaacgttccgacctgcccgaggcggcgcgggaagcgggaagcgcacgcgacaaaatcctcttgcgcgtactcggcagcccggatccctacggcaagcagatagacggtttgggcaacgccagctcgtccaccagcaaggcggtgattttggacaagtccgaacgcgccgatcacgatgtcgattaccttttcgggcaagtttccatcgacaaaccttttgtcgattggagcggcaactgcggcaacctcaccgctgccgtgggcgcattctccatcgaacagggcttggtcgataaaggcaagattccttcagacggcatctgcacggtcaaaatctggcagaaaaacatcggcaaaaccattattgcccatgtaccgatgcaaaacggcgcagttttggaaacaggcgattttgagctcgacggcgtaacgttcccggcagccgaagtacaaatcgaatttcttgatccagccgacggcgaaggcagtatgttcccaaccggcaatttggtcgatgaaattgatgtgccgaatataggccgtttgaaagccacgctcatcaacgcgggcattccgaccgttttcttgaatgccgccgacttgggctacacaggcaaagagttgcaagacgacatcaacaacgatgccgcggctttggaaaaattcgagaaaatccgcgcttacggtgcgctgaaaatgggtctgatcagcgacgtatccgaagctgccgctcgcgcgcacacgccgaaagtcgccttcgtcgcgcccgccgccgattacaccgcctccagtggcaaaaccgtgaacgccgccgacatcgatttgctggtacgcgccctgagcatgggcaaactgcaccacgcgatgatgggtaccgcctctgttgccattgcgaccgccgccgccgtacccggtacgctggtcaaccttgccgcaggcggcggaacgcgtaaagaagtgcgcttcgggcatccttccggcacattgcgcgtcggtgcagccgccgaatgtcaggacggacaatggacggccaccaaagcggtcatgagccgtagcgcacgcgtgatgatggaaggttgggtcagggtgcctgaggattgtttttaa

SEQ ID NO: 4491 - DNA, 1200 bp, Neisseria meningitidis
atgtccgaccaactcatcctcgttctgaactgcggcagttcatcgctcaaaggcgccgttatcgaccgaaaaagcggcagcgtcgtcctaagctgcctcggcgaacgcctgaccacgcccgaagccgtcattacgttcaacaaagacggcaacaaacgccaagttcccctgagcggccgaaattgccacgccggcgcggtgggtatgcttttgaacgaactggaaaaacacggtctgcacgaccgcatcaaagccatcggccaccgcatcgcccacggcggcgaaaaatacagcgagtctgttttgatcgaccaggccgtaatggacgaactcaatgcctgcattccgcttgcgccgctgcacaaccccgccaacatcagcggcatccttgccgcacaggaacatttccccggtctgcccaatgtcggcgtgatggatacttcgttccaccaaaccatgccggagcgtgcctacacttatgccgtgccgcgcgagttgcgtaaaaaatacgctttccgccgctacggtttccacggcaccagtatgcgttacgttgcccctgaagccgcacgcatcttgggcaaacctctggaagacatccgcatgattattgcccacttaggcaacggcgcatccattaccgccatcaaaaacggcaaatccgtcgataccagtatgggtttcacgccgatcgaaggtttggtaatgggtacacgttgcggcgacatcgatccgggcgtatacagctatctgacttcccacgccgggatggatgttgcccaagtggatgaaatgctgaacaaaaaatcaggtttgctcggtatttccgaactttccaacgactgccgcaccctcgaaatcgccgccgacgaaggccacgaaggcgcgcgcctcgccctcgaagtcatgacctaccgcctcgccaaatacatcgcttcgatggctgtgggctgcggcggcgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggcattatcagcccgaccgattcttctccggctgttttggttgtcccgaccaatgaagaactgatgattgcctgcgacactgccgaacttgccggcatcttgtag

SEQ ID NO: 4492 - DNA, 642 bp, Neisseria meningitidis
atgacgataaggaaacaaaccatggcacagtttttcgctattcatcccgacaatccccaagaacgcctcatcaagcaggcggttgaaatcgtcaataaaggcggcgtggtcgtttatccgaccgattcctgttatgccttgggctgcaaactcggcgataaggcggcgatggaacgcatactctccatccgcaaaatcgatttgaaacaccacctgaccctgatgtgcgcagatttgagcgagttgggcacatacgccaaagtcgacaacgtacagtttcgtcagcttaaagccgccacacccgggccttatacttttattttacaggcgacgaaggatgtgccggcgcgcacgctgcacccgaaacgcaaaaccatcgggctgcgtattcccgataatgccattgcacaagccctgctgggggaattgggcgagccgcttttaagctgcaccctgatgctgcccgaagacggcgaaccattgaccgatccttatgaaatccgcgagcgtttggaacacgccgtcgatttggtgattgacggcggctggtgcggaaccgagccgaccaccgtcgtcgatatgaccgacggcacggaattggtgcgccaaggttgcggcgatacggcggtgttcggtttgtag

SEQ ID NO: 4493 - DNA, 444 bp, Neisseria meningitidis
atgtatttgacacaacatacggactacgggctgcgcgtccttatctacactgccatcaacgacgatgcgctggtcaacatcagtaccatcgccgtaacctacggcatttccaaaagccatctgatgaaggtcgttaccgcgctggtcaaaggcggcttcctccacagtgtgcgcggaaaaggcggcggtctgcggcttgccgcaccgcccgaccgcatcaacatcggctcggttgtccgccacctcgaaccgatgcagctggtcgagtgcatgggcgagaacaacgaatgcctgattacaccgtcctgccggctgacgggcatactcggcggcgcgatgaagtcgtttttcacgtatctggacggtttcacgctccaagacctgctcaacaagccgacctacgacctgctctacgaaccgagaattccgattgcggtgcagtaa

SEQ ID NO: 4494 - DNA, 369 bp, Neisseria meningitidis
atgaaaccgttgaaacgacatcccgcccttatcgggctttcgcgtgaccaccaccattcgctttccctgtgcgtgcgtctgttgcggacgccggaagaaaggcatcgggacgaactcgaaccgcatttttccgaattggaaacccattttcgcgaagaagaaaccaagtttgccccaatttggcagaatgtcgcccccgaattgaaacaacgtttcgagaaagaccacgcccgactgcggcagatgatggcaagccccgaatacggtaacgcggcgtggaataccgcttttgccacaaccctgcgcgaccacgcgcgctttgaagaacgcgagctgtttcccgccgccgaaccgtttttgccggcatga

SEQ ID NO: 4495 - DNA, 1155 bp, Neisseria meningitidis; identical to SEQ ID NO: 707

SEQ ID NO: 4496 - DNA, 873 bp, Neisseria meningitidis
atgcccattttgaaccatattgccctcatcggtgtagggctgatcggcggttcgttcgttctcgacctcaaaaggcagggactcgtccgcaccgttaccggtatcgacaccgaccgcgacaacctcgaacgtgcattggaacgcggcgtgattgaccaggcttccgttgccatcgacgcggacagcatcggcggtgcggacttggtactgattgccacgcccgtcgccaccgttcccgccattttgaccgcgctgcgccccgttttgccggaacacacttggatttccgatgtcggcagcaccaaatcttcggtcatcgaagccttccgccgctgtctgcccgaccgcctgcaccactgcatcgccgcccacccaattgccggttcggacagaagcggtgcgcaagccgcgcagttcgggctgttccgccacagaaaactcatcatcacgccacacggcggcgaacattcagacggcattgccttggtagaaaacctgtggcacgcggtcggtgcggaaatttatacgatggacgcgcaacgccacgacgcggttttcgccgccgtctcccatatgccccacctgaccgccttcgcctatgtccaccagattctcgaccaccccgacggacaggaatatctgaaattcgccgccacgggctttcgggacttcacccgcatcgcctccggtcatcccgccgtgtgggcggacatctgccttgccaacaaagacagcctgctgcaactggttcaaggcttgggcaaacagttggacgttttggcaaacatcctgaccaccgacgaccgcgaagccctgtaccgctattttgaagaagccaaaaccacacgcgaccgctggctggacggcaactga

SEQ ID NO: 4497 - DNA, 813 bp, Neisseria meningitidis
atggacaaaatcagagttgccgccgtgcagatggtgtcgggcgtgtcgccggaaaccaacgtcgccgccatgaaacgcctggtcgcacgggcggcggagcagggtgcggattgggtgctgctgcccgaatattgggtgctgatgggcgcaaacgataccgacaaactcgcgcttgccgagcctttgggcggcggacgctttcagacggcattgagcgaaacggcgaaagaatgcggcgtggtgctgttcggcgggactgtgccgctgcaaagctgcgaggcgggtaaagtgatgaatacgctgttggtgtacggacgggacggcgtaaggacggggctgtaccacaaaatgcacctcttcggtttttccggtttgggcgaacgctatgccgaagccgataccatccgcgcgggcggggatgtgccgcacttgtcggcagaaggcgtgccggtggcggcgggcatttgttacgatgtccgctttcccgaatttttccgacgccagttgccgtttgacgtattgatgctgcccgctgcgtttacgcacacgacgggcaaggcgcattgggagctgctgctgcgcgcgcgtgccgtcgaaaaccaatgttacgtcgtggcggcggcacagggcggtttgcacgaaaacggacggcgcacgttcggacacagcatgattgtcgatccgtggggcgacgtgttggacgtattgcccgagggcgaaggcgttgttacggcagacatcgatgccaaccgcctgaacagcgtccgcaaccgcctgcccgccttgaaataccgggttttggatgccgtctga

SEQ ID NO: 4498 - DNA, 797 bp, Neisseria meningitidis
atgaatccagcccccaaaaaaccttctcttctcttctcttctcttctcttctcttctcttctcttctcttctcttccgcagcgcaggcggcaagtgaagacggcagccgcagcccgtattatgtgcaggcggatttagcttatgccgccgaacgcattacccacgattatccgcaagcaaccggtgcaaacaacacaagcacggtaagcgattatttcagaaacatccgtgcgcattccatccacccccgggtgtcggtcggctatgatttcggcggctggagaatagcggcagattatgccagttacagaaaatggaaagaaagtaattcttctactaaaaaagttactgaagagataaacaacaactacaaagaaacccaaacaaaacatcagggaaacggcagcttccacgccgtttcttctctcggcttgtccgccatttacgatttcaaactcaacgataaattcaaaccctatatcggcgcgcgcgtcgcctacggacacgttaaacatcaagttcattcggtggaaacaaaaaccacgactattacctctaaaccaaagaacggctctccacagggaggccctattatacaaactgatcccagcaaacctccctatcacgaaagccacagcatcagcagcgtgggtcttggtgtcatcgccggtgtcggtttcgacatcacgcccaagctgaccttggacaccggataccgttaccacaactggggacgcttggaaaacacccgcttcaaaacccacgaagtctcattgggcatgcgctaccgcttctga

SEQ ID NO: 4499 - DNA, 966 bp, Neisseria meningitidis
atgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacccccttatccgccgcaaactcagtcccgaacaagtatgcgcctacctgcgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgtccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 4500 - DNA, 855 bp, Neisseria meningitidis; identical to SEQ ID NO: 243

SEQ ID NO: 4501 - DNA, 1233 bp, Neisseria meningitidis
atgccttctgcccattatcctgaaatgagcgaaaaactgatggcggttttgatggcgatgctggttacgctgatgccgttttccatcgatgcctacctgcccgcgattcccgaaatggcgcaatcgctgaacgcggatgttcaccgcatcgaacagagtttgagtttgtttatgttcggcacggcgttcggacaggtggtcggcggttcggtgtccgacatcaaagggcgcaaacccgtcgccctgaccggtttgattgtatattgccttgccgttgccgccatcgtatttgtttcgagtgccgaacagctcctcaacctgcgcgtcgtgcaggcattcggtgcgggcatgactgtggtcatcgtcggcgcaatggtgcgcgattattattccggacgcaaagccgcccagatgtttgcccttatcggcatcattttgatggttgtgccgctggtcgcacccatggtcggcgcattgttgcagggcttgggtggctggcaggcgatttttgtttttctggcggcgtattcgctggtgctgctcggtttggtacagtatttcctgcccaagcccgccgtcggcggcaaaatcggacgggacgtgttcgggctggtggcggggcggttcaagcgcgtattgaaaacccgtgctgcgatgggttatctgttttttcaggcattcagcttcggttcgatgttcgcctttctgaccgaatcttccttcgtgtaccagcagctctaccgtgttacgcctcatcaatacgcttgggcgtttgcactcaacatcatcacgatgatgtttttcaaccgcgttaccgcgtggcggctcaaaaccggcgtgcatccgcaaagcatcctgctgtgggggattgtcgtccagtttgccgccaacctgtcccaactcgccgccgtgctgtttttcgggttgcccccgttttggctgctggtcgcgtgcgtgatgttttccgtcggtacgcagggcttggtcggtgcaaacacgcaggcgtgttttatgtcctatttcaaagaagagggcggcagcgcaaacgccgtattgggtgtattccaatctttaatcggcgcgggggtgggtatggcggcgaccttcttgcacgacggttcggcaaccgtgatggcggcaacgatgaccgcgtccacctcttgcggcattgcgcttctgtggctctgctcgcatcgtgcgtggaaagaaaacgggcaaagcgaatacctttaa

SEQ ID NO: 4502 - DNA, 1089 bp, Neisseria meningitidis
atgtcccaaactatcgacgaactcctccttccccaccgcaacgccatcgacaccatcgatgccgaaatcctgcgcctgctcaacgaacgtgcgcaacacgcccacgccatcggcgagctgaaaggcacgggcgcagtgtaccgccccgaacgcgaagtcgccgtgttgcgccgcattcaggatttgaacaaaggcccgctgcccgacgaatcggtagcacgcctgtttcgggaagtgatgagcgagtgcctcgccgtcgaacgcccgctgaccatcgcctatctggggccgcagggcacgtttacccagcaggcggcaatcaaacatttcggacacgccgcgcacaccatggcgtgtccgaccatagacgactgcttcaagcaggttgaaacgcgtcaggcggattatctggtcgcccccgtggaaaattcgaccgaaggctcggtcggtcgcacgttagacctgcttgccgttaccgcgttgcaggcgtgcggcgaaatcgttttgcgcatccaccacaaccttttgcgtaaaaacaacggcagcaccgaaggcattgccaaagtcttttcccacgcgcaggcgttggcgcagtgcaacgactggttgggcagacacctgcccaacgccgaacggattgccgtgtccagcaatgccgaagccgcaaggctggttgccgaatcggacgacggtacggttgccgccatcgccggacgcacggcggcggaaatctacggactcgatatggttgccgagtgcatcgaagacgaaccgaacaacaccacgcgcttcttggtgatgggacatcacgaaaccggtgcaagcggcagcgacaagacttcgctggccgtttccgcgcccaaccgggcaggcgcggttgcctcgctgctgcaaccgctgaccgaatcgggtatttccatgaccaagtttgagagccgtccgagcaaatccgttttgtgggaatacctgttcttcatcgacatcgaaggacaccgccgggacgcgcagattcagacggcattggaacgcttgggcgaacgcgcttcgttcgtcaaagtcatcggttcgtacccgaccgccgttttgtag

SEQ ID NO: 4503 - DNA, 792 bp, Neisseria meningitidis
atgtccgaataccgagtcaaccatgaacccgtttttatgctggcatcttcgccctggcgcgaaagcagcctgtgggttgaagcattcagccgccgttacgggcgtgtggctttgctggcgcgcagcgcgcgcaaaaggcagagcgagctgcgcggcgtattggtgccgttcgtgcccgtcagcgtgtcgtggtacggcagtcaggaactcaaaaccctacaccgcgccgaatgggtcggcggttggcggcagcctcagggcagggcgttgttcggcggattgtatgtgaacgagttggtgttgaaactgaccgcccgcgaagacccggtgcccgagttatacgacgcgttggcggaagtgatggaggcggtgtgctgcaaagccgcttatatcgacgacttgcgccgtttcgagtggcggctgctgaacctgttgggcgttgcccccgatttgaaccgcgacggggacggcgggacgattgcggcaggcggcacataccttgtccgcccggaaacagccgtcttccccgtcggaaaaggatttgccgtaccgccgcacgccgccggcgttgtcgcccccgggcagagcctgatcgatttgcgcgaaggcagtttccgcactgccgaaagcctgcaacaggcattgaaaatcacacggctttttatccgccacctgttgcccgaggggctgaaatcgcggcaggtgttggaacagatacggcagtttgaccgcaaagaaaccgcccgggaaaccgtcccgacttcggacggcacggcttcaaatgccgtctga

SEQ ID NO: 4504 - DNA, 729 bp, Neisseria meningitidis
atgcttttaggtgtcaacatcgaccacatcgccaccgtccgcaatgcgcgcggtacgacttatcccagccccgtggaggcggcactggttgccgaaacgcacggtgcggatttgattaccatgcacctgcgcgaagaccgccgccacatcaaagacgcggacgtgtttgccgtcaaaaacgccatccgcacgcgcctgaaccttgaaatggcgttgacggaagaaatgttggaaaacgctttgaaagtgatgccggaagacgtgtgcatcgtgcctgaaaaacgtcaggaaatcacgaccgaaggcggtttggacgtattggcgcaacaggaaaaaatcgccgggttcaccaaaatcctgaccgacgcaggcatacgcgtgtctttgtttatcgatgccgacgacaggcaaatccaagccgcccgtgatgtcggcgcgcccgttgtcgagctgcacacaggcgcgtatgccgacgcgcgcagccacgccgaacaaatcaggcagttcgagcgcatccaaaacggcgcgcatttcgccggcgatttgggcttggtcgtcaacgccggacacggactgaccatacacaacgttacccccatcgcccaaatcctcgccatccgcgaactgaacatcgggcattcgctgattgcccaagccctcttcctcggactgcccgaagccgtgcgccaaatgaaggaggcgatgttcagggcaaggctgctgccgtaa

SEQ ID NO: 4505 - DNA, 225 bp, Neisseria meningitidis
atgaatcaaaagtatattttatctgcaaacaataatagtttgatagaagaaattcacaatacagtacagagtattgggtattgtattgttcgaggtcttaatctaaaccatcttgatggcagccggagaaacaagaaattatttgactttctatctcaattaggaatgctgacaaaccacaaaggcgatggttttaaatctatattttgggatattaaatattga

SEQ ID NO: 4506 - DNA, 447 bp, Neisseria meningitidis
atgtatgtagtaaaatcagccaatgatggaggtaattccctatttttaagttcatcagatattgtcaatcagttatctaaaacagaaaccggtaaaaaacacttaaaaacattaacgggcaatttatatccatttaaaacaccagcatcatttgataaaaaacaaggtgtgagatggggtaatatcttatcggtcaatactcaaatgattagatttagaagtgattgtatctataaaggtattgaagaaaatagaaataaagtatcaaaggaaatggtacttgcacttgattatcttataaatgttataaaaaatgcgagtgatattcaagaattttctgcacaagatgatggtttgattattattgacaatgtcaatggcttgcatgccagaactgattatacggataaaaacaggcattatattagagcaagaattactgtataa

SEQ ID NO: 4507 - DNA, 768 bp, Neisseria meningitidis; identical to SEQ ID NO: 967

SEQ ID NO: 4508 - DNA, 378 bp, Neisseria meningitidis
atgatttacggcatcggcacagacattgtttccctcaagcgcatcatccgcttaaacaaaaaattcggacaggcgtttgccgggcgcatcctcactccggaagagctgcttgaatttccgcaagcgggcaaacccgtcaactacctcgccaaacgctttgccgccaaagaagcctttgccaaagccgtcggcacgggcatacgcggcgcggtttccttccgcaacatcggcatcgggcatgacgcattgggcaagcccgaatttttctacggccccgccctgtccaaatggctggaggaacaaggcatcagccgcgtcagcctcagcatgagcgacgaagaagacaccgtattggcgtttgtcgttgccgaaaaataa

SEQ ID NO: 4509 - DNA, 810 bp, Neisseria meningitidis
atgattcaagacacccgaccccttatccgcgtcgttgccggcatcctgctcgattcagacggcaactacctgctcagctcgcgccccgaaggcaaaccctatgccggatattgggaatttgccggcggcaaggtcgaagcgggcgaaaccgacttccaagccctgcaacgcgagtttgaagaagaactcggcatccgcatcctcgccgccacgccttggttgaccaaaatccattcctacgaacacgcccgcgtctgcctgaaattcctatgggtcaaccccgaccaatggacgggcaaaccgcaatcccgcgaagggcaggaatggtcttggcagaaggcgggtgattttaccgttgcccccatgctgcccgccaacggcgcgcttttgcgttcgctgtccgtcccgcgccgtttgtacggcagcctgaaaacgggtttgcacggagaaaacagtatgggcgcgtaccgcgtcctgcctttgggttcggcagagggaagcggtgcgaacgttttgatggaggcggcgcaatggcaggacagacccgaacacgccgacagcgtgtggatggtggtgcagacccgcgaacaatggcggcgggcgcaggaaaagggcgcggatgcggtcgtttggcgcgtgtgcgatgatgttcaggcacaagaggcggcagaagccctgcggcagggcgtatccgtgccgctcgtacttgcagcaaacggacagacggttgcacgttatggaaaactatggctcggattgggggcgcacgtggtggtaagggatgaaacaatagggaagaatcatgaataa

SEQ ID NO: 4510 - DNA, 423 bp, Neisseria meningitidis
atgaataaaaaccgtaaattactgcttgccgcactgctgctgattgcctttgccgccgtcaagctcgttttgttgcaatggtggcaggcgcagcagccgcaagctgtggcggcgcaatgcgatttgaccgagggttgcacgctgccggacggaagccgcgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagtacgcatccgcctgcccatctgtgtcgaaggcaggcgcgattttacggcggacattacaatcggcagtcggacatttcagacggcatttaccgccgaataa

SEQ ID NO: 4511 - DNA, 1143 bp, Neisseria meningitidis
atgaatactttatatacacttttcgccacctgcccgcgcggcttggagaccgttttatctcaagaactcgaaagcctcggctgtaccgatgtacaagtgtttgacggcggcgtttcctgccggggcggattggaacaggtttacgccgccaacctgcattcgcgtactgccagccgtatcctgctgcgcctgaccaaagggacataccgcaatgagcgcgacatctacaaactcgccaaaaatatcaactggtttaattggtttactttacagcagacgttcaaagtcaaagtcgaggcaaagcgtgccaacgttaagagcatccaatttgtcggactgaccgtcaaagatgccgtctgcgacgctttccgcgacatttacgacgcacgtccgagcgtggacaaagccgcgcccgatgtccgcatccacgcctttttgaacgaacgcaatgtcgaaatctttattgacacttcgggcgaagccctgttcaaacgcggctaccgcctggataccggcgaagccccgctgcgcgaaaaccttgccgccggactgctgctctcggcaggctacgacggcacgcagccgtttcaagacccgttttgcggcagcggcacgattgctatcgaagccgcttggattgccgcccgccgcgcgccgggtatgatgcgccgtttcggttttgaaaaactgcaaaatttcgataaaacgctgtggtcggatttgcggcgccgcgccgaagcgcaaacccgccccgtccgcgccccgattgcaggcagcgacaacgaccgccgcatcgttcagacggcattggacaacgcacgccgcgccggggtggacgacatcgtttccttcagcgttgccgacgcgcagtccgtccgaccgaacggcgaaaacggcattatggtgtccaatccgccctacggcgtgcgccttgaggaagtccgcgccttgcaggcactgtatccgcagttggggacgtggttgaaaaaacattacgcaggctggttggcggcaatgtttaccggcgatagggaaatgcccaaattcatgtgcctgtcgcccaagcggaaaatcccgctttataacggcaacatcgactgccgcctgttcctgattgatatggtggaaggatcgaaccgttga

SEQ ID NO: 4512 - DNA, 1251 bp, Neisseria meningitidis
atgatcaaactgacacgaagacaaatcatccgccgcaccgccggcacactgttcgccctaagccccatcgcatccgccgttgccaaaacggtacgcgccccgcaattcaccgccgcacggatatggccgtcgcacacctacacccgcctgacgctggaaagcaccgccgcgctcaaataccagcacttcacgctcgacaacccgggcaggctggtcgtcgacatacaaaacgcgaacatcaataccgtattgcacggactgtctcagaaagtcatggcagacgacccctttatccgcagcatacgcgcgggtcagaacacgccgaccaccgtccgcctcgtcatcgatttgaaacagcccacccacgcacaagtcttcgcgcttccgcccgtcggcggctttaagaaccgcctcgtcgtcgacctctatccgcacgggatggatgccgacgatccgatgatggcactgctcaacggtagcctgaataaaaccctgcgcggctctcccgaagccgacctcgcccaaaacaccacgccccaacccgggcgcggcagaaacgggcgcagacccgtcatcatgctcgatccgggacacggcggtgaagaccccggcgccatcagcccgggcggtctacaggaaaaacatgtcgtcctatccattgccagggaaaccaaaaatcagttggaagcattaggttacaatgtatttatgacgcgcaacgaagacgtgttcatcccattgggcgtgcgtgtcgccaaagggcgagcacggcgggcggacgtatttgtctccatccacgccgatgccttcaccagcccctccgcgcgcggcacgggggtttatatgttaaacaccaaaggcgcaaccagctctgccgccaaattcttggaacagacgcaaaacaatgccgacgcggtcggcggcgtaccgaccagcggcaaccgcaatgtcgataccgccctgctcgacatgacccaaaccgccacgctgcgcgacagccgcaaactcggcaaactggtgcttgaagaattgggcaggctcaaccatctgcacaaaggcagggtggacgaagccaatttcgccgttttgcgcgcacccgatatgccgtctatcctggtcgaaaccgccttcctgtccaatcctgccgaagagaagctgctgggcagcgaatccttccgccggcagtgcgcccaatccattgcctcgggtgtccaacgctacatcaatacatccgtattgaagcggggttga

SEQ ID NO: 4513 - DNA, 462 bp, Neisseria meningitidis
atgtctgatttaccctctatctcccgattccttgccgacgaagccgccacactcgatttgggcgcggcgtggtcttcccgtttaaacgcaccgctggtcatttatctcgaaggggatttgggtgcgggcaaaaccacgctgacacgcggcatcctgcgcggattgggtcatcagggcgcagtcaaaagtccgacctacgccatcgtcgaatcttatccgctggaacgcttcaccctgcaccatttcgacctctaccgcttctcgttccccgaagaatgggaagacgcggggcttgacgaactgtttgccgcaaacagcgtctgcctgatcgaatggccgcaacagggcggggaatttacgccgcccgccgacatcaccgcaacattgacacacgacggcgacggcagaaaatgcctgctgaccgcccataccgaacgaggacgcgaaagcctgccgctatga

SEQ ID NO: 4514 - DNA, 813 bp, Neisseria meningitidis
atggaaaatatcggcaggcagcgacccatcggcgtttttgactcgggaatcggcggtttgaccaatgtgcgagcgctgatggaacggctgccgatggagaacatcatttatttcggcgacacggcgcgcgtgccttacgggacgaaatctaaggcgaccatcgaaaatttctcgatgcagattgtcgattttttattggaacacgatgtcaaggcgatggttatcgcgtgcaatacgattgcggcggtggcggggcagaaaatccgtcaaaaaaccggcaatatgcccgttttggacgtgatttccgccggcgcgaaagccgcgctggcaacgacgcgcaacaataaaatcggcattatcgccaccaatacgacagtcaacagcaatgcttatgcgcgcgccatccataggaacaaccccgacacgctcgtccgcacgcaggccgcgccgctgctcgtccctttggtggaagagggctggctggaacacgaagttacccgcctgaccgtatgcgaatacctcaaaccattgcttgcagacggcatcgatacgctggtgttgggctgcacgcactttcccttgctcaagcccttaatcggcagggaggcgggcaatgtcgcgttggttgattctgcaattacaacggccgaagaaaccgcacgcgtccttgctcaggaaggattgctcaataccgacaacaacaatcccgactaccgtttttacgtcagcgatattcctttgaaattcagaaccatcggcgagcgttttctgggcaggacgatggagcagattgaaatggtgtctttgggttaa

SEQ ID NO: 4515 - DNA, 1110 bp, Neisseria meningitidis
atgagcaactggaaacccaatattccctataacgatttaccacccctgccgccaaaacaggatattgaaagcaaaaccatcctgaaacgttgtatagccgcccgtgcatcccttgcccgtttaaagcaggcggcagaattgataccgaatcaagccatgctgattaacacccttcctgttatggaagcccgtgcaagttcggaaattgaaaacatcgtaaccaccacggacaagctgtttcaatccctgcaaatggatacggaacggcaagaccctgccacgaaagaagccctgcaataccgcaccgccctgtttgcaggctatgaatcactgacgagccgccctttatgcacacaaaccgccatcatggtctgcaacgccatcaagcacccctacgaaatggccatccgcaaaacaggcggcacagccctaaaaggaggcaacagcggaaatgttgtctataccccgcccgaaggagaagaaaccatacgcggcaagctggcaaattgggagcggtttattcacgaaagcggcgatttagacccgcttatcatcatggcggcggcacattaccaatttgaagccatccatccgtttacggacggcaacgggcggacggggcgcatattgaacagcctgctattgattgaaaaagggcttttggatttgcctattttgtatttgagccgctacatcatcgaaaacagggcggactattaccgcctgcttttaggcgtaaccgaacggcaggactgggaaagctggataatctacatcttagacggcgtagctgacaccgccgattggacggtatcgaaaatagatgcgatacgccgcctgttcgagcagacacggcaacacatacggacacacgcacaaggaatctacacgcacgaactggtaaatcttctgtttgagcagccatatacacgcattgccaacctagaagcggcagggatagccaaacggcagacggcctctaagtacctgaaagagctttcagacataggtgtgctgcaagaaatcgtcatcggcagggacaaactattcattcatccgcgcctaatggaactattgcggggagagggcaacagctttacttcattctaa

SEQ ID NO: 4516 - DNA, 2139 bp, Neisseria meningitidis
atgaacaatccattggtgaatcaggctgctatggtgctgcctgtgtttttgttgagtgcttgtttgggcggaggcggcagtttcgatcttgattctgtcgataccgaagccccgcgtcccgcgccaaaatatcaagatgttttttccgaaaaaccgcaagcccaaaaagaccaaggcggatacggttttgcaatgaggttgaaacggaggaattggtatccgcaggcaaaagaagacgaggttaaactggacgagagtgattgggaggcgacaggattgccggacgaacctaaggaactccctaaacggcaaaaatcggttatcgaaaaagtagaaacagacagcgacaacaatatttattcttccccctatctcaaaccatcaaaccatcaaaacggcaacactggcaacggtataaaccaacctaaaaatcaggcaaaagattacgaaaattttaaatatgtttattccggctggttttacaaacacgccaaacgagagtttaacttaaaggtggaacctaaaagtgcaaaaaacggcgacgacggttatatcttctatcacggtaaagaaccttcccgacaacttcccgcttctggaaaaattacctataaaggtgtgtggcattttgcgaccgatacaaaaaagggtcaaaaatttcgtgaaattatccaaccttcaaaaagtcaaggcgacaggtatagcggattttcgggcgatgacggcgaagaatattccaacaaaaacaaatccacgctgacagatggtcaagagggttatggttttacctcaaatttagaagtggatttccataataaaaaattgacgggcaaactgatacgcaacaatgcgaataccgataacaaccaagccaccaccacgcaatactacagccttgaggctcaagtaacaggcaaccgcttcaacggcaaggcaacggcaaccgacaaaccccaacaaaacagcgaaaccaaggaacatccctttgtttccgattcgtcttctttgagcggcggctttttcggcccgcagggtgaggaattgggtttccgctttttgagcgacgatcaaaaagttgccgttgtcggcagcgcgaaaaccaaagacaaacccgcaaatggcaatactgcggcggcttcaggcggcacagatgcggcagcatcaaacggtgcggcaggcacgtcgtctgaaaacggtaagctgaccacggttttggatgcggtcgagctgaaattgggcgataaggaagtccaaaagctcgacaacttcagcaacgccgcccaactggttgtcgacggcattatgattccgctcttgcccgaggcttccgaaagtgggaacaatcaagccaatcaaggtacaaatggcggaacagcctttacccgcaaatttgaccacacgccggaaagtgataaaaaagacgcccaagcaggtacgcagacgaatggggcgcaaaccgcttcaaatacggcaggtgataccaatggcaaaacaaaaacctatgaagtcgaagtctgctgttccaacctcaattatctgaaatacggaatgttgacgcgcaaaaacagcaagtccgcgatgcaggcaggagaaagcagtagtcaagctgatgctaaaacggaacaagttgaacaaagtatgttcctccaaggcgagcgcaccgatgaaaaagagattccaagcgagcaaaacatcgtttatcgggggtcttggtacggatatattgccaacgacaaaagcacaagctggagcggcaatgcttccaatgcaacgagtggcaacagggcggaatttactgtgaattttgccgataaaaaaattactggtacgttaaccgctgacaacaggcaggaggcaacctttaccattgatggtaatattaaggacaacggctttgaaggtacggcgaaaactgctgagtcaggttttgatctcgatcaaagcaataccacccgcacgcctaaggcatatatcacagatgccaaggtgcagggcggtttttacgggcccaaagccgaagagttgggcggatggtttgcctatccgggcgataaacaaacgaaaaatgcaacaaatgcatccggcaatagcagtgcaactgtcgtattcggtgcgaaacgccaacagcctgtgcgataa

SEQ ID NO: 4517 - DNA, 2748 bp, Neisseria meningitidis
atgcaacagcaacatttgttccgattcaatattttatgcctgtctttaatgactgcgctgcccgcttatgcagaaaatgtgcaagccggacaagcacaggaaaaacagttggataccatacaggtaaaagccaaaaaacagaaaacccgccgcgataacgaagtaaccgggctgggcaagttggtcaagtcttccgatacgctaagtaaagaacaggttttgaatatccgagacctgacccgttatgatccgggtattgccgtggtcgaacagggtcggggcgcaagttccggctattcaatacgcggcatggataaaaaccgcgtttccttaacggtggacggcgtttcgcaaatacagtcctacaccgcgcaggcggcattgggcgggacgaggacggcgggcagcagcggcgcaatcaatgaaatcgagtatgaaaacgtcaaagctgtcgaaatcagcaaaggctcaaactcggtcgaacaaggcagcggcgcattggcgggctcggtcgcatttcaaaccaaaaccgccgacgatgttatcggggaaggcaggcagtggggcattcagagtaaaaccgcctattccggcaaaaaccgggggcttacccaatccatcgcgctggcggggcgcatcggcggtgcggaggctttgctgatccacaccgggcggcgcgcgggggaaatccgcgcccacgaagatgcaggacgcggcgttcagagctttaacaggctggtgccggttgaagacagcagcaattacgcctatttcatcgttaaagaagaatgcaaaaacgggagttatgaaacgtgtaaagcgaatccgaaaaaagatgttgtcggcaaagacgaacgtcaaacggtttccacccgagactacacgggtcccaaccgcttcctcgccgatccgctttcatacgaaagccggtcgtggctgttccgcccgggttttcgttttgagaataagcggcactacatcggcggcatactcgaacacacgcaacaaactttcgacacgcgcgatatgacggttccggcattcctgaccaaggcggtttttgatgcaaataaaaaacaggcgggttctttgcccggtaacggcaaatacgcgggcaaccacaaatacggcggactgtttaccaacggcgaaaacggtgcgctggtgggcgcggaatacggtacgggcgtgttttacgacgagacgcacaccaaaagccgctacggtttggaatatgtctataccaatgccgataaagacacttgggcggattatgcccgcctctcttacgaccggcagggcatcggtttggataatcattttcagcagacgcactgttctgccgacggttcggacaaatattgccgcccgagtgccgacaagccgttttcctattacaaatccgatcgcgtgatttacggggaaagccacaggctcttgcaggcggcattcaaaaaatccttcgataccgccaaaatccgccacaacctgagcgtgaatctcgggtttgaccgctttggctctaatctccgccatcaggattattattatcaacatgccaaccgcgcctattcgtcgaacacgccccctcaaaacaacggcaaaaaaatcagccccaacggcagtgaaaccagcccctattgggtcaccataggcaggggaaatgtcgttacggggcaaatctgccgcttgggcaacaatacttatacggactgcacgccgcgcagcatcaacggtaaaagctattacgcggcagttcgggacaatgtccgtttgggcaggtgggcggatgtcggcgcgggcttgcgctacgactaccgcagcacgcattcggacgacggcagcgtttccaccggcacgcaccgcaccttgtcctggaacgccggcatcgtcctcaaacctaccgactggctggatttgacttaccgcacctcaaccggcttccgcctgccctcgtttgcggaaatgtacggctggcgggcgggtgttcaaagcaaggcggtcaaaatcgatccggaaaaatcgttcaacaaagaagccggcatcgtgtttaaaggcgatttcggcaacttggaggcaagttggttcaacaatgcctaccgcgatttgattgtccggggttatgaagcgcaaattaaagacggcaaagaagaagccaaaggcgacccggcttacctcaatgcccaaagcgcgcggattaccggcatcaatattttgggcaaaatcgattggaacggcgtatgggataaattgcccgaaggttggtattctacatttgcctataatcgtgtccgtgtccgcgacatcaaaaaacgcgcagaccgcaccgatattcaatcacatctgtttgatgccatccaaccctcgcgctatgtcgtcggcttgggctatgaccaaccggaaggcaaatggggtgtgaacggtatgctgacttattccaaagccaaggaaatcacagagttgttgggcagccgggctttgctcaacggcaacagccgcaatacaaaagccaccgcgcgccgtacccgcccttggtatattgtggacgtgtccggttattacacggttaaaaaacactttaccctccgtgcgggcgtgtacaacctcctcaactaccgctatgttacttgggaaaatgtgcggcaaactgccggcggcgcagtcaaccaacacaaaaatgtcggcgtttacaaccgatatgccgcccccggtcgcaactacacatttagcttggaaatgaagttctaa

SEQ ID NO: 4518 - DNA, 1380 bp, Neisseria meningitidis
atgcaagccttttctctctatccgcccgtcggacaccctgacagcgcaaaaaaacggcaaaatcgggcggacgtttttctccccttttggaaacaggataattttttaggaaaatcagtccaatatcgctttgagtttgcacaaatttactttacaatgcccaaaccttgcgccggggtaacgatggggcgcggggatttctttttttccaacctctttcatcaggaatctgcccgtatgaaaaaatccgtattagccgttttggccgcgctgtctctggcagcctgcggcggcagcgaaaaaaacgccgtgcaacctcaagcagacgctgcgtctgctgccaatgccgaagccgctgccaccgatactctgaacatctacaactggtcgaactatgttgatgagagtacggtcgaagactttaaaaaagccaacaatctgaagctgacttacgacttgtacgaaaacaatgaaacgctggaagccaaaatgctgaccggcaaatccggttacgatttggtcgtgccgggcatcgccttcctgccgcgccaaatcgaggcgggcgcgtatcaaaaagtcaacaaagacctgattcccaactataaaaacatcgatcccgaactcttgaaaatgctggaaaccgccgacccgggcaaccagtatgccgtcccctatttctccggcgtgaacacgattgcgattacggcgaagggcaaagagcttttgggcggcaagctgcccgaaaacggctgggatttgctgttcaaacccgaatacacccacaagctgaaatcctgcggcatcgccctgtgggacaccccgagtgaaatgttcccgattttgctgaactacttgggcaaagaccccaaaggctcgaatcctgaagacttgaaggcggcggcggaagtgttgaagtctatccgtccggatgtcaaacgtttcagcccgtccatcatcgacgagctggcacgcggcgacatctgcctggcggcaggcaacggcggcgatttgaacttggcgaaagcacgttccgaggaagtgaaaaacaacgtcggcatcgaagtgctgacaccgaaaggtatgggcttctggattgagtcttggctgattcccgccgatgcgaaaaacgtcgccaatgcccacaaatacatcaactacacgctcgaccccgaaatcgcggcgaaaaacggcatcgccgtaacctttgcccccgccagcaaaccggcgcgcgaaaaaatgcctgccgagctggtgaacacccgttccatcttcccgaacgagcaggatatgaaagacggtttcgtgatgccgcaaatgagcacggatgcgaaaaaactgtctgtcagcctgtggcagaaaatcaaagtcggcaccaactga

SEQ ID NO: 4519 - DNA, 264 bp, Neisseria meningitidis
atggcaaacagcgcacaagcacgcaaacgtgcccgccagtccgtcaaacaacgcgcccacaatgctagcctgcgtaccgcattccgcaccgcagtgaaaaaagtattgaaagcagtcgaagcaggcgataaagctgccgcacaagcggtttaccaagagtccgtcaaagtcatcgaccgcatcgccgacaagggcgtgttccacaaaaacaaagcggcacgccacaaaagccgtctgtctgcaaaagtaaaagccttggcttga

SEQ ID NO: 4520 - DNA, 1149 bp, Neisseria meningitidis
atgccgacaatgggggcggagatgaatacacggaatatgcgctatattcttttgacaggactgttgccgatggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcctggataagggcgaggcggtcattgttgttgaaaaaggcggggatgcgcttcctgccgacagtgcgggcgaaaccgccgacatctatacgcctttgagcctgatgtacgacttggacaaaaacgatttgcgcgggctgttgggcgtacgcgaacacaatccgatgtaccttatgccgctctggtacaacaattcgcccaactatgccccgggttcgccgacgcgcggtacgactgtacaggaaaaattcggacagcagaaacgtgcggaaaccaaattgcaggtttcgttcaaaagcaaaattgccgaagatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttacgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaaccccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgacttggacggcatctga

SEQ ID NO: 4521 - DNA, 702 bp, Neisseria meningitidis
atgacggaacctgcggccgaaggcggcaaagctgccaaggcgttaaaaaaatatctgattacgggcattttggtctggctgccgattgcggtaacggtttgggtggtttcctatatcgtttccgcgtccgatcagctcgtcaacctgctgccgaagcaatggcggccgcaatatgttttggggtttaatatcccggggctgggcgttatcgttgccattgccgtattgtttgtaaccggattgtttgccgccaacgtattgggtcggcagatcctcgccgcgtgggacagcctgttggggcggattccggttgtgaaatccatctattcgagtgtgaaaaaagtatccgaatcgctgctgtccgacagcagccgttcgtttaaaacgccggtactcgtgccgtttccccagcccggtatttggacgattgctttcgtgtcagggcaggtgtcgaatgcggttaaggccgcattgccgaaggacggcgattatctttccgtgtatgttccgaccacgccgaatccgaccggcggttactatattatggtaaagaaaagcgatgtgcgcgaactcgatatgagcgtggacgaagcattgaaatatgtgatttcgctgggtatggtcatccctgacgacctgcccgtcaaaacattggcaggacctatgccgtctgaaaaggcggatttgcccgaacaacaataa

SEQ ID NO: 4522 - DNA, 1809 bp, Neisseria meningitidis
atgcgtaccaactattgcggcctgatcagtgagcaatacttagaccaaaccgttaccgtcaaaggctgggtacaccgtcgacgcgaccacggcggtgtgatttttatcgacctgcgcgaccgcgaaggcatcgtccaagtcgtgatcgatcccgacacgcccgaagcgtttgccgctgccgattcctcccgcaacgaatacgttttgagcattaccggccgcgtacgcaaccgtcccgaaggcacgaccaacgataaaatgatttccggcaaaatcgaaatccttgccaaagaaatcgaagtcttgaacgccgccgccacgccgccgttccaaatcgacgatgaaaacatcagcgaaaacgttcgcctgaccaaccgcgttatcgacttgcgccgtccggtgatgcaacgcaacctgcgcctgcgttaccaagttgctatgggcgttcgccgctacttggacgcgcaaggtttcatcgacattgaaaccccgatgctgacccgctccacgcctgaaggcgcgcgcgactacctcgtgccgagccgcgttcatccgggcgagtttttcgcgctaccgcaatcgccgcaattattcaaacaactgttgatggtggcgggtttcgaccgttactaccaaatcaccaagtgcttccgcgacgaagacctgcgtgccgaccgccagcccgaatttacccaaatcgacttggaaacctcgttcttaaacgaggatgaaatcatggacatcactgaaggcatggccaaacaagtcttcaaagatgctttaaatgtagatttgggcgacttcccacgcatgccttactctgaagccatgttctactacggctctgacaaaccggatatgcgcatcaacttgaaatttaccgagttgaccgacctgatgaaaacggaagaattcaaagtcttccgtggcgcagccgacatgaaaggcggccgcgtggtcgctctgcgcgtgccgaacggcgcagaattcagccgcaaagaaatcgacgaatacaccaaatttgtcggcatctacggcgcgaaaggtctggcatacatcaaagtaaacgatgtcagcaacctttccaacggcgaagacagcggcctgcaatctccaatcgtgaaatacctgtccgaaaacgccctgaaagaaattatcgcgcgtaccggcgcgcaaaacggcgacatcatcttcttcggcgcagacaaagccaaagtcgtgaacgaagccatcggcgcactgcgtatcaaagtcggcttggagcacggcaaagacaacggctatttcacagacgaatggaaacctttgtgggtcgttgatttcccaatgttcgaatacgacgaagaagccgaccgctacgttgccgtacaccatccgtttaccgcgccaaaagaaggtcatgaagacctgatggtttccgacccggcaaattgtttggcacgcgcctacgatatggtattgaacggctgggaaatcggcggcggctctatccgtattcaccgcgcagacgtacaagagaaagtgtttgccgcgctgaaaatcagccctgaagagcaacaagagaaattcggcttcctcttggacaacctgaaattcggcgcacctcctcacggcggtcttgcattcggcctcgaccgtctggtaacgctgatgaccggtgccgaatccatccgcgacgtgattgccttcccgaaaacacaacgcgcccaatgcctgctgaccaacgcgcccaacagcgtggacgacaagcagttgcgtgaattaagtttgcgtttgcgccagaaggcaaccgaaactaaagaagtataa

SEQ ID NO: 4523 - DNA, 285 bp, Neisseria meningitidis; identical to SEQ ID NO: 3731

SEQ ID NO: 4524 - DNA, 1893 bp, Neisseria meningitidis
atgcctatccttaccatccgtgaagtgtgcaacattaatcattggggcataggttattatgatgttgacgattccggcgaaatcatcgtccgccccaatccctcgcaacacaatcaaactgtttcactgcaaaaactgactgaagccgtgcaacaaaaacatcaggcgcgcctgcctgttttgttttgttttccgcaaatcctcgaacaccgcctccgcgacattaaccgcgcctttcagacggcacgggaagagtgcggctataagggcggttattgtttggtttaccctatcaaggtcaaccaacaccgccgcgtcatcgaatcgcttatgtcaagcggacaaccgcatggtttggaagctggttctaaagccgaactgatggcggttttggcacacgccggcaaccggcaaacattaatcgtctgcaacggctataaagaccgtgaatatatccgtttcgccttgatgggcgaaaaactggggcatcaggtttatttggtgattgagaagctgtccgaaatacaaatggtattggaagaggcggaaaaactcggcatcaagccccgtttgggtgtgcgcgccagactggcttcccaaggttcgggaaaatggcagtcttcgggtggggaaaaatcaaaattcggcttgtcggcttcccaagttttgcaactggtcgatattttgaaacaaaaaaacaggctggattgcctgcagcttttgcatttccatttgggctcgcagcttgggaacatccgtgatgttgccacaggtgtacacgaatcggctcggttttatgttgagttgcacaaactgggggtaaatatccgctgttttgatgtaggcggcgggcttggcgtggattacgaaggaaaccgcacacaatcggattgttccgttaattacagcctcaacgaatatgccgccacagtcgtatggggcatcagtcaggcttgtctcgaacacgggctgccgcatccgacaatcatcaccgagagcgggcgcggcattaccgcacatcacgccgttttggttgctaatgttataggcgttgaacgttacaaaccgcgccggctggatgcgccatcgcccgaagcaccgcgtgtgttgcacagtatgtgggaaacttggacggatatttccgcctcgcgggaaaaacgttccttacgcagctggatacacgaagggcagtttgatcttgctgatgtgcataatcagtataatgtcgggctgttgagtttggcgcaacgtgcgtgggcggagcaactgtatttaaatatctgtcatgaagtcggcgaattgtttaatgaaaaacaccggtctcaccgaaccattattgacgaattgcaagaacgttttgccgataagctgtatgtcaatttctcactcttccaatctttgcccgatgcttggggcatagatcaacttttccctgtttgtcccattaccggtttgaatgaaccgattgcgcgccgcgccgtgttgttggacattacctgcgattcagacggtacgattgaccactacatcgacggagacggcatcgccggtacgatgcctatgcctgattatcccgaagaagagccgccgcttttaggcttttttatggtgggagcatatcaggaaatactcggcaatatgcacaatcttttcggcgacactgccactgccgatgttgttgtaggggaagacggacaatttaccgtcatcgattacgatgaaggaaacaccgttgccgatatgctcgaatacgtttatcaagatccgaaagagctgatgaaacgctatcgcgaacaaatcgaacattcagaccttcctgcctcgcaggctatgtctttcttaaaagaactcgaagcggggcttaatggttatacctatttggaagacgaatag

SEQ ID NO: 4525 - DNA, 924 bp, Neisseria meningitidis
atgcaatacagcacactggcaggacaaaccgacaactccctcgtttccaataatttcgggtttttgcgcctgccgcttaattttatgccgtatgaaagtcatgccgattgggttattaccggcgtgccttatgatatggcggtttcagggcgttccggcgcgcgtttcggtcctgaagccatccggcgcgcctccgtcaacctcgcttgggagcaccgcaggtttccatggacatttgatgtgcgcgaacgcctgaacattattgattgcggcgacttggttttttcttttggcgacagcagggattttgtcgaaaaaatggaagcgcacgccggcaaattactttcttccggcaaacgctgtttgagtttgggcggcgaccatttcattaccctaccgttgttgcgcgcccacgcccgctatttcggcaaactcgcactgattcattttgacgcgcacaccgacacctacgacaacggcagcgaatacgaccacggtacgatgttctataccgcccccaaggaaggcctcatcgacccgtcccgttccgtacaaatcggcatacgcaccgaacacagtaaaaaattgccttttactgtgttgtccgcccctaaagtcaatgaagacagtgttgaagagaccgtccgtaaaatcaaagaaaccgtcggcaatatgcccgtttacctgactttcgacatagactgcctggacccgtcgttcgcccctgggaccggtacgcccgtatgcggcggcttgagcagcgacagggcattaaaaatcctacgtgggctgacggatctcgacatcgtcggtatggatgttgtagaagttgccccctcttacgaccaatccgacattaccgctttggccggtgccacaattgccttggaaatgctttaccttcaaggtgcgaaaaaggactga

SEQ ID NO: 4526 - DNA, 1467 bp, Neisseria meningitidis
atgatgaaattgggtttcaaaccgatacccctcgccattgccgcagtattgtgcgccctggttttggcactgcccgtacccgacggggtcaagcctcaggcttggacgctgctggccatgtttgtcggtgtgattgccgccattatcggcaaggccatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaactatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgccgttcaatttgccaaagaccgtctgagggagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttttcgctgctgccgtttcactgaatgccccggcgatgccgaccgcgctgatgatggcggccgcatccaacattatgatgaccctcactcattatgcgaccggtacttcgcctgtgattttcggttcgggctacaccacaatgggagaatggtggaaggcgggttttatcatgagcgtagtcaattttctgatttttttcgttatcggcagcatttggtggaaagttctggggtattggtaa

SEQ ID NO: 4527 - DNA, 1077 bp, Neisseria meningitidis
atgatttgccgaaaacctatcggacacacaccatattttgatatgaataaaacaatctgccgcactgctgcactattgataagcggtttttcatacgcaaacaccatcattcccgatgtctcccccgtcgcacaaggtcaacatgtcttcattaacatccctcagcaacgcctgttcctctacaccgacggcaaactgaccaaggtttatcccgttgcagtaggtcgggcgatgacgcaaaccaatctaggcgaacataaaatcggtgcgaaagcctataaccctgtttggtacatccccaaatccatacagaaagaacgcggcgacggcgtaaaaaccatagccgccggcccggacaaccctttggggccggtttttgtccgcttaggcgaccccaaactcggtttgggcatacacgggaccaatgcgccggccagcgtccccggggttcggagtcacggctgcgtccgcatgaaatcgcccgacgcgctcgagtttgccaaaaccatcgccagcggctcgcccgcctccgtcatctatcaaatggcgggtctcaatgaagatgcggatcgcaacctgtggcttgccgccttccgcgacccttacggtaagaacaaccttgacatcgcctctctgaaaaaaagtattgcgcaatgggcaaaaacacagggtaaaaccatcgcgcccgagaaagtcgatgctgtactcaaagaccgcaccggatcggccgtctgcctgacctgcggcaaaaacggcaagatgaagatgccgctcaaatcgctggcgtggatacagggttcttcctcatacagccaagctgaagtcattgaacaaactgaggaaaccaactctgccgaaatatccgagacacgcacgcccgaagtgcctgatgtacacacgcccgaggcacaaccgcatttaaatacccaatccgacggcacgccgactgcctataccgaaccggctgccgattcatcgccgcaagtagaaacacctgatcaggctgcttccgagccggttgatgtattattttcaatagatgtgatacggcagggaaatttgcgtttaggtaattga

SEQ ID NO: 4528 - DNA, 1143 bp, Neisseria meningitidis
atgaaggtttttaaacaacagcttgaacaactcggcgcgcaaaaccaatatcgttcgattccggatttgattcatcaagggcggtatattacgcgggaaaaccgcaaaatgctgaatatgtcgtctaatgattatttgggtttggcatcagatgaaaacttgcgccggtcttttttgcagcaatacggcggtaattttccctcttttaccagttcttcatcgcgtttattaacgggcaactttcctatttataccgatttggaagagcttgtcgcacaacgtttccaacgggaaagcgcgttattgttcaacagcggctatcacgccaatctcggtattttgcctgctttgacgacgacgaaaagtttgattttggcagataaatttgttcacgccagtatgattgacggcatccgtttgagccggtgtgcgtttttccgttatcgtcataatgattatgaacatttgaaaaatctgcttgaaaaaaacgtcggaaaatttgaccgcacttttatcgttaccgaatctgttttcagtatggacggcgatgtggcggatttgaaacagcttgtccaattaaaaaaacagtttcccaatacttatctttatgtggatgaagcccacgcaatcggtgtttatgggcaaaacggattggggattgccgaacgggataatttgattgccgagattgatttattggttggcactttcggtaaagccttagcctcggtgggggcgtatgccgtctgcaaccaagtattgaaagaatgtttgattaatcaaatgcgcccattgattttttcaaccgcattgccgccgtttaatgtggcttggacttattttatttttgaacgattgccgcaattctcaaaagaaagaagccatcttgagcagttaagcgcatttttacggcgggaagtggcgcatcggacgcaaataatgccgagccaaacctgtatcgtcccctatattttaggcgggaatgaagccacccttgccaaagcggaatacctgcaaaggcagggttattattgcctgcccatcagaccgtcgacagtacccaaaaacacatccagaatccgcctgtctttaacggcagatatgacaacggatgaagtgcggcagtttgcggcgtgcctgtaa

SEQ ID NO: 4529 - DNA, 648 bp, Neisseria meningitidis
atggaaacaaaattttacaatcatcaaggcggacatttaatcctgtattttgcaggttggggaacgccgcccgatgctgtaaatcatttgattttgccggaaaatcacgatttattgatttgctatgattatcaagatttaaatttggattttgatttttccgcctatcggcacatccgtttggtggcgtggtcaatgggcgtttgggcggcagagagggcattgcaaggaataagattaaaatccgcaacggcagtgaatggcacaggtttgccttgcgatgataatttcggtatcccttgcaccgtttttaaaggcacattggagaacctcacggaaaacacccgtttaaaatttgaacgcagaatgtgtggcgataaagcatcttttgaagattaccaacaatttcccgcacgcccgtttggcgaaattcatcaagaacttatcgcactttttgcgatgatcgggcaagatagacgtacagatcttatccgctggacaaatgccttggtcggatcgggcgataaaatttttatgcctgccaatcagcaccgatattggacaccgcgttgcaccgttcgggaaattgacgtcggacattacctgttttcaagattcacccattggtcggcactatggaatcactga

SEQ ID NO: 4530 - DNA, 783 bp, Neisseria meningitidis
atggaatcactgactgccataaataaatcgcgcattcggcaggctttccaaaaagcattaaacgattatgaccggcacgccttaatccaacaaaaaatgacgattaatttaatgacgcatttgcaagattatttgccggatatgccattggaaaacgtgttggaattgggctgcggctcaggaatgttgagtgccttgctgcaaaaacagatttcagcgaattattggttatttaatgatttgtgcaatgtgcagccccaactggctgaaaaactgccgcaatcctttgatttttattgcggcgatgcggaaaactttccttttcaacgacaatttgacttaatcgcaagcgcatctgccgtgcaatggtttcatcaacccgacgcttttatcacccattgcaaaacaggcttgaaaacaaacggattattggcggttgcaacctttggcaaagacaatttaaaagaagtccgccaaattacaaatataggcttaaattacccgactttatcccaatggcaggcttggttagccaaagattttgagcttttatggtgtgaggattttacggtaatactagactttgatacgccgtcagatgtactcaaacaccttaaatatacaggcgtaacagccacgaaccaaaaaaattggacaagaaaaaatctcaatggatttattggcgattacttgtcggcgttcggtatgccgtcgggcaaagtgcgcctgacttatcatccgttattttttatcgcgcgctactctgcggcgggcaggcaataa

SEQ ID NO: 4531 - DNA, 1392 bp, Neisseria meningitidis
atgcttttggttatgcgtgcgaagcagggtaagaaaacaccgaagcgcaaatcccaaggtgtcggcaatacgcaggggcagacacccggaagcaatgattcggactgggtcgatcagattggacaatcggtttcagacggcacgcaacccgactggtcttggaacgaaagtgccgagaccgcatccgccgccgtatccgcgcaagaagtcgatccgcttacggagtatcaggtttataagcaattcggttatcagggcaaggctgccgaatctttggctgcctatctggacggcattccggatggtgaagcgaaacctgaaaaccttatccgcgagctgctcgatatcaatctcgaagtgggggatgtcgatgttttggcagacaatctgcaaaaatacggcaaactgattctttccgaacttttggcaaaatatatcgaacaggcattacagcgcgattcaaaccatttgcgtatccgcgtcttggcggaagaaggtttgggatggggtactcaggagattgaaaaacgtgcggaaggcggttctgcgacggcagcttccgcatcgcccccgccggatgccggcggtaaggcttatgaagccgaagaaatcaagcgcatcccgattgtgcggggcaaaaaagacgtgtccggaatcagtcaagaggaaatcggtgcgattgccggtttggtccgtgccgatcaaggtgcgaaaatccttaaagacaaagtcagctatgaaacggcatcgaaacaatacgaccgtgccatccaaacttccgaaaaacctgcaaacctgattatcgatgcgttgaaactcgattaccaacacgcggacatagaccgttttgccggacatttgtggaaactttaccaaacgttgggcaactacggcaggcaggttaaagagcggatgctggggtgggggtacagcttgggttaccatgaagttttcgatgatttggaaaaagggccgaacgaccggcaaatcaaagacatcggtatggggcacgggtatctgccgaaaaatatacagaaattcaaatcgcaacatcgggatttggtgcttcaagattcttcgttgattaacaccggttcgtctccggcagacgatgcggttaaggaagtagagtcgttgctgatgtatggtcagattgaagcggcaatggatgtgttggagcaggcggtattgaaatatcccgacgagtcccagctttatattacgttgatcgatatttatgaacgtactgaagattgggataggttggggcagtttttaagggtattgagggaacgtgcggacaggcttcctgaagaggtcgttatgctgatgagccggctgctgcagcgtatgaatcaaaatattaaaaaaataaaacggtacggaaaataa

SEQ ID NO: 4532 - DNA, 1098 bp, Neisseria meningitidis
atggaagttcaactgccgaaaattaaaacagtacgcgtaatgttggcggggatgacggcgcagcaggaatccgttttcaaaatggcattcaaaatgcacaataccacccgttatgaaacagtatccccttcagacggcagtgccgtgcccgatttggttttggcggataccgatgccgagggcggttttgaactttggaaagagcttgccgagcgttataaggatatacccgtcgccgtctgttcggagaaagttcccgattctgaagttccctacctgcccaaaccgattcggtttgaaacattgtttcctatgctccgcaaattgttgcagggcgagaatgtttatgggaaatcgtttattgcacccgcagaccggtcggcgaaaaataacgggaatgtgcagcgtacggttacgatacgccagtttaacccgaataaaggattattgggggcgttgcggtttgcggaaaagaacaggcaggacatcgctatcttgcatggaaataagccggtccttattgttttcccctcgatacaacgggttttgctgacagaaagtgtgcaaaaactcgaagaattgtgcaaagacgaaaatttgcaggtcagctgcaagactgttcccgataacccgcaatggcgcgaaaaggctaaagtaggcattatgtcctgtatgtggcagttttccatttggacagcgcagggcaggttgatttatccgatttctcccgatactccgtttacgttgaaatcttggccaaacctgacccggttggcaaatgtgccggggtcgatacgcttgtcggcatttctgaccaaggcatccgtcaaccttaacgtgttgtataaagtgatgcctttaaacctcaatgatattctgaattatcttgcggcaacctatacaaccgggtttttgtcggtagatttaaaaacggtttcacaacaggcatactccgatatggcggataaaataaatatcggagccgattctgcctctgatagtgaaatgatgaaaaaagcggaaaaaatcacaacaccatcccaatcccagtcgcgcggccttctgcaaaggctgatgaaaaaactgttgggcagctaa

SEQ ID NO: 4533 - DNA, 537 bp, Neisseria meningitidis
atgagagaaaataaaattattttcacaggacctgtcggcgtagggaaaaccactgccattgcggctatttcggacgaagcactcgttcagaccgatgcttccgcatccgatatgactttggataggaaaaggaatacgacagtggcgatggactacggggccatcagcttggatgaggataccaaagtccatttatatggtacgcccggtcaggaacggttcaactttatgtgggaaatcttaagccaaggcagtatgggtttggtcttgcttttagataatgcccgaaccaatccgttgaaagatttggaattctttttacattcgtttcgagggctgctggagaaggcacccgtcgttgtcggtattaccaagatggatatacgctctcagcccggtatcgacgtgtatcacaaatatcttgcaaaacataatcttaatgttccggtttttgaaattgatgcccgtaaggaagatgacgtaaaacaattggttagcgcaatgttattttctattgatccgggactggaggtttaa

SEQ ID NO: 4534 - DNA, 645 bp, Neisseria meningitidis; identical to SEQ ID NO: 611

SEQ ID NO: 4535 - DNA, 360 bp, Neisseria meningitidis
atgcagcaattattgatttcaatccttgaagatttaaacaatacatctacggatattatcgcgtctgccgttatctcaaccgacggattgccgatggcgacaatgcttccttcacatttgaattcggacagggtaggggcgatttctgccactttgcttgctttggggagtcgctcggtgcaggaactcgcctgcggggaattggaacaagtgatgattaaaggaaaatcaggctatatccttttaagtcaggcgggtaaagatgccgtgttggtgctggtggcaaaagaaaccggcagacttggtttaatcctattggatgccaaacgtgcggcaaggcatattgcggaagccatataa

SEQ ID NO: 4536 - DNA, 396 bp, Neisseria meningitidis
atgatgtattcgtttgaagcgaatgcaaatgcagtaaaaatatctgaaactgtttcagttgataccggacaaggtgcgaaaattcataagtttgtacctaaaaatagtaaaacttattcatctgatttaataaaaacggtagatttaacacacatccctacgggcgcaaaagcccgaatcaacgccaaaataaccgccagcgtatcccgcgccggcgtattggcgggggtcggcaaacttgcccgcttaggcgcgaaattcagcacaagggcggttccctatgtcggaacagcccttttagcccacgacgtatacgaaactttcaaagaagacatacaggcacgaggctaccaatacgaccccgaaaccgacaaatttgcaaaggtctcaggctaa

SEQ ID NO: 4537 - DNA, 333 bp, Neisseria meningitidis
ttgaaaggcagaaccatgaacaagccgtttatcactcaggcgcagttggcactttataaatatcagccgtccagcaagtattttgggcaatcgatggcggttatagcgcaatctgaatttgttgaatttgcgaagattaataagtctgaaaatgttattgattgtttctcttttttctggaatagaagaattaaacatgatatttggctaatctcattttctgataattcagaaatggtaattaaagaatccctgaaagatggtcataaaatatacaaatttgaattttgcgaaattgtcgataattgcaattttgatgatgtattcgtttga

SEQ ID NO: 4538 - DNA, 279 bp, Neisseria meningitidis
atgtactaccaagtcggaaataaatgtcttgagaagcaccaggctgaaaacctttatttcagcttggtagtaccaagaatcaaagaaaacggacagattgtcaggccggaatataacggcagcctgtggaagatgtcggacggtcagccgctaaggcttttattggcggaatgcagtccgaaagacaacctgcaaagcggtcttgaaacaggctggatagtattcggcatcctcgcgtccgtttactttgtttccctgctgaaaaaggttttgaaatga

SEQ ID NO: 4539 - DNA, 285 bp, Neisseria meningitidis
atgttcggcggtcgtctgaaaaacgctccatccattaccgccaaacactttttgaaggaaaatatcatgaaatttattaacacctgccgtaaatacggcgcaaaactggctgttgtaacagctgctcccctggctttggccgcacatgcaaatgcaacgttgcccgatacggcaaaaaacgctttggaagccgcaaaagcggacggtatggaagccggttggattgtagtgggcattttcgccgcgctttttgtattttccatcgttaagagagtgatgaagtaa

SEQ ID NO: 4540 - DNA, 198 bp, Neisseria meningitidis
atgcagaaagtctatgttgtccagtccgtatcaacaggggactttctgtatctctctcctgaaacgggcgacatcggacataccaaattaatcaccaatgccgattatttctacgacttcgaagaagcgattaacgcaggtttggaagaaatcggcaaccaatacgaatttgtcgtattcggatttttgaaagactga

SEQ ID NO: 4541 - DNA, 291 bp, Neisseria meningitidis
atgaacatccaacttcaaggccacatcgtcggcgttaaaaaaatcaacggacaaatcgaaggcaagagcttcgactattgctgcctgattgtcgccacacccttagacagctcccaaggcaacgcattgggcagctctactactgaatacgatttcggcggctctgccaatttcgagcagttccgaaacgcccaatttccgatcgaagcaaacctgaacgtagaaatcgtcactacgggcaaaacccaaaaactgaaagtcatcggttttcaactcgtgaagaaaggctga

SEQ ID NO: 4542 - DNA, 1343 bp, Neisseria meningitidis
atggaagataagcaagggatgacaaaggcggttgccggcgtgatgacggacgcgctagcggacggcaggaagccgacaaccgcttcaaatcttccccccttatctaacagggggggacagaaaccgaaacggcaggcagggttcaggaagtcttcgaatgttacgaaacgtacataacggacggtaaaggaaacctgttaggcgttcctcttcggcgcggtgtatcagattcggctttcattgatcaaattagcttttcatttcatgaaaaaacctttttcgataaatacggcgttcgtgtaagtcttttggaagacgaagattttattcgcgccgcgtccatgctcgccgaagaagttttcggtttcggtatctacaaagaatccaaaggttcgggcggtcgtttctatgagcgctgttggttgatgggttcggaagacgccctatacggtcgcgtccattttggcggccaacaaaataccattcttttcgaactgaccggcaccggttgcggcgtcgcaaaagaaggctgggaatcacgacttttcgcattcctgactaatgcaatccgcccaaaaatcacacgcgttgacatcgcaaaagactttttcaacggcgaatacagcccgaaccaagcccgtgaagaccgaaataaaggtatgtttacctgtcatcacgtcaaaccaaaaggcgaatgtttggggtcagattgggaagaagacgatgaagccaaaatgaccaaaggcaagacctatggtatcggctcccgtgaatcgtccaaatatgtccgcgtctatgaaaaaggcaagcagttgggcgataaaacaagcacatggacgcgatttgaaattgaattcaaagcaaaagacatcgttatccctttcgaagttttgcagaatccgggcgaatatttcggcggcgcatatccgatttgcgaacgattcgcccaaaaggcaacgcgcatacacgcggttaaggaagataaggtcatttcagccgaccgctaccttgaatgggtaaaaaaacagttcggacgtgcggcaaacggtctgaaattcatttttcccgaattggacaaagccaaactgtttgaactgattgagccgagtcatcacaagctgcccaagtctttggctcccgaagcctacgactgcgcctttttgaaagctcaagccattcatgaacagcccgcattcaaaccgtacaaagacccttactatatgtacgaatattacgagaatcttgaaaaacagcttgaacagcaaaaacacgtcaacaatgaagaaagctataacaacttcatttacgacaaattcgcaagactaccgatttcatgggcttaa

SEQ ID NO: 4543 - DNA, 96 bp, Neisseria meningitidis
atgcggttctcaaggtctaagccaagaggccgtctaaaaacagaaaaaccgtttcagacggccttatatattgcgtccctaagaagggacgattaa

SEQ ID NO: 4544 - DNA, 495 bp, Neisseria meningitidis
atgactttcaatcaagaacaagattattgggctggctataaggcaaatgaaagagccttgattattcaaacatggtcaggatttgggcgatatgctccagaccacctatatcccccccatatcctgccattggataccgacaatgaaactttaggcacaacggtcttgcaagcattggcaaacagcaggactttcgtttatgacagtccagaagaccaagatttttttgataccgaaaaaattcggcaacgctatgaggattgggttgccaagctatgcgggaacttgggctataaaaccagacgcgccctatttaaaaacatgatgagcgtagatatttggctgcacaacggctgcctgaaaatcagcccgagccgccatgtcaagctggaagcgtgggatgccattgatgcagacgatgtaattttatcattggataacagccctgaagaaatcggagcaggtttaaagttggcattgagccgctgccgataa

SEQ ID NO: 4545 - DNA, 882 bp, Neisseria meningitidis
atgcggacggatgcatttaaatatggaacatggaacagcctgaatgatatacgcagcagttacgaccgtgctgccaccaaaattaagggtgcgggcaatatgggattgggtgcaacgacttttgtcggttcgggtgctataggcggaggtctgtgcagtaccgggattggctgtgcggccggtggacttattgcaacggcaggtatgaccggtggttatacacaggcctcagaaggaagccggcaattgtttggcacttaccagtccgattttggtaaaaaagttgtcctatctttgggtacaccaatagaatacgaatcgccgttagtatctgatgcgaaaaatctagccgtatggggattggaaacgctgattacgcgcaaattgggaaacttggcaacgggtgtgaaaacttccttgactccgaaaactgctgacgtacagcgaaatatcctgtcccaatccgaagtcggtatcaagtggggcaaggggattgaaggacagggaatgccttgggaggattatgtcggtaagggcttgtctgccaatgcaaggttacctaaaaattttaaaacatttgattattttgatcgtggtacaggcacggcaatcagtgccaaaactctggatacgcaaactacggcacgcctgtccaaacccgaacagctttacagtaccatgaaagggtacatcgataagacggcaaatttcaaaagttatgaattatcagaagtaccgttaagggcagacatgatcaaacagcgcgaaatccatctggccatacccgcacaaactaataaggagcaaagattgcagttgcaacgtgtggtagagtatggcaaaagtcaaaacattacagtcaaaattacggagatcgaataa

SEQ ID NO: 4546 - DNA, 903 bp, Neisseria meningitidis
gtgaccgtaggttatggcttcagtgccagtggcgattacagccaaagcaaaatccgagccgaccatgcttcggtaaccgagcaaagcggtatttatgccggagaagacggctatcaaatcaaagtcagagacaacacagacctcaagggcggtatcatcacgtctagccaaagcgcagaagataagggcaaaaacctttttcagacggccaccctcacccatagcgacattcaaaaccacagccgctacgaaggcaaaagcttcggcataggcggcagtttcgacctgaacggcggctgggacggcacggttaccgacaaacaaggcagacctaccgacaggataagcctggcagccggctacggcagcgacagcgacagtcaaagcagcatcacgaaaagcggcatcaacacccgcaacatacacatcaccgacgaagcgggacaacttgcccgaacaggcaggactgcaaaagaaaccgaagcgcgtatctacaccggcatcgacaccgaaactgcggatcaacactcaggccgtctgaaaaacagcttcgacaaagacgcggtcgccaaagagatcaacctgcaaagggaagtaacgaaggagttcggcagaaacgccacccaagccgtagcggccgttgccgacaaactcggcaatacccaaagttacgaacggtatcaggaagcccgaaccctgctggaggccgaactgcaaaacacggacagcgaagccgaaaaagccgccttccgcgcatccctcggccaagtaaacgcctatcttgccgaaaaccaaagccgctacgacacctggaaagaaggcggcataggcaggagcatactgcacggggcggggcggcaatcggctatgcggcgggcgggaatgtcggtacggcggcagtag

SEQ ID NO: 4547 - DNA, 444 bp, Neisseria meningitidis
atggcaattttttattttagttcaaaaaaaatagaaagaaatattatctcatcaaatctgaatcgaaaacaagttcgtgcaatatttagttctgatgtacaagaaatttataagtcatcatactctcgggttcctatggatgtttttcccgaattgaatatccattgtttttatgatgataaaaatcagcttgaagcgatagagatatttgaaccaaataagttttttttagaagatatttcttttaattggcttggaaaaattaatgatgaaataataagctatctttataagagtggaattaatgattttgaaattgatgatttgggtattaggcttcttaatattcctgtttcaactataatcaattcaataggtaaagtagaatgttgttatttagatttttcaaatagagacacgaaattttatgtaaaacaagtgtag

SEQ ID NO: 4548 - DNA, 324 bp, Neisseria meningitidis
atgtctattttggaagagaatgtaattgattcagcctctattgaaaacggaatactcatattaactatttctgatcacttaaaatgggataacgagcatttgtttttgttgcaagaaaaaataaattcatatattcaatatattgaatcaggtcaaatttttgaagattttggagaaagtagctatgagactattgaaatacagcttatatataaatataaaccaaatgaaaattatagaaaatttttatatcgcctagaaggtgctttattaaaacttaaattacggttttcccatggaactatctcatatttttatagttga

SEQ ID NO: 4549 - DNA, 8112 bp, Neisseria meningitidis
atgaaccgcaccctgtacaaagttgtatttaacaaacatcgaaactgcatgatagccgttgctgaaaatgccaaacgcgagggcaaaaacacagccgacacccaagctgtaggtattttgccaaatgatattgcgggctttgcgggttttatccattctatctctgttatctcattctccctttcattactgctcggttctgcccttatcctgacttcttcttctgctactgcccaaggtatcgttgccgacaaatccgcacctgcacagcaacagcctaccatcctgcaaacaggtaacggcataccgcaagtcaatattcaaacccctacttcggcaggggtttctgttaatcaatacgcccagtttgatgtgggtaatcgcggggcgattttaaacaacagtcgcagcaacacccaaacacagctaggcggttggattcaaggcaatccttggttggcaaggggcgaagcacgtgtggttgtaaaccaaatcaacagcagccattcttcacaactgaatggctatattgaagtgggcggacgacgtgcagaagtcgttattgccaatccggcagggattgcagtcaatggtggtggttttatcaatgcttcccgtgccactttgacgacagcccaaccgcaatatcaagcaggagaccttagcggctttaagataaggcaaggcaatgttgtaatcgccggacacggtttggatgcacgtgataccgattacacacgtattctcagttatcattccaaaattgatgcacccgtatggggacaagatgttcgtgtcgtcgcgggacaaaacgatgtggccgcaacaggtgatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggtcgagcaagcaggcattcgtaatcaagggcaatggtttgcctcagccggcaatgtggcagtgaatgctgagggtaaactggtcaacacgggcatgattgcagcgacgggagaaaatcatgcggtttcacttcatgcccgcaatgttcataatagcggtacggttgcctcacaggatgatgccaatattcacagccagacgctggacaattcaggtacggtcttatcctcaggtcgattgactgttcgtaatttaggccgtctgaaaaaccaaaacaacggtacgatccaggctgcccgcttagatatgtcaacaggtggtttggataacacaggtaatattactcaaacaggttcacaagcattggatttggtatctgccggcaaattcgataacagtggcaagattggtgtaagtgacgttccacagaccggtttgaatcccaatccatcagtcataccacagattccgagtactgcaacaggttcaggcagcagcactgtctcggtatctaagcctggttcaaacaatcccgtttcacctacagcacctgcaaaaaactacgccgtaggacgcattcaaacaacaggagcatttgacaatgcaggatcaattaatgcgggtgggcaaattgacattgccgcccaaaacggtttgggaaattcgggtagtctgaatgcggctaaactacgagtatcaggcgattcatttaacaatacggtaaaaggcaaactccaggcacacgatctggctgttaacactcaaactgctaaaaacagcggtcacttattaactcaaaccggcaagattgataaccgtgaactgcataatgccggagaaattgccgccaacaatctgacactcattcattcgggccgcttgagcaatgataaaaaaggcaatattcgagctgcacatttacagcttgataccgccggtttacataatgcaggtaacattcttgccgatagtggaaccgttaccaccaagaataatcttcgcaatacaggaaaagtttctgttgcacgactgaataccgaaggtcagactctagataatacgcgcggacgtatagaggctgaaacggttaacatccaaagtcagcaactgactaaccaaagcggccatattactgctaccgaacaactgactatcaatagtcgaaatgtagacaaccaaaacggcaaactcctatctgcaaaccaagcacaattagctgtttcagacggcctatacaaccaacatggtgaaattgccaccaaccggcagttgtctattcacgataaaaatcaaaacactttggcgttaaacaatgcggatggcacgattcaatctgccggtaatgtatcgctacaagccaaatcactcgccaacaatggcacattaacagccggtaacaaactggatattgctttgacggacgatttcgtcgtagagcgcgacctcactgcaggcaaacaattaaatctaagcataaaaggccgtctgaaaaatacccataccctacaagcaggccatacgctcaaactcaatgccggcaatatagataaccaagttacaggcaaaattattggtggagaacaaacggacatcacatccgaacagcatgttgacaacaggggcttgatcaacagcgacggtttgacccacatcggtgcaggtcaaaccctgaccaacaccgggacaggcaaaatctatggcaaccatattgccctggacgcgcaaatactgcttaaccgggaagaaacgacggaaggcagtaccaaagcgggggcaatagctgcaaggaaacgtttggatattggagcgaaagagattcataaccaagaaggtgccctactatccagcgaaggtatttttgccgtaggtaatcgactggatgaacaacatcatgcggcaggcatggccgatacctttgttaatggcagtgccggtttggaagtacaaggtgatgcattgatgtccgttcggaatatgcagaatatcaataatcactttaaaacagagacatacttagccaaagcggaaaagcaagtccgcgactacaccgtactggggcaaaatacctactatcaggcgggaaaagacggtttattcgacaactcgcaaggacaaaaagaccaaactactgctacgttccatttaaaaaatggttctcgtattgaggccaaccaatggcatgtccgagactaccacatcgagacttataaagaacgcatcatcgaaaaccggccggcacacattactgtgggcggtgatttgactgcctcaggtcaaaattggctgaacaaagacagccggattgtagtaggcgggcgtattatcactgatgatttaaaccagaaagaaattaccaatcaaagtacaacaggcaaaggtcgcacagatgctgtcggcacacagtgggattcagttacaaaaaaaggatggtacagcggtagaaaaagacaacgccgtactgaaagaaaccatactccttaccatgatacccaactatttacccacgacttcgacacgcctgtatccgtcatccaacagaatgccgcctccccttcctttcaacccgccgcatctgcaatcaaactgattgacggagtatccacggcagccgtcaatggtcagcgcatccataccggtaatgtggtctcgttaaataacgctactgttactctgcctaacagcagcctctataccacccatcctgacaataaaggctggttggttgaaaccgatcctcaatttgcagactaccgccgctggttgggcagcgactacatgttgcaacaactgcaattggacaccaatcatctacacaaacggcttggcgacggctactacgaacaaaaacttgttaatgaacaaatccatcagttaacaggctaccgccgactcgacggctacaggagtgatgaagaacaattcaaagctctgatggacaacggccttactgctgccaaaacattcggtctcaccccaggtatcgccttgagtgcagagcaagttgcccgcttaacttcagatatcgtttggatggaaaatcaaaccgtcaccctgtctgacggttcgactcaaaccgtactggttcctaaagtctatgccctggcgcgcaaaggtgatctcaatacctccggtggcctgattagtgccgaacaagtcttacttaaactgcaaaacggcaacctgactaacagcggtaccattgcggggcgacaggccgtactcatccaggcacggaatattaacagcaacggtaacattcaagccgaccaaatcggcttaaaagctgaaaaaagtatcaatatcgacggcgggcaggtacaagcaggcagactgctgactgcccaagcgcaaaatatcaaccttaacggtacaacccaaacttccggtaatgaacgtaacggcaataccgccatcgatcgtatggccggcattaacgtggtcggaagccatactgaacaagtagataacagaacttcagacggcatcctatccctgcatgccagcaacgatatcaacctcaatgcggccaccgtctctaaccaagttaaagacggcactacccaaattaccgccggcaataatctcaacctcggcaccatccgtaccgaacatcgcgaagcctatggtacattagatgacgagaaccatcgccatgtccgccaaagtaccgaagtcggcagcagtatccgcacgcaaaacggcgcactgcttagagccggtaacgacttaaaaatccgccaaggcgaactggaggccgaagaaggcaaaaccgtccttgccgcaggacgtgatgtcactatcagcgaaggacgccaaataaccgaactggatacctcggtaagcggaaaaagcaaaggcatcctttccagtaccaaaacacacgaccgctaccgcttcagtcatgatgaagcagtcggcagcaacatcggcggcggcaaaatgattgttgcagccgggcaggatatcaatgtacgcggcagcaaccttatttctgataagggcattgttttaaaagcaggacacgacatcgatatttctactgcccataatcgctataccggcaatgaataccacgagagcaaaaaatcaggcgtcatgggtactggcggattgggctttactatcggtaaccggaaaactaccgatgacactgatcgtaccaatattgtccatacaggcagcattataggcagcctgaatggagacaccgttacagttgcaggaaaccgctaccgacaaaccggcagtaccgtctccagccccgaggggcgcaataccgtcacagccaaaagcatagatgtagagttcgcaaacaaccggtatgccactgactacgcccatacccaggaacaaaaaggccttaccgtcgccctcaatgtcccggttgtccaagctgcacaaaacttcatacaagcagcccaaaatgtgggcaaaagtaaaaataaacgcgttaatgccatggctgcagccaatgctgcatggcagagttatcaagcaacccaacaaatgcaacaatttgctccaagcagcagtgcgggacaaggtcaaaacaacaatcaaagccccagtatcagtgtgtccattacctacggcgaacagaaaagtcgtaacgagcaaaaaagacattacaccgaagcggcagcaagtcaaattatcggcaaagggcaaaccacacttgcggcaacaggaagtggggagcagtccaatatcaatattacaggttccgatgtcatcggccatgcaggtactgccctcattgccgacaaccatatcagactccaatctgccaaacaggacggcagcgagcaaagcaaaaacaaaagcagtggttggaatgcaggcgtagccgtcaaaataggcaacggcatcaggtttggaattaccgccggaggaaatatcggtaaaggtaaagagcaagggggaagtactacccaccgccacacccatgtcggcagcacaaccggcaaaactaccatccgaagcggcggggataccaccctcaaaggtgtgcagctcatcggcaaaggcatacaggcagatacgcgcaacctgcatatagaaagtgttcaagatactgaaacctatcagagcaaacagcaaaacggcaatgtccaagttactgtcggttacggattcagtgcaagcggcagttaccgccaaagcaaagtcaaagcagaccatgcctccgtaaccgggcaaagcggtatttatgccggagaagacggctatcaaatcaaagtcagagacaacacagacctcaagggcggtatcatcacgtctagccaaagcgcagaagataagggcaaaaacctttttcagacggccacccttactgccagcgacattcaaaaccacagccgctacgaaggcagaagcttcggcataggcggcagtttcgacctgaacggcggctgggacggcacggttaccgacaaacaaggcaggcctaccgacaggataagcccggcagccggctacggcagcgacggagacagcaaaaacagcaccacccgcagcggcgtcaacacccacaacatacacatcaccgacgaagcgggacaacttgcccgaacaggcaggactgcaaaagaaaccgaagcgcgtatctacaccggcatcgacaccgaaactgcggatcaacactcaggccatctgaaaaacagcttcgacaaagacgcggtcgccaaagagatcaacctgcaaagggaagtaacgaaggagttcggcagaaacgccgcccaagccgtagcggccgttgccgacaaactcggcaatacccaaagttacgaacggtatcaggaagcccgaaccctgctggaggccgaactgcaaaacacggacagcgaagccgaaaaagccgccttccgcgcatccctcggccaagtaaacgcctatcttgccgaaaaccaaagccgctacgacacctggaaagaaggcggcataggcaggagcatactgcacggggcggcaggcggactgacgaccggcagcctcggcggcatactggccggcggcggcacttcccttgccgcaccgtatttggacaaagcggcggaaaacctcggtccggcgggcaaagcggcggtcaacgcactgggcggtgcggccatcggctatgcaactggtggtagtggtggtgctgtggtgggtgcgaatgtagattggaacaataggcagctgcatccgaaagaaatggcgttggccgacaaatatgccgaagccctcaagcgcgaagttgaaaaacgcgaaggcagaaaaatcagcagccaagaagcggcaatgagaatccgcaggcagatactgcgttgggtggacaaaggttcccaagacggctataccgaccaaagcgtcatatcccttatcggaatgaaaggcgaagacaaagccttgggttatacttgggactaccgcgactacggcgcaagaaatccgcaaacctacaacgatccgaagctgtttgaggaataccgccgacaggacaaacccgaataccgcaacctgacctggctgcacagcgggacgaaagacaccaaaatcaggcagggagagcggaaaaacgaagagtttgcactgaacgttgccgaaggactgacgagccttgtcaaccccaatccgaggataaaagtcccgattcttgcaggcatccgcaacctgaaaaacatcaagccgacagttaccggcagcgatcccttattggcgggtgcggggaatatccgtatccctgcaaacggcaatgttgcgaagggggacaggattccggatacggcattggctagcaagggaatcaaacataaaaatcgtaaagatcaactggaaaaaaataaaaaatctggtgaggattttgagatggaaatttatcagaagaaagttaaacaaggctttaaaccgcaaagacagattacagttaaaacaaaaagtggtgtaaaaactaggcttgatattatttcgaaagaaggtggtcttgatgtttgtacagagtgtaaggcttcaataactgcgccacttactaaaaatcagaaaaaagcttttcctgaaattgaaagaacgggagcaacagtggtcggtaagggaaaaccgggctatccaaaggggaccaaaattgaacctactaaagttataattgaaaggaaaagataa

SEQ ID NO: 4550 - DNA, 486 bp, Neisseria meningitidis
atgaacgattacacagccatgccgtctgaagacggaggaatcggctcattatcgcttccgccgcactcaatggaggcggaacaatccgttttgggcgggttgatgctggaaaatccggcttgggacaggattgccgatgtggtttcgggagaggatttctaccgccacgaacaccgcctgattttccgatccattgccaaactgatcaatgagagccgtcctgccgatgtcatcacggttcaggaagatttgcagcggaacgaagagctggaagcggcggggggattcgaatatctgattacgctggcgcaaaatactccgtctgccgccaacatccggcgccatgccgaaatcgtgcgcgagcgttccattatgcgccaactcgccgaagtgggaacggaaattgcccgcagcgccatacccaaaatatcggcagcggaacgggcggtagcttggagtacgaaaaattcaagcagtttcttttga

SEQ ID NO: 4551 - DNA, 984 bp, Neisseria meningitidis
gtgctgctgacgctgcatggaacggataagttctgcatcgttaataatttccataccaaccgtaatacggcgtataaggctttgaaagatgcctgtaacaacctttttgaacgccaattcagttttatcgaaaaaacaccaaaaggggaaaaggtagtacggacaaggtgggtatctcaagtcgcctatattgaacaacaggcaacggtagagttagtttttgcaccaaatgttgcccctttgattacgatgctagaaaaaaacttcacaagctacgagcttgatcaggtctcatcgttgagcagtaaatacgcggtgcggctctacgaaattattatttcatggcgtgcagccggtaagacaccgatgttcagtacaatggagttgcgcgaacgtttgggtatgatgcctgacgagtatcaaaaaatggagctattcaaacgtaaggttttggatttcgccgtcaagcagatcaatgataaaacggatatttccattacctacgagcagcataaagaaggacgaaaaattgtaggttttacattctcaatcctacataaaatagggtcgaaagacatccctcttgaaaatcaatcggaactttttgccggaatgactgatttggaagccggaacgatacgggtcagggcggaagcatatatcgcttcgctcattgcaaaaggtcagaacgtgactaaagcccataggctgaatattctgaaaaaagccgtagaggaacgttggggatttgaagatgtggctaaagataatggggccaaaaatcctgaaaacaaaaatgcaaaagtcgttttaaacgaatgggaaaagatttctaatggcacacgttttaaggacaaggatggaacaatttgggttaaagattcaggtatgcttaggactgaagggacaaacaggtggatagccgattctcagattgccaaattatttcctatgttaactgtgatggttgaggaaggtatttaa

SEQ ID NO: 4552 - DNA, 1680 bp, Neisseria meningitidis; identical to SEQ ID NO: 3351

SEQ ID NO: 4553 - DNA, 5928 bp, Neisseria meningitidis
atgaataaaggtttacatcgcattatctttagtaaaaagcacagcaccatggttgcagtagccgaaactgccaacagccagggcaaaggtaaacaggcaggcagttcggtttctgtttcactgaaaacttcaggcgacctttgcggcaaactcaaaaccacccttaaaactttggtctgctctttggtttccctgagtatggtattgcctgcccatgcccaaattaccaccgacaaatcagcacctaaaaaccagcaggtcgttatccttaaaaccaacactggtgcccccttggtgaatatccaaactccgaatggacgcggattgagccacaaccgctatacgcagtttgatgttgacaacaaaggggcagtgttaaacaacgaccgtaacaataatccgtttgtggtcaaaggcagtgcgcaattgattttgaacgaggtacgcggtacggctagcaaactcaacggcatcgttaccgtaggcggtcaaaaggccgacgtgattattgccaaccccaacggcattaccgttaatggcggcggctttaaaaatgtcggtcggggcatcttaactaccggtgcgccccaaatcggcaaagacggtgcactgacaggatttgatgtgcgtcaaggcacattgaccgtaggagcagcaggttggaatgataaaggcggagccgactacaccggggtacttgctcgtgcagttgctttgcaggggaaattacagggtaaaaacctggcggtttctaccggtcctcagaaagtagattacgccagcggcgaaatcagtgcaggtacggcagcgggtacgaaaccgactattgcccttgatactgccgcactgggcggcgacagcatcacactgattgccaatgaaaaaggcgtaggcgtcaaaaatgccggcacactcgaagcggccaagcaattgattgtgacttcgtcaggccgcattgaaaacagcggccgcatcgccaccactgccgacggcaccgaagcttcaccgacttatctctccatcgaaaccaccgaaaaaggagcggcaggcacatttatctccaatggtggtcggatcgagagcaaaggcttattggttattgagacgggagaagatatcagcttgcgtaacggagccgtggtgcagaataacggcagtcgcccagctaccacggtattaaatgctggtcataatttggtgattgagagcaaaactaatgtgaacaatgccaaaggcccggctactctgtcggccgacggccgtaccgtcatcaaggaggccagtattcagactggcactaccgtatacagttccagcaaaggcaacgccgaattaggcaataacacacgcattaccggggcagatgttaccgtattatccaacggcaccatcagcagttccgccgtaatagatgccaaagacaccgcacacatcgaagcaggcaaaccgctttctttggaagcttcaacagttacctccgatatccgcttaaacggaggcagtatcaagggcggcaagcagcttgctttactggcagacgataacattactgccaaaactaccaatctgaatactcccggcaatctgtatgttcatacaggtaaagatctgaatttgaatgttgataaagatttgtctgccgccagcatccatttgaaatcggataacgctgcccatattaccggcaccagtaaaaccctcactgcctcaaaagacatgggtgtggaggcaggctcgctgaatgttaccaataccaatctgcgtaccaactcgggtaatctgcacattcaggcagccaaaggcaatattcagcttcgcaataccaagctgaacgcagccaaggctctcgaaaccaccgcattgcagggcaatatcgtttcagacggccttcatgctgtttctgcagacggtcatgtatccttattggccaacggtaatgccgactttaccggtcacaataccctgacagccaaggccgatgtcaatgcaggatcggttggtaaaggccgtctgaaagcagacaataccaatatcacttcatcttcaggagatattacgttggttgccggcaacggtattcagcttggtgacggaaaacaacgcaattcaatcaacggaaaacacatcagcatcaaaaacaacggtggtaatgccgacttaaaaaaccttaacgtccatgccaaaagcggggcattgaacattcattccgaccgggcattgagcatagaaaataccaagctggagtctacccataatacgcatcttaatgcacaacacgagcgggtaacgctcaaccaagtagatgcctacgcacaccgtcatctaagcattaccggcagccagatttggcaaaacgacaaactgccttctgccaacaagctggtggctaacggtgtattggcactcaatgcgcgctattcccaaattgccgacaacaccacgctgagagcgggtgcaatcaaccttactgccggtaccgccctagtcaagcgcggcaacatcaattggagtaccgtttcgaccaaaactttggaagataatgccgaattaaaaccattggccggacggctgaatattgaagcaggtagcggcacattaaccatcgaacctgccaaccgcatcagtgcgcataccgacctgagcatcaaaacaggcggaaaattgctgttgtctgcaaaaggaggaaatgcaggtgcgcctagtgctcaagtttcctcattggaagcaaaaggcaatatccgtctggttacaggagaaacagatttaagaggttctaaaattacagccggtaaaaacttggttgtcgccaccaccaaaggcaagttgaatatcgaagccgtaaacaactcattcagcaattattttcctacacaaaaagcggctgaactcaaccaaaaatccaaagaattggaacagcagattgcgcagttgaaaaaaagctcgcctaaaagcaagctgattccaaccctgcaagaagaacgcgaccgtctcgctttctatattcaagccatcaacaaggaagttaaaggtaaaaaacccaaaggcaaagaatacctgcaagccaagctttctgcacaaaatattgacttgatttccgcacaaggcatcgaaatcagcggttccgatattaccgcttccaaaaaactgaaccttcacgccgcaggcgtattgccaaaggcagcagattcagaggcggctgctattctgattgacggcataaccgaccaatatgaaattggcaagcccacctacaagagtcactacgacaaagctgctctgaacaagccttcacgtttgaccggacgtacaggggtaagtattcatgcagctgcggcactcgatgatgcacgtattattatcggtgcatccgaaatcaaagctccctcaggcagcatagacatcaaagcccatagtgatattgtactggaggctggacaaaacgatgcctataccttcttaaaaaccaaaggtaaaagcggcaaaatcatcagaaaaaccaagtttaccagcacccgcgaccacctgattatgccagcccccgtcgagctgaccgccaacggcataacgcttcaggcaggcggcaacatcgaagctaataccacccgcttcaatgcccctgcaggtaaagttaccctggttgcgggtgaagagctgcaactgctggcagaagaaggcatccacaagcacgagttggatgtccaaaaaagccgccgctttatcggcatcaaggtaggcaagagcaattacagtaaaaacgaactgaacgaaaccaaattgcctgtccgcgtcgtcgcccaaactgcagccacccgttcaggctgggataccgtgctcgaaggtaccgaattcaaaaccacgctggccggtgcggacattcaggcaggtgtaggcgaaaaagcccgtgccgatgcgaaaattatcctcaaaggcattgtgaaccgtatccagtcggaagaaaaattagaaaccaactcaaccgtatggcagaaacaggccggacgcggcagcactatcgaaacgctgaaactgcccagcttcgaaagccctactccgcccaaactgaccgcccccggtggctatatcgtcgacattccgaaaggcaatttgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattgttaccataatcgtaaccgcactgacttatggatacggcgcaaccgcagcgggcggtgtagccgcttcaggaagtagtacagccgcagctgccggaacagccgccacaacgacagcagcagctactaccgtttctacagcgactgccatgcaaaccgctgctttagcctccttgtatagccaagcagctgtatccatcatcaataataaaggtgatgtcggcaaagcgttgaaagatctcggcaccagtgatacggtcaagcagattgtcacttctgccctgacggcgggtgcattaaatcagatgggcgcagatattgcccaattgaacagcaaggtaagaaccgaactgttcagcagtacgggcaatcaaactattgccaaccttggaggcagactggctaccaatctcagtaatgcaggtatctcagctggtatcaataccgccgtcaacggcggcagcctgaaagacaacttaggcaatgccgcattaggagcattggttaatagcttccaaggagaagccgccagcaaaatcaaaacaaccttcagcgacgattatgttgccaaacagttcgcccacgctttggctgggtgtgttagcggattggtacaaggaaaatgtaaagacggggcaattggcgcagcagttggggaaatcgtagccgactccatgcttggcggcagaaaccctgctacactcagcgatgcggaaaagcataaggttatcagttactcgaagattattgccggcagcgtggcggcactcaacggcggcgatgtgaatactgcggcgaatgcggctgaggtggcggtagtgaataatgctttgaattttgacagtacccctaccaatgcgaaaaagcatcaaccgcagaagcccgacaaaaccgcactggaaaaaattatccaaggtattatgcctgcacatgcagcaggtgcgatgactaatccgcaggataaggatgctgccatttggataagcaatatccgtaatggcatcacaggcccgattgtgattaccagctatggggtttatgctgcaggttggacagctccgctgatcggtacagcgggtaaattagctatcagcacctgcatggctaatccttctggttgtactgtcatggtcactcaggctgccgaagcgggcgcgggaatcgccacgggtgcggtaacggtaggcaacgcttgggaagcgcctgtgggggcgttgtcgaaagcgaaggcggccaagcaggctataccaacccagacagttaaagaacttgatggcttactacaagaatcaaaaaatataggtgctgtaaatacacgaattaatatagcgaatagtactactcgatatacaccaatgagacaaacgggacaaccggtatctgctggctttgagcatgttcttgaggggcacttccataggcctattgcgaataaccgttcagtttttaccatctccccaaatgaattgaaggttatacttcaaagtaataaagtagtttcttctcccgtatcgatgactcctgatggccaatatatgcggactgtcgatgtaggaaaagttattggtactacttctattaaagaaggtggacaacccacaactacaattaaagtatttacagataagtcaggaaatttgattactacatacccagtaaaaggaaactaa

SEQ ID NO: 4554 - DNA, 510 bp, Neisseria meningitidis
atgagtaactttgaaaaaaaatatattttagaattaaatgatgctttaagccatttaaatcataactctacctcatttgatttattgaaagttttgatttcatggttatcaaacgatattgtcattgataaatttaaaattttaggttatgactttagtaaatatatcgaaatgaatcccgatgactatccggttgaaaaatctatattgaatagagaggaaattatttatctcaaaaacaatatttatcgtaaaatatcatcaggaaattttaaatttcaatactttgtacaatatattagagatattttagaatatttatttattgaacatattgaaagagtctgtccttactgcgaatggggtgaaatgcaaaaattagaagaacaaaatacgcatgaaacggtgtatctctgtactcaatgtggatgtgctttttataacgataattcacaatttttattaaaaacccctttaaccattccaatgaaacgtgatgaatttaaataa

SEQ ID NO: 4555 - DNA, 1623 bp, Neisseria meningitidis; identical to SEQ ID NO: 3923

SEQ ID NO: 4556 - DNA, 378 bp, Neisseria meningitidis
atggaaacattgaatgatataaaaaaaatcttgattaatgtggggctttatcaagggtttgatttgacagatccaaaagtatcagaagaagttaatcatgaaacagctaatatgaaatggattaaagattatacttcagacgggaattgggataatgaatttaaggaggatttaaaaaactttttagattatatggaagtatgccaattagccctaaacgataaaaatttcaaaattgccagtaattctttatttatggctatgatttacgcaggtaatctatctcttatatttgattcaataaaaactgatatatcaacattattgagtgctgagtataaaaagaatagtttttcatggccatctcttgatgaatag

SEQ ID NO: 4557 - DNA, 375 bp, Neisseria meningitidis
atgaaaaattttaatgtagtaaaagaaagtttaagagagttaggaattaaacaaggatttgatctttatgagaaagccacaactgaaaaattgaatagtgaagatcctcttgacttacaatggctttctaactattcatctgattggaatgatgaattagaagaagactttgattctttttttcagcatatgaaggaatatcaatatgctattgacaatgaagacattaaatctgcatgtagttcactatgtgaagctatgctctatgttggtaatattaaaaatttttttgagtttctcaaaagcgatatgattagactgttgagaggtgaaagtaaaacaacagactttcaatggccgcaatttgatgaatag

SEQ ID NO: 4558 - DNA, 1953 bp, Neisseria meningitidis
atgcgtaaggtgtgtgcttcagcacgcacgcgttccatgatttacggctcaatgccgtctgaaaagctcacaatttttcagacggcatttgttatgcaagtaaatattcagattccctatatactgcccagatgcgtgcgtgctgaagacaccccctacgcttgctatttgaaacagctccaagtcaccaaagacgtcaactggaaccaggtacaactggcgtacgacaaatgggactataaacaggaaggcttaaccggagccggagcagcgattattgcgctggctgttaccgtggttactgcgggcgcgggagccggagccgcactgggcttaaacggcgcggccgcagcggcaaccgatgccgcattcgcctcgctggccagccaggcttccgtatcgctcatcaacaacaaaggcaatatcggtaacaccctgaaagagctgggcagaagcagcacggtgaaaaatctgatggttgccgtcgctaccgcaggcgtagccgacaaaatcggtgcttcggcactgaacaatgtcagcgataagcagtggatcaacaacctgaccgtcaacctggccaatgcgggcagtgccgcactgattaataccgctgtcaacggcggcagcctgaaagacaatctggaagcgaatatccttgcggctttggtgaatactgcgcatggagaagcagccagtaaaatcaaacagttggatcagcactacattacccacaagattgcccatgccatagcgggctgtgcggctgcggcggcgaataagggcaagtgtcaggatggtgcgataggtgcggctgtgggcgagatagtcggggaggctttgacaaacggcaaaaatcctgacactttgacagctaaagaacgcgaacagattttggcatacagcaaactggttgccggtacggtaagcggtgtggtcggcggcgatgtaaatgcggcggcgaatgcggctgaggtagcggtgaaaaataatcagcttagcgacaaagagggtagagaatttgataacgaaatgactgcatgcgccaaacagaataatcctcaactgtgcagaaaaaatactgtaaaaaagtatcaaaatgttgctgataaaagacttgctgcttcgattgcaatatgtacggatatatcccgtagtactgaatgtagaacaatcagaaaacaacatttgatcgatagtagaagccttcattcatcttgggaagcaggtctaattggtaaagatgatgaatggtataaattattcagcaaatcttacacccaagcagatttggctttacagtcttatcatttgaatactgctgctaaatcttggcttcaatcgggcaatacaaagcctttatccgaatggatgtccgaccaaggttatacacttatttcaggagttaatcctagattcattccaataccaagagggtttgtaaaacaaaatacacctattactaatgtcaaatacccggaaggcatcagtttcgatacaaacctaaaaagacatctggcaaatgctgatggttttagtcaaaaacagggcattaaaggagcccataaccgcaccaattttatggcagaactaaattcacgaggaggacgcgtaaaatctgaaacccaaactgatattgaaggcattacccgaattaaatatgagattcctacactagacaggacaggtaaacctgatggtggatttaaggaaatttcaagtataaaaactgtttataatcctaaaaaattttctgatgataaaatacttcaaatggctcaaaatgctgcttcacaaggatattcaaaagcctctaaaattgctcaaaatgaaagaactaaatcaatatcggaaagaaaaaatgtcattcaattctcagaaacctttgacggaatcaaatttagatcatattttgatgtaaatacaggaagaattacaaacattcacccagaataa

SEQ ID NO: 4559 - DNA, 432 bp, Neisseria meningitidis
atgaaaaataatatttttctaaacttaaataaaaaatctataaataacaaccattttgttatttcgattttttttgaaacaatttaccaatttgaaactaaagatacgcttttagagtgttttaaaaatattacaactaccggacattttggagtaataggtgctcaatatgaaaaaatagatgctaccagatggattggagattatgaagaggtaaatggatttgagtatattgataaagctccttctatttatttttcagttggagatgatttcaatcctgaagaattaattatacctattaatttagcatatcattactttaatattgcaatatctgatttcttaatagctcaccctgaatatcaaaaaaagtgtaaagaaatacaaaaaacatattctcaaacaaactgtagcctgcatgaaacctaa

SEQ ID NO: 4560 - DNA, 216 bp, Neisseria meningitidis
atgccaatgagaacagtcgcatcctgctcagcaccacggatatcagttcggaaaacggcaaaatcaaaattcaatcttacggtgaccaatattactatgcgagacagagcgaactctatacctttgaacgccgcagctacaaaactggcaaatggtacaaccgcaaacacattaccgaagtcaaagaacacaaaaacgccaagcccgacgcagtaa

SEQ ID NO: 4561 - DNA, 285 bp, Neisseria meningitidis
atgttactgccccgtcctgcctgtttttgccatagagtagatttgctgctgctcacggtttctgtgtggatgctgcttttgatcccttcgaggataatcttggcatcggcccgtgcctgctcgcctacgcctgcgcgtatggttgcgccacccagtgtggtttcaaactgtgtgccttgcagtttggtatcccaacctgattgcagattggcagattctgcaactacccttgagggcagcgcggttttcatgacttgggtggtggtgtcgtgtgctttgctgtag

SEQ ID NO: 4562 - DNA, 1521 bp, Neisseria meningitidis
atgacacccgcagcagcagctgtcgtcgttatcgtcgtaaccgtattgacctacggcgcactgtccgccccggcagccgccggaacggcgggcgcggcaggcgcaggagcgggaggagccgcagcaggaacggcagccggaactggagtagcagcaggaacggcagccacaaccggagtagcagcaggcacatcagctgcagctatcaccacagccgcaggcaaagccgcactggccagtctcgccagccaagccgcagtttccctcatcaacaacaaaggagacataaaccataccctgaaagaactgggcaaaagcagcaccgtcagacaggccgccaccgccgccgtaaccgcaggcgtactgcagggcataagcgggctgaacacccaagcagccgaagccgtcagcaaacattttcacagtcccgcagcaggcaaactgaccgctaacctgatcaacagcaccgctgccgcaagtgtccataccgccatcaacggcggcagcctgaaagacaacttgggcgatgccgcactgggtgcgatagtcagtaccgtacacggagaagtagcgagcaaaatcaaatttaatctcagcgaagactacattgcccacaagatagcccatgccgtagcaggctgtgcatcggcggtagcaaataaaggcaaatgtcgggacggcgcaatcggcgcggcagtcggcgagatggtgggagaaaccctgttggacggacgcgatgtaggcaaactgtcaccccaagaacgccaaaaagtcatagcctactcgcagattatcgcaggcagcgcagtggcattggttaaaggggatgtgaatacggcggcgaatgcggctactgtggcagtggagaataatagtcttttagctcgcaggagggtaaatatacgttggacttcgcgacaagaattggaacatgaatatgccattcttgaaatccaggccattaccaatcaaatccgaaggctggatccgaaatttaacgggattgctattatgaggaatcctagagagccgtggacaagacatgatgtacaaacatacaggcaatattataatcaattaagggaatccagaggctttgctgttgacccaatttatagaatcaggataaacaacggcaatgaatttaaccgtatcatgtcatcaaaatacccttataatgagctttatgtagccaatcctaaatcggcgacggggtattttagggtagattcgtataatcctgcgacagaggaaattatttcaagaaaatttacccaattttctcaaatccaagaaagtacggggattggttatatcaaggaggctgttagaaaatatagccctggtgctgtcatttccaatgttccaagtacacctactacgataagaggaagaaagcttgaaggaaaacttattttagaagttcctgctcaggtcaatccaattccacaatctgtattaagggcggcacaagaagaaaatgttatcattagagatacaacaggaaggatttacaaatga

SEQ ID NO: 4563 - DNA, 489 bp, Neisseria meningitidis
atgaagaaagatattttttattgtgagcagtggtcttatggttataagaaacttcataagcctttttctgagaaacaagctgaggaaaaacatcttaaaggggagttatatactgccgtaataggttcggcgacacaacctgaatatgtaattaccttgcgagaggaagtaggttttttttcggtacattttttcgataaatttggaagggattatttaacccatcaatttcaaaaatattccaattcgaattattattttctttctatggctgtatggagagattatataactttggaatctcatgacttagcagaaggatatacttatttcttcaatgaaaatacggatgattgctatgttttgaaagaggattttattaataatgagcgatatgaaaaaacagaattatattcccaaaaagataaggtaattctatttccaaagtttggcgaatatgatttggtgttaaatccggacattatttaa

SEQ ID NO: 4564 - DNA, 273 bp, Neisseria meningitidis
atgaataagagaatgaaaatgtgtcctgcttgtcaacaaggctatctctaccattcgaaacctaaatatcttcatgatgaaattattctgtgtgatgaatgcgatgcagtatggctcaaaggtatgaatatattttatggagaatatgaaaaagatttttattcttatgttcctttcatggaatcccaaggtataacgagtgaatgtatttgggaaggagatttgtttgatcatccatattatgaagatgaaaactcaaatgatatggattga

SEQ ID NO: 4565 - DNA, 783 bp, Neisseria meningitidis
gtgggggagattgtcggggaggctttggttaagaataccgatttcagcggtatgactgcttctgaaattgaaaaagctaaagcgaatattactgcgtatgcaaaattggtagccggagcgactgtaggtgttacaggaggcaatgttgatgtggcggcaaatgcttccgaaacagctgttaaaaataatgcattagatattatttgggatattggcaacctcgtatgggacggcggtaaatggatttacgccaaatctattggcgataagcagatggctcgagaagcggcgattgattttggtgtggatgccgccgcagctgccgttccctttgttccggcaggtgcgactaaaatcagccgaggcggggcttatgttctgaaggcgggagacgaagcagttgatacggctaaagccatacaggaaattcagaagcagaccggaatcaagcttacttatgataaggttaataaggtttggacaacaccggcggggttagattatgggttagatgctaagcatggtaataggattaaacatgttttagcccatacaattccaaatccaaacaaacctgttcattctgtttttaatgtgtcccgtaaagaagttttgcctttggttgatgaagcttggagaatgaaaggaaatcctttgccaaatgattcatccgtatatcttgtagatatgaagaaacctattggaacaaaaggagaaacaaaagtgcggattgttgtgcaaaaaggaacaaataaaatcatttctgcatatcctcagaaataa

SEQ ID NO: 4566 - DNA, 264 bp, Neisseria meningitidis
atggataaagaaattaaaatttgcccaagatgtgagcaaggctacctttatcatgcaaagcctaaatatttctctggggaggtcattttatgcgatgaatgttatgctatgtggcttggggatatgaaaattttttacggacaatatggaaaagatttttatgattatcatgagtttatgaaagataaaggcatagaagaaataaatatgtgggaaggagagctttttgatcacccatattatgaggatgaaaaatttaaataa

SEQ ID NO: 4567 - DNA, 1923 bp, Neisseria meningitidis; identical to SEQ ID NO: 911

SEQ ID NO: 4568 - DNA, 423 bp, Neisseria meningitidis
atgaaatatatgattagttttctaaaaaaaacatttgaattaatgagttgggtgttagtcatactaataattgggacattttatgactattatcaaataaggcaatatgctgaattagaaaagaaatctatatcaaatatcttgctatatgcccaaaaagaaaaatttcgcttagagagtaaagataaatacatgcgaggaggatatacaaaatataaatttattttttcagaatatagtaatactacttttttaaatttcataaatgacctgaaaaaagataattatttaccacttgacggctatggacatggttttctatgtagaaaaggagagtctatatcaatcaatatataccctgaaattaataaatttattttagtatggggataccctgaaaatctttgcgctgattctaattaa

SEQ ID NO: 4569 - DNA, 402 bp, Neisseria meningitidis
atgagaaaattgaataatcacgatgttcataaacggtatcaagatcgtttagaagaggatgtagagttcactatcaactatgagcttcctttgagttgtttgtggtcaaccatcaaagacttttccagcgattttgaggaaaaaactgaagcgttctttattcttttcaaagagctgctgcgcagaggtcatctgaaactgcaacgcgacgggcaaattatcgggcatacgcccgaagaatgggaacaaatatttagggaagtatggcctgaatatgaaatcgaacccaatccacttcccggctatgccccatttgatattggaatgtggcttacggtcgaggctcctgcctacgccgtatggatagatcccgaagacggtagcgaatactgggcgggataa

SEQ ID NO: 4570 - DNA, 240 bp, Neisseria meningitidis
ttgctgggtgtggttccgggtatcggtgaatcgatacaggcctataaagtagcgaaagcggcaaaaaatttacaaggcatgaaaaaagccttggacaaggcagcaaccgttgccactgcacagggctatgtcagtaaaaccaaaatcaaaatcggtcaaactgaattaagggttactgcagcaactgacaaacaattgctgaaagctattggcgaaggaaggacacgacaggtaaaatga

SEQ ID NO: 4571 - DNA, 384 bp, Neisseria meningitidis
atgaccgagcagttatttgactctttagctaaacaaaatggcttcagagtgctttcgggcggcaaatacggcggaaataacggttttgatcatgtatggcaggctgccgatggtagtgttgttttgattgtagaaagtaagcagattaggaacggtacggtacagctgaatccgaatggtgcgggtggatatacgcagatgagtcgtgaatggattaaacaagttgtaaaaagtttacctgatggtagtcctgctaaggcagttgtcttaaaagcaaatcagaacggcaaattaaaaacggcaatagcaggcgttgatcgtcaaacaggtaaggccgttattctttctgtcaaagttccttctaaaaccaatataaggagataa

SEQ ID NO: 4572 - DNA, 936 bp, Neisseria meningitidis
atggggcacaatatgatgaccacccaaaaatggtatgaacatattactaatgtaatcataggcaatactgctaatttcaatagcggttgccccgaatctatagattatgtagatgaaaaaaaaggcgtgccgcttgcagcgatgaaatacattttaatgtacactgaagctgcggcttcccatgcctatctatttgaacatgatcttaagaaattcaagcaatatgcttatgttgcaggaaagttgggtattttgcagagtgtagatgatgaagaccccgaacccttcttctttccctgcgacatgctcaacattcaagatccgatgtttctgatgctgatgagcgacagcccgcagctgcgcgagtttttggtgcgcaatatcgacaacatcgccaacgatacagaagccttcgtaaaccgatacgacctcaaccgtcatatgatttacaatactctgctgatggtggagggtaagcagcttgatcggttgaaacaacgtagcgagaaagtcttggcgcatcccacccctagcaaatggctgcaaaagcggttgtacgattaccgcttcttcctcgctttcgccgaacaggatgccgaggcgatgaaggccgccttagagccgctttttgataaaaaaaccgcgcgtatggctgccaaagaaacattgtcctatttcgatttctacctgcagccgcaaatcgttacctacgccaaaatcgcatccatgcacggtttcgatttgggcatagaccacgaaatcgcgccgagggatttgactgtttacgatccgctgccggcagacgaatatcaagacatcttcgattttatgaaacagtatgacttgtcttatccgtatgaatatctgcaggattggatagattactatacgttcaaaaccgataagctggtatttggtaacgcgaagcgagagtga

SEQ ID NO: 4573 - DNA, 156 bp, Neisseria meningitidis
atgttattgcaaagatctcatgccttgttttgccagcaggttgagttcttctccggcaatcagcgtggtaaagcctcgccacaacacagatctatgtactatggaagggcttcaatttatagctttcgaaaatctttcagctttaagacggcctaa

SEQ ID NO: 4574 - DNA, 252 bp, Neisseria meningitidis
ttgaaaattttttggcgcatttttatgcgtcaaatttcgttaacagactatttttgcaaaggtctcaggttcaaacacatcgccttcaggtggtttgcgtactcactttgtcatttccaatgttccaagtacacctgctccgctaagaggaagaaaacttacaggaaaacttattttagaagttcctgctcaggtcaatccaattccacaatctgtattaagggcggcacgagaagaaaatgttatcattag

SEQ ID NO: 4575 - DNA, 204 bp, Neisseria meningitidis
atgttatcattagagatacaacaggaaggatttacaataggtggtggtttagtattaggtggttgtgcaggtgcacatcttgcaagaaaagaaccattgatactaacagggaaaacaggggcaggtgcgtcagcaattgcaaatgcaagcattggatatcaatggactgtcaatttgtcaaagccaaaagaaggagctaaataa

SEQ ID NO: 4576 - DNA, 180 bp, Neisseria meningitidis
atgcattcccactatatatttggtattttgatgatttcatatgttttcgcaatgttatttaattttataatatcatataaaatatttaaagaagaaaaattaattaatggtttttttgattttctaattaaatcaagctaccttaactttaaatatttcaatatattatttggaaaataa

SEQ ID NO: 4577 - DNA, 459 bp, Neisseria meningitidis
ttgttaactaagttgaaaattttgctatttttgttcttatttgtttttgtattggctattaatttgcttttcttcttttttagttcggatatcgagagtttcgggaactatcagtttgaatatgtttacgataaaggttggcctgctaattatattttagtcatgaaagatggaaatgaagggaattttgataaaataatatccggattggttttagaatattataaggaggatgataacatttatttttcttatattgacgggcaaggatttgcttcagactcttgctattacaaaccggaaattttatatggaaaaattattttaaataaaaatcatatcattaatattaatagcatggaaaaaaataattttctttcagaagataaaataatgaagggaacaagaaattggctagcagaccctaaaaataaatgtaatatacagactctagactaa

SEQ ID NO: 4578 - DNA, 126 bp, Neisseria meningitidis
ttgcgaaaatacaacggaatcgatcgtaaatctttcccgctgttcttgaaagaatgcgaatttcgatttaacttcggcacaccgtctcaacagcttaaaatcctgcgggattggtgtgggatttag

SEQ ID NO: 4579 - DNA, 283 bp, Neisseria meningitidis
atgattcacgaagaaatctccgccatgcctatgggctatgaaaccttgatcggcgatatgggcagcgcactgtcaggcggacaaaaacaacgcatcgtattggcgcgggccttaatattgcgaaccgaaaatcctatttttagatgcagcgaccagccatttggatattgccaatgaaaaagcagtcaatgcaaacttgaatggcttgtctatcataaaaattatggcggcacacagaaaggaaacggtggaatcagcagataggaaaatgtctttaggataa

SEQ ID NO: 4580 - DNA, 1221 bp, Neisseria meningitidis; identical to SEQ ID NO: 621

SEQ ID NO: 4581 - DNA, 660 bp, Neisseria meningitidis
atgtcaaaccaacaagccttggtcatcttttcgggcggtcaggattcgaccacctgcctgattcaggcaatccaaacctacgggcgcgaaaacgtccaagccattactttccaatacgggcaacgccatgccgtcgagctggaacgtgcccgctggattgcgcaggatttgggcgtcaaacaaaccgtactcgacttgagcctgatgcggcagattacgcacaatgccctgatggacgacaccgccgccatcgaaactgccgaaaacggcgttccgaatacctttgtagacggccgcaacgcgcttttcctgctctatgccgcgatttacgccaaagggcaggggatacggcacatcatcgcgggcgtgtgcgaaaccgacttctccggctatcccgactgccgcgacgtgtttgtcaaatcgatgaacgttacccttaatttggcgatggactatgattttcaaatccacacgccgctgatgtatctgaccaaggcgcaaacgtgggcgttggcggacgaaatgggcgtgctggactatatccgcgagcaaacccacacctgctataacggcatcgtcggcggctgccgcgaatgcccgagctgtatcttgcgcgaacgcgggctggcggaatatctggaaagtaaaaaggccgtctga

SEQ ID NO: 4582 - DNA, 519 bp, Neisseria meningitidis
atgcccaagctccatatgttttacctcggcggcaatgccggcaggtcgaatatcgaagtgcacgacatccaatttgccgtgtgcgacaactaccgcgaggccgtccccgcgctcaaagccgcgtggttcggcgatgcggacaaaatccacatcgacggctggcagattgtcgaatgggcggacggttacgacatcgccgtatccgaaacgcccaaaacgaaaatgccgtctgaacacgccccgcgcctgtatttcgccaatgtcggcggttatcgcgcgggtcagcttgccgaggcacacgctttcgggctgttcgccgccgccacgcctgccgaagccaaacaaaaagccctgcaaaccctgttgaccgacagctatgttcagcagcataaagacaacttaaaagacgtggacaacctgcttgcgctcgaccgcatcggcaatttccatatccgcctgaccccgaatccgcacggcaaacccgccgaaatcggctttcaaggctatttgcccatttga

SEQ ID NO: 4583 - DNA, 423 bp, Neisseria meningitidis
atgaaaatcaccaaaatcttcaccttcgactcctcgcatatgctcgacgggcatgacggcaaatgccaaaacctgcacggacatacctacaaactcgaaatcaccgtttcagacggcattatcaaaggcggcgcgaaagacggtatggtgatggactttaccgacttgaaagccattgtcaaacaacacattaccgaccccttcgaccacgccttcatctaccacggcggcaacagccgcgaatgccaaatcgccgcgcttttggagggctggaacatgaaaaccctgcgcctgccctgccgcaccactgccgaaaatatggcggtcgaaatgtacggccgtctgaaaaacgcggggctgaacgtgtgccgcgtgaaattgtgggaaacgccgacatcgtgtgcggagtatgaaggggagtag

SEQ ID NO: 4584 - DNA, 372 bp, Neisseria meningitidis
atgaaactcctcttcatcctcctagtcctcttcgtcgccgtcgaacatttctacatcgcctggcttgaaatgacacagattcccagcgaaaaagcggcggaaatattcaagctgccttatgaatttatggaacaaaagcaagtgcagaccttgttcagtaatcaagggctgtataacggctttctcggcatcgggctggtgtggtcgcggtttgccgcgccggacaacgccgtttacggcgcgacgactctgtttctcggtttcgtattgattgccgccgcgtggggcgcgttttcgtccggcaacaaaggcatactcgtcaaacaaggactgcccgcgatgctggcggcggcagcggtgttggcggtatga

SEQ ID NO: 4585 - DNA, 639 bp, Neisseria meningitidis
atgaaaaaaatcaatgttgcccccgaaaatccgcaataccgtatcgtcgaaattttcgagagcctgcaaggcgaaggctggaacacgggcatgcccgccgttttcgtccgcttgggcaaatgcaatctggcgtgcggctggtgtgataccgattatttgacattcggtatgatgggcttgtccgatatcttaggccgtctgaaaacctacgccgcccgcaacatcatcatcaccggcggcgagccgaccatacagccgcatctcgatatgctgctggacacgctcaaggcggaaggctatttcctctgtctcgaaaccaacggactcaatcccgcgccgccgcaaatcgactacgtcgccaccagccccaaagcctgctacgccgccaaatatgaaaatagctgtatcgaaacagccgacgaagtgcggattgttgccgatggtgatgtccttgcgttctgcgaaaacatggaacgcaaaatccgcgcacatcattactacctttcgccctgtgagcaagacggtgcgatgaacatctacgacaccatccgccaaatcggtattttaaacagtcgccccgacgcatccgtgcattggcagttgagcgtgcagacgcacaaatgggcgggaatagagtag

SEQ ID NO: 4586 - DNA, 1086 bp, Neisseria meningitidis
atgaccgtcccccatattccgcgcggccccgtcatggcagacattgccgccttccgcctgaccgaagaggaaaagcaacgcctgctcgatcccgccgtaggcggcatcatcctcttccgccgcaacttccaaaacatcgaacaactcaaaacactcaccgccgaaatcaaagccctgcgcacacccgaactcattatcgccgtcgatcacgaaggcggcagggtgcaacgtttcatcgaaggcttcacccgcctgcccgcaatgagtacgctcggcgagatttgggacaaagacggcgcgtccgccgccgaaaccgccgccggacaagtcggccgggttttggcaaccgagctttccgcctgcggcatcgatttgtccttcacgcccgtcttagatttggactggggaaactgccccgtcatcggcaaccgcagtttccaccgcaatcccgaagcggtcgcccgcctcgccctcgcccttcaaaaaggtttgacaaaaggcggtatgaaatcctgcggcaaacattttcccggacacggatttgtcgaaggagacagccatctggtcttgccggaagactggcgcagcctgtccgaactcgaaaccgccgacctcgcccccttccgcattatgagccgcgaaggtatggcggcggttatgcccgcccacgtcgtttatccacaagtggacacaaagcccgcagggttttccgaaatctggctcaaacaaattttgcgccgcgacatcgggttcaaaggcgtgattttctcggacgatttgactatggagggcgcgtgcggggcaggcggcatcaaagaacgcgcccgcatttcctttgaggcaggttgcgacatcgtcctcgtctgcaaccgtcccgaccttgtggatgaactgcgcgaagatttccgcattcctgacaatcccactttggcgcaacgttggcaatatatggccaacacgctcggcagtgccgccgcgcaagccgtgatgcagacggcggatttccaagcggcgcaagcctttgttgccggccttgcctcgccgcaggacacggcgggcggcgtgaaagtcggcgaagccttttaa

SEQ ID NO: 4587 - DNA, 1521 bp, Neisseria meningitidis; identical to SEQ ID NO: 691

SEQ ID NO: 4588 - DNA, 1500 bp, Neisseria meningitidis
gtgttcaaaaaataccaatacctcgctttggcagcactgtgtgccgcctcgctggcaggctgcgacaaggcaggcagctttttcggtgcggacaaaaaagaagcatccttcgtagaacgcatcgaacacaccaaagacgacggcagcgtcagtatgctgctgcccgactttgcccaactggttcaaagtgaaggtccggcagtcgtcaatattcaggcagcccccgccccgcgcacccaaaacggcagcggcaatgccgaaaacgattccgacccgattgccgacaacgacccgttctacgaatttttcaaacgcctcgtcccgaatatgcccgaaatcccccaagaagaagcagatgacggcggattgaacttcggttcgggcttcatcatcagcaaagacggctacatcctgaccaatacccacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcatcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcaggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataa

SEQ ID NO: 4589 - DNA, 630 bp, Neisseria meningitidis
atgaacagacacatccgccaagaaatcttcgaacgcttccgcgccgccaacccccatccgaccaccgagctgaatttcaactcccctttcgagcttttaattgccgttctgctttcagcgcaggcgaccgatgtcggcgtaaacaaggcgacggcgaagctgtttcccgttgccgatacgccgcaggcgatgctggatttgggtttggacggcgtgatggaatacacgaaaaccatcgggctgtataaaaccaaatccaaacacattatgcaaacctgccgcatcctgctggaaaaatacaacggcgaagtgccggaagaccgcgaggctttggaatcattgccgggtgtggggcgcaaaacggcaaacgtcgtattgaacacggcgttcggccatcccgtcatggcggtcgatacgcatattttccgcgtatccaaccgaaccaaaatcgcccccgggaaagatgtgcgcgaagtcgaagacaaactgatgcgcttcattcctaaagaatttctgatggacgcgcaccactggctgattttgcacggacgctacacctgcaaggcactcaaaccgcaatgccaaacctgcatcatcaacgatttgtgcgaatatcccgccaaagcctga

SEQ ID NO: 4590 - DNA, 414 bp, Neisseria meningitidis
atgataccctcctacacctacgccgccctcgccttttccgcattcacttccgccaccctcctgcccggcacatccgaagccgcctttgccctgttcgtccaccgctttcccgaacacgcatacggcgcgttgctgtgcgccggccttgccaacggattgggcagtatggtttcctattggatggggcgtttgctgccctcccgaaaaatgccgtctgaaaaaacactgaatctgatgcggcgtttcggtatttggctgcttgcgtttacctggctgcccgtcgtcggcgacgcactgccgcttgccgccggctggctgcggttgaatccgtggacaagcgggctgatgctggttatcggcaaaacggcgcgttacgccttcattctgtggggaatgcaatattacgccgcctga

SEQ ID NO: 4591 - DNA, 1281 bp, Neisseria meningitidis
atgtcaatttctattttcttgaaacgggtaatattccgacaccacgaaaggcaaatcatgtctgcgcaatcacaaaacaatcatacgtccccattggtcgtcttgaccacgctgttcttcatgatgggttttattacctgcatgaacgacatccttatccctcatttgaaagaaattttcgacctgtcttacgttcaggcgatgctgatccaattctgtttctttaccgcctatgcggtgatgtccatcccgatgggggcttttgtcggcaaagtcggctacaaaaacggcgttatcggcggctttctgctgacggcggtcggatgcctgctgttttatcctgctgcgggcagccattcttacgcggtatttttgggcgcgttgtttattttggcttccggcgtaacgctgcttcaggtcgccggtaatccttatgttaccctgctggcgaaacccggcaaggaatcggcaacactgacgctggttcaggcgtttaacgctttgggtacgaccattgcgccgcaaatcggcgcgttcctgattctggcggacgcaacccaaaccgtcagcaaggcggaacagatttcttccgtacagattccctatttgggactggcggggctgctgattatccttgccgttttcgtgaaaatgatccggctgcccgacgcgcgcaaaattgccgccgaggaaagcgcgcacaaccacgacggcaaaaccagcgtatggcaatacaaacatctcgtgttcggtacggcaggcattttctgctatgtcggcgcggaggtgtctatcggttcgttgatggtcaacgtattgggttatctgaaagggctggatcatgcttctgccgcgcattacctgtcgttctattggggcggcgcgatggtcggacgtttcctcggttcggcggtgatggcgaaattcgcgcccaaccgttatttggcgtttaacgcatcggctgcggtcgtactgcttgccgtcgcgatggcgacgggtagcggcaatgcggatgtggcgatgtggtcgctgcttgccatcggttttttcaactcgattatgtttccgacgattttctctttggcaaccaaaggattgggaaaatttaccaacgcggcttccggtgtactgtgtaccgcgattgtcggcggtgcggtcgttcctgtcgtgcagggctgggtggcagatacttacaccctgatgtcttcgtttgtcgtttccgtcatctgttatctgtatatcgtgttttttgcggtgtacggatatagggcggacaaataa

SEQ ID NO: 4592 - DNA, 1380 bp, Neisseria meningitidis; identical to SEQ ID NO: 3363

SEQ ID NO: 4593 - DNA, 825 bp, Neisseria meningitidis
atggacggcgcacaaccgaaaacgaatttttttgaacgcctgattgcccgactcgcccgcgaacccgattccgccgaagacgtattaaacctgcttcggcaggcgcacgagcaggaagtttttgatgcggatacgcttttaagattggaaaaagtcctcgatttttccgatttggaagtgcgcgacgcgatgattacgcgcagccgtatgaacgttttaaaagaaaacgacagcatcgagcgcatcaccgcctacgttatcgataccgcccattcgcgcttccccgtcatcggcgaagacaaagacgaagttttgggcattttgcacgccaaagacctgctcaaatatatgtttaaccccgagcagttccacctcaaatccattctccgccccgccgtcttcgtccccgaaggcaaatcgctgaccgcccttttaaaagagttccgcgaacagcgcaaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttccgaacgctggcgcatccatgcagctaccgaaatcgaagacatcaacaccttcttcggcacggaatacagcagcgaagaagccgacaccattggcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaa

SEQ ID NO: 4594 - DNA, 510 bp, Neisseria meningitidis
atgaaacgcaccaaaaaataccctttcttaacgttgcagcggcaacgtttccatttgaactttgaaaacgcctcttccgccgccggcatcccagccgaacgcgatttctaccgctgggcgtggtctgccttgaaaaatgaataccgccgcgccgacatcagcctgattcttctggacgaagaagaagcccgagcctacaaccgcgactaccgcggcaaagattacgccaccaatgtattgagtttcgcgctcaacgaaggcgaaatcctgccctgccaagtttcggaaaaactgtacggcgatttgattatctgcccgcaagtggttttgaaagaagccgccgaacaaggcaaaacacccgagcagcattttgcccacctgaccatacacggtactttacacctgatgggctacgaccacatcgaagacgacgaagccgaaataatggaagccgaagaaatccgcctgatgcgggcggcaggcttccccaacccctaccaagaggactga

SEQ ID NO: 4595 - DNA, 936 bp, Neisseria meningitidis
atgaacccgaaaaaactcgtcatcgccagccgcgaaagcctgcttgctatgtggcaggcaaagcatatccaaggccgtctgaaggctctgtatcccgattgcgaagtcgagattttgggcatgaccacgcgcggcgatcagattttggacaaaactttgtcaaaagtcggcggtaaaggcttgtttgtcaaagagttggaacaggctttatatgacgggcgcgccgatttggcggtgcattcgattaaggacgtgccgatggatttgcctgaaggtttcgcgcttgccgccatcggcgaacgcgccaatccgtttgacgcgtttgtgtccaaccaatacacgcgtttggaagaaatgcccgaaggcgcggttgtcggcacatccagcctgcgccgcgaagcccagttgcgtgcgcgctatccgcatttgcttatcaaacctttgcgcggcaatgtgcaaacccgtttgtccaaactcgataacggcgaatacgacgcaattatcttggctgccgccggtttgcagcgtctgaaattggacggacgcatccgcatgattttgtcggaatccgacagcctgcctgccgccggacaaggcgcattgggtatcgaaattgccgcgcaccgcgaagatttgtatgaagttttgaaacccttgaaccacggtgttaccaatgcctgcgttaccgccgaacgcgccctcgcacgcgctttgggcggaagctgccaagtgcctttggccgcatattgcacggaagaaaacggcttgctgaccttgcgcggcttggtcggacaccccgacggttcggttgtgttgcgggcggacgcgcaagcccctgccgaatatgccgacgcgctcggacgcgctgtcgctaagaaattggcggacgacggtgcgcgggaattgattggagcagtattgaatacggaaaattga

SEQ ID NO: 4596 - DNA, 1194 bp, Neisseria meningitidis
atgttcttcaagcacatcgaagccgcccccgccgatccgattctcggtttgggcgaagcgttcaaagccgaaacccgccccgaaaaagtcaacctcggcatcggcgtttataaagacgcatccggcgcgacacccctcgtcaaagccgtcaaagaagccgaaaaacgcctgttggaaagcgaaaccaccaaaaactacctcaccatcgacggcgttgccgactacaacgcgcaaacccaaatcctgctgttcggcaaagaccacgaaatcatcgccagccgtcgcgccaaaacagcgcaaagcctcggcggtacgggcgcattgcgtattgcggccgagtttgccaaacgccagttgaacgcgcaaaccatctggatttccaatccgacttggcccaaccacaacgccatcgccaaagcggtcggtatccaagacaaaccttatcgttactatgatgccgccaaacacggtttggattgggacggcatgattgaggacttgagccaagcgcaaaaaggcgacatcgtcctgctgcacggctgctgccacaatcctaccggcatcgaccctacgcccgaacaatgggaaactttggcaaaactttctgccgaaaaaggctggttgccgctgtttgactttgcctaccaaggcttcggcaatggtttggaagaagatgcctacggcttgcgcgtgttcttgaaacacaatacagaattgctgattgccagctcttattccaaaaacttcggtatgtacaacgagcgcgtcggcgcgttcactttggtggccgaagatgaagaaacagcagcccgcgcccacagccaagtcaaaaccatcatccgtaccttgtattccaacccggcttcacacggtgcgaacaccattgcgctggtgttgaaaaatgatgatttgaaagcacaatggattgccgaactcgatgaaatgcgcggccgcatcaaagccatgcgccaaaaatttgtcgggttgctcaaagccaaaggtgcaagccaaaactttgatttcattatcaaacaaaacggtatgttctctttcagcggcttgactcccgaacaagtcgaccgcctgaaaaacgagtttgccatttatgccgtccgctccggccgcatcaacgtcgccggcattaccgacaacaacatcgattatctgtgcgaaagcatcgtgaaagtactgtaa

SEQ ID NO: 4597 - DNA, 498 bp, Neisseria meningitidis
atgactgcgcttacccttccggaagacatccgccaacaagagccatccgccctgctctataccctcgtttccgcctacctcgaacacaccgcccaaaccggcgacgaatccctctcctgcctgtccgacgaccagcacacgctgaccgcattctgctacctcgacagccaagtcgaagaaggcggcttcgtgcaactcatcgcatccggttacggcgaatatattttccgcaacccgcttgccgacagcctgcgccgctggaaaatcaaagccgtgccgaaagtcttggacaaagccaaagccctctacgaacaacacggcaaaaccatcgaaacgctcgccgacggaggcgcagacatcccttccctgcgcaaacagttccccgaatttgaagaatgggacggcgcatactacgaagccgccgaacaagacctgcccctgcttgcagaacacatacagtcaaactgggaaaccttcgcccatatcgggcaggcgtga

SEQ ID NO: 4598 - DNA, 204 bp, Neisseria meningitidis
atggacaatctgaatccgcaggaaatttccgtgttgccggaaaatctgccgctgtattgctcgggacccggcaacgagcagtggaacgggcatccgagagtgtttttgcctttgtgcgaaggagaatcgggcagcgttgcctgcccgtattgcggcacgcgctaccgccttgacggcaagatgccgcatcatcattacgcctga

SEQ ID NO: 4599 - DNA, 1587 bp, Neisseria meningitidis
atggcacttttcctcagcatattccccatcgtcctgctgatttggctgatggtgaaaaaaaacagtatgccctcctacgtcgcgctgccgattaccgcagtgctgatttacgccatcaaacttttctacttcgacgatgcgggcatgctgctcaacgccaccgccgcttccggcctcgtcaaaacgctcacgccgattaccgtgattttcggcgcgattatgttcaaccgtatgatggaaaccacgggctgcatcgatgtcatccgcaaatggctggcgaccatcagcccgaaccccgtagcgcaactgatgattatcggctgggcttttgcctttatgattgaaggcgcatccggcttcggtacgcctgccgcgattgccgcgccgattctgatgagcttgggcttcaacccgttgaaagtggcgattttcactttggtgatgaactccgtccccgtctctttcggcgcggtcggtacgccgacctggttcggtttcgcaccgctgaacctgagtgccgaagacatcctcgccatcggcaggcagaccggcgtaatgcacttcttcgcaggtttcgtcatccccgtcatcggcttgggcttcatcgtaccttggtctgaaatccgcaaaaacttgggcttcgtcgccattgccgtcttctcctgcaccattccttatgtcgcattggcgatggtcaacgaagaattcccgtcgctcgtcgccggcgcgatcggcctgatggtgtccgtattcgccgccaaccaaggctggggcttgagcaaagaccacgccaaagacccgaatgccgaaaaagtgccgttcgcccaagtcgccaaagcactcgcccctttgggtatgctgatcggcatgctggtggttacgcgcatcaaacagctcggcatcaaaggcattttgaccagcaaagaagaatggttcagcttccaactgccgtttgatttgtccaaaatcaccgtcagcgactccctgacgattaccttcggcaatattttcggacaagatgtcagcgcgtcttaccaaacgctgtacgtcccggcttggattccgtttgtgctgaccgtttggatttgcatcctgctgtataaaaccaaattcaaagatgcctggacgatttattccgtaaccttcaatcaaaccaaaaaaccgctgcttgccctgatgggcgcgctgattatggttcagctgatgctggtcggcggcgacaattcgatggtgaaaatcatcggtaaggaatttgccgcaatggcgggcgaacactgggtttatttctcgccgtatctgggcgcgatcggtgcgttcttctccggttccaacaccgtgtccaacctgaccttcggcccgattcagcagcaaatcgccttggataccggcctgtccgttaccctgattctggcgttgcagtccgtcggcggcgcgatgggcaatatggtgtgcctcaacaacatcatcgccgtatgtaccgtattggatgtgaaaaattccgaaggtgcgattatcaagaaaaccgttatcccgatggcgatttacggcgtgattgccgtcgtcgcggcaatgattttcttcctctag

SEQ ID NO: 4600 - DNA, 723 bp, Neisseria meningitidis
atgaaacccgcctatttcatttccgacctgcatttgagcgaaaagcagcccgaactgaccgcgctgctgctgcgttttttacgttcttccgccgccgggcaggcgcgggcgatttacattttgggcgatttgtttgatttttgggtgggcgatgacgaagtttccgagttgaatacttcggttgcgcgtgaaatcaggaaattgtccgacaaaggcgttgccgtgttcttcgtcaggggcaaccgcgacttcctgatcggtcaggatttttgccggcaggcgggcatgacgctgctgccggattactcggttttggacttgttcggctgcaaaaccctcatctgccacggcgacactctgtgtacagatgacagggcataccaacgtttccgcaaaatcgtgcatcggaagcggctgcaaaaactgttcctaatgctgcccctgaagtggcgcacgcgccttgccaccaaaatcaggcgtgtcagcaaaatggaaaaacaggtcaagcccgccgatattatggatgtcaatgccgcctttaccgcgcggcaggtacgcgccttcggtgcggaaaggctgatacacggacacacccaccgcgagcatatccatcacgaaaacggctttacccgcatcgttttgggcgactggcataacgactatgcttcaatcctccgcgtggacggggacggcgcggtattcgtgccgctggaaaaatactga

SEQ ID NO: 4601 - DNA, 3486 bp, Neisseria meningitidis
atgcgcctgacccatatcaaactctccggcttcaaatcttttaccgacccgaccacgattcatgtgccggggcagcttgtcgcggttatcgggcccaacggctgcggcaagtcgaatgtgattgacgcggtgcgctgggtgttgggcgaggcttcggcgaagcagcttcgtggcgagagtatgcaggacgtgatttttaacggtgcggcgacgcgccgtcctgcgccgagggcttcggtggagctggtgtttgacaacagcgaccacagtttgcagggggcgtgggggcagtatgccgaggtgagcatcaagcggcagctgacgcggcagggcgaatcgacttatttcatcaacaatcagaccgtgcgccgccgcgacattaccgatttgtttctgggtacgggcgtgggcgcgcgcggttatgccgttatcgagcaggggatgatttcgcgcatcatcgaagcgcggccggaggagttgcgcgcctatatcgaggaggcggcgggcgtgtccaaatataaggaacgccgcaaggagacggaaggtcgtctgaaagacacgcgcgagcatttgcagcgtttgggcgatttgcagaacgagttggcgcgtcaggtggaaaagctggaaaaacaagcggaaaccgccgaacgctacaaatccctgaccgcgcagctgaatcagcaacaggatttgctcgattacgcccaatggcggcaatcgcttgccgccgccgataaggcgaccgcgcagcatcaatctttgcaggcgcagcaggacgaaaccgccgcgcaggttcaggcgttaaacgacgaagtacacgccttgcagactgccgaacagtcgcagcagcaggcagtgcatgaattgagcaacaagcgcggcgtgttgcgcgagcagattgcccgtttggaagaacaaatccgccatcagcaaaacctgcaccaacgcatcgaacgcgacaagcaggcagcgcaggcgcagttacaacgcattcatcaagagcagcagcaaatccgcgtgcagcttgaagaaaacgagttgcaggtcgaagaaaaacaaaccgagctggcggaatgggcgatgcaggttgccgaacacgaggagcgtctgcccgaattggaagaagcccaagccacgctcaacgccgccttccaaacccagcaggacgaggcaaaccgcatccgccgcgaactggcgttgaagcagcagcagcttgcccatgccgaacaaacgattgccaagcacgaagagcgcaaaggtcgtctgaaacaggaaaaccaagccttaaacctgcccgacgaagccgaaaccgccgccgcgcaggaagcagccgccttgttgcaaagtcagcaagagcattacgaagaacaaatcattgccgccgaagaagccttacacgccgcccgcgaggcgtttcagacggcctcaaaccgcttccaaagcctgaagcagcaacacatcaccttgcaggcgcagcagcaggcgttgtcgcaaatcctgtcgcaacagcaggaagccgccgatttctggcaggcaaccgaccacgccgccgcgccgcaactgtggcaacacatcaccgcgcccgccgagtggcagcacgccttgtccgtcattcttgccgaacgcctgcacgcccgcgccgtgccgcaaggtttcgtgccgcccgagcctttgccgcaggggcaggcggcatggctttcagacgacctctcaggcggcatcaaaaaatccctgcccgtacaggcattgctgaaccaaatccaagcgcagccgccgtttcagacggcattgcactactggctcgacggcgtattgtgcgcgcccgatttgagctatgccctcgcgcatcaaaacgatttgggcgcacaccaaatctggctcacgcccgaaggtcatcaggtcgataaagtcagcgtcctgctctatgccaaacccgcgcaggaaagcctgattgcccaaaaagcgcgcctcgacggcatcgcgtccgaactggaaaacctcgcccccgaactttccgccgccgaagccgcgttcaaacaggcggaagctgccgtgcgctcgtctgaagtgcaacataaaaacctgatgcagcagcaacagcagcacacgcgccaatacagtcaagcacagcaacgcgccgccgaactcttagcgcgtaccaaccaagggcaaatccgccgcgaacacatcgagcgcgaactggcgcagttggcggaagaacagaccgtgttgcaacacacgtccgacgggctttcagacgacatcgttaccttgcaggaagccgccgccgaactcgaacaccagcagcaaaccaccgcgcacagccgccaagagcagcaaggccgtctgaaacaggcgcagcttgccctgttggaagccaaccgccaatacgggcttgccgaagtcgccgtccacaaactcaaccagcaaaaacaaaactaccggcagcaaatcgcccagcttgaacagcaaaccctcgactggcaggaacgccagcaagagcttgccctcgcctatgaaaccgagttccaaaacgacgagcagcacatcaagcttgaagaattaagcgaagccgtacagaccttggacgaagaatatattgttgtgcaagagaaactcgcgcagattcaggaacagggcagggagcaatacgctaaagtgcaaaccctgcaaaccaagctgccgcagcttcaggccgccacccaaaccgccttgttgcagcagcaggaagccctgatcaacgccaaacgctaccatcaaaacctgaccgaacgcgccgccgatttggacgcgctcgaagcgttggcgaaagaatcgccgaaagtattgaacagcagcatcggcagcctttcgcaacaaatcgaagcactcggcgcggtcaacctcgccgccctgcaagaactcgaagaagcgcgcgaacgcgacggctactaccgcagccaaagcgaagacgtgcaggcagccatcacccttttggaagaagccatcgcccaaatcgacgacaaaaccaaagcgcgtttcaaagaaaccttcgatgccgtcaacagcaaagtccaaaccttcttcccgaccctgttcggcggcggcgaagccactctcaaaatgataggcgacgacctactgaccgccggtgtgtccattatggcgcgtccgcccggcaagaaaaacagcaccatccacctcctctccggcggcgaaaaagccctcaccgccatgagcctcgtgttcgctctgttcagcctcaaccccgctccgttctgccttttggacgaagtcgatgccccgctggacgacgccaacacctcgcgtttctgcaggctggtcaaagaaatgtcggcgcaaacccagttcctctacatctcccacaaccgcctgacgatggaaatggcggagcagctggtcggcgtaaccatgcaggaaaaaggtgtctcgcgcgtcgtcgccgtggacatcaaacaggcgttggaaatggcggaagccgtttga

SEQ ID NO: 4602 - DNA, 1047 bp, Neisseria meningitidis
atgaaaatgcaggcagttgttgtgaataaaaatgtagcgggcgatgtggaagtaatcgaacgcgaggttcgcccgttggaatacggcgaggcattggtcgaagtcgaatattgcggcgtgtgccacaccgacctgcacgttgcggcaggcgactacggcgaaaaaccgggccgcgtgttgggacacgaaggcatcggtttggttaaagaagttgccgacggtgtgaaaaatctgaaagtcggcgaccgcgtcagcatcgcttggctgttccaaagctgcggctcttgcgaatactgcaataccggccgcgaaaccctgtgccgttccgtattgaacgcgggctacaccgccgacggcggtatggcgacccactgtatcgtgagtgccgattacgcggtcaaagtccctgaaggtttggatcctgcgcaagcttccagcattacttgtgccggtgtaaccacttataaagccattaaagtttccggcgttcgtccgggacagtggattgccatctacggcgcgggcggtttgggcaacttgggggtccaatacgcgaaaaaagtattcggcgcgcacgttgtcgccatcgacatcaacgacgacaaactggcgtttgccaaagaaaccggcgcggatttggttgtcaacgccgccaaagaagacgctgccaaagtgattcaggaaaaaaccggcggcgcacacgctgcggtcgtaaccgccgtatctgctgccgcattcaactctgccgtgaattgcgtccgcgcgggcggacgtgtggttgccatcgggctgccgccggaatcgatggatttgtccatcccgcgtttggttttggacggcatcgaagtggtcggctctttggtcggcacgcgcaaagatttggaagaagccttccaattcggcgcggaaggtttggttgtgccgaaagtccaactgcgtgctttggatgaagcacccgccattttccaagaaatgcgcgaaggcaaaatcaccggccgtatggtgatcgatatgaaaaaagaatgcggctgcggccatcaccactga

SEQ ID NO: 4603 - DNA, 390 bp, Neisseria meningitidis
atgaaaaacgttcaaaaaggctttacgctgctcgagctgatgattgccgtcgccatcctcggcatcctgacgctcatcacctacccttcctataaaacctacatccggcgcgtccgcctgtcggaagtcaggacgaccctgctgcacaacgcgcagaccatggaacgttactaccgccaaaaagggacgtttaaaacctacgacaaaaacaaactgaaacaaaacgaatatttcgatatcactttaagcgaagtcagccccgaccactttacccttcaggccgaccccaatcccaccaccaacgacggcgaaacctgcgtcgttacgctcaacgacggcggtaccattgccgcttccggtacaaaccaatcctgccccggcttcgactaa

SEQ ID NO: 4604 - DNA, 1179 bp, Neisseria meningitidis
atggcaaaaatgatgaaatgggcggctgttgcggcggtcgcggcggcagcggtttggggcggatggtcttatctgaagcccgagccgcaggctgcttatattacggaaacggtcaggcgcggcgacatcagccggacggtttctgcaacaggggagatttcgccgtccaacctggtatcggtcggcgcgcaggcatcggggcagattaagatactttatgtcaaactcgggcaacaggttaaaaagggcgatttgattgcggaaatcaattcgacctcgcagaccaatacgctcaatacggaaaaatccaagttggaaacgtatcaggcgaagctggtgtcggcacagattgcattgggcagcgcggagaagaaatataagcgtcaggcggcgttatggaaggaaaacgcgacttccaaagaggatttggaaagcgcgcaggatgcgtttgccgccgccaaagccaatgttgccgagctgaaggctttaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataa

SEQ ID NO: 4605 - DNA, 1935 bp, Neisseria meningitidis
atgagcttgatcgaatgtaaaaacatcaaccgctatttcggcagcggcgagaaccgcgtccatattttgaaagacatcagcctgtcgatagagaagggcgattttgtcgccatcatcgggcagtccggttcgggcaagtccacgctgatgaacatactcggctgtttggataccgccggttccggttcgtaccgaatcgacggcatcgaaactgccaaaatgcagcctgacgagctggcggcattgcgccgcgaacgcttcggtttcatcttccaacgctacaacctcttaagctcgctgaccgcaagggacaacgtcgcgctgccagccgtctatatgggcgcgggcggcaaagagcgttccgcgcgggcggacaaactcttgcaggatttgggtttggcaagcaaagagggcaacaagcccggcgaactctcgggcggacagcagcagcgcgtctccatcgcccgcgccctgatgaacggcggagaaatcatcttcgccgacgagccgaccggcgcgctcgataccgccagcggcaaaaacgtgatggaaatcatccgcaggctgcacgaagccgggcataccgtcattatggtcacgcacgaccccgacatcgccgccaatgccaaccgcgtcatcgaaatccgggacggcgaaatcatttccgacacctcgaaaaatcccgaaatccccgcaagcaatgtcgggaggattcgggaaaaagcttcgtggtcgttttattacgaccagtttgtcgaagccttcagaatgtcggtgcaagcagtattggcgcacaaaatgcgttcgcttctgacgatgctcggcatcatcatcggtatcgcgtcggtggtttccgtcgtcgcattgggcaatggttcgcagaaaaaaatccttgaagacatcagttcgatagggacgaacaccatcagcatcttcccggggcgcggcttcggcgacaggcgcagcggcaggattaaaaccctgaccatagacgacgcaaaaatcatcgccaaacaaagctacgttgcttccgccacgcccatgacttcgagcggcggcacgctgacttaccgcaacaccgacctgaccgcctcgctttacggcgtgggcgaacaatatttcgacgtgcgcggactgaagctggaaacggggcggctgtttgacgaaaacgatgtgaaagaagacgcgcaggtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccaggttgccgaaaaagggctgaccgatctgctcaaagcgcggcacggcacggaagatttcttcatgaacaacagcgacagcatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatattttgcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagacgcattggcacaggattga

SEQ ID NO: 4606 - DNA, 783 bp, Neisseria meningitidis; identical to SEQ ID NO: 2201

SEQ ID NO: 4607 - DNA, 2190 bp, Neisseria meningitidis
atgatttaccaccgcatcgccgtaaacgtgccgctttcagacggccttttgacttattcccattccgatccgcttcctccgggaacgcgggtgcttgtgcctttccgcaataaaaccgtggtcgggatggtgtgggaaacggatattgcgcccgatatggatatggcgcggattttgagtgttcagacggcctttgtggaagaaaagccgttgcctgaaagctggcgtgatttgttggcatttacgtcgcgttattaccactatccgactgggcaggcggtgtttgccgcgctgccgcagggtttgaaggaaacgcgcgcggtggaaatgccgcagccgccgttgttttatgctttgaacgaagcgggcagggcgcaaacgccgccaccagctcggttcaacaaaaaagcggctttgtgggacgcactgctttcgggcggaatgacgatggcagcgttgaagcaggtaaacgcgcaggcggcgaaattgattgaagattgggcggagcagggttggattgaaacaacggaagcggcgaaacctgtattgaggtcgtaccacgggcaggcttcgcactctgaatttgtgttgaatgccgaccagcaacaggcttccgatgaaattcagacggccttcggcagcttccagccgtttttgctgtacggcatcaccggcagcggcaagaccgaggtgtatttcgatgcgatggcgaaagtgttggcgcaggggcggcaggtgttgtttctgttgcccgaaatcaacctcacgccgcagcttttgaagcgggtggaaaaccgttttgccgacgtgccgaccgccgtgttgcacagtcagatggcggcaggcaagcgcacgcaggattatttgcgcgcgatgttggggcaggcgaaattggtcatcggcacgcggctggcggtgttcacgccgatggatgatgtcgggctgattgtggtcgatgaggaacacgacggctcgttcaaacaggacaacgaattgcgctaccacgcccgcgatttggcggtgtggcgggcgaagcagggcggctgcccgatcatattgggcagtgccacccccagcttggagagctggcacaaggcgcaaagcggcgcgtaccgcctgctgcaactgaccgaacgcgcccataccgccgcgcaactgccgcaagtggacatcctcaacgtaggccgtctgaaacttgacaacggcttctcgccgcaagccttgcagcttttgaaacagaactttgaagcaggtggcatgtcgttggtgtacctcaaccgtcgcggcttcgcgcccgcgctgttttgcggcgactgcggttataccttcggctgcccgaactgctccgccaaaatggtgctgcaccaacgcgcccgccaactgcgctgccaccactgcgaccaccgcgaacccatcccgtacaaatgccccgactgcggcaaccaagacctgaccgccgtcggccacggcacgcagcgcgtcgaagaaaccctgcgcaccttcctgcccaaggcagccgtcgtccgtgttgacagggacagcaccgcgcacaaaaacgactgggcggatttgtaccgccgcatcgccgacaacaaaatcgacattttggtcggcacgcagatgctcgccaaagggcatgatttcgcgcggctcaacctcgttatcgtgttgaacgctgacggcagcctgtacagcgcggactttcgcgccccggaaaggctgttcgccgagctgatgcaggtgtccggcagggcggggcgcgccgacaaacccggcaaggtgttgatacagacccaactgcccgaacatcccgtcttcgccgccgtcaaagcgcaggactacgccgtgtttgccgaaaacgaattgaacgagcggcaaatgttcgccatgccgcccttcggtttccagaccgccgtccgcgccgacgcgccgcgcgttgccgatgcgatggagtttctcaatgccgccaaagaaaccctcgccccgcttttgcccgaaagcgtttcacagttcggcgccgccccgatgctgatggtgcgcctcgccgaacgcgaacgcgcgcaaatcttcctcgaatctccgtcccgacaggatttgcaccgtgccgtgagtttgtgggcgcaggtgttgcagcaaaaccgcgacggcaaaatcagatggtcggtggatgtcgatccgcaggaggcttga

SEQ ID NO: 4608 - DNA, 1074 bp, Neisseria meningitidis; identical to SEQ ID NO: 847

SEQ ID NO: 4609 - DNA, 957 bp, Neisseria meningitidis
ttgttaattcactatatcgacatcgccaaacgaaacttcgtcatcgccgtttcgtctttgtctaaaaccaaaaccgaaaccaacaaccccaaaggtatcgcccatactatcgaataccttaaaaaacacaaggtcgccctcgtcgtgacggaaagtaccggcggtctcgaaatccccgccgccaaagccatccgccgagcaggcatagccgtgattatcgccaacccgcgtcagacgcatcagtttgcccaatcgcagccgctgaccaaaaccgacgccaaagatgccaaaatgctcgccttcttcgcacagatgatgacgcagaaagaaggttcgcaaaccatgccctaccacccgcccaccgaagtggaagaagtgttggaagccttggttaaccgccgcaaccaactggtggatatgcggactgccgagaaaaaccgtctgcattaggttcatgaaacgcaagtcggaagcgtcaaacaactgattgcccattttgaccggctgattgacgaattggacaaacaaatcgacgaccacacccacacgcattttgacggcaaagcccaagtggcggagcaaatcaaaggcatcggttcgataacgacggctacgctgatggcgatgctgcccgaattggggcggctgtcgcacaaacggatagcgagtttggccggcattgccccgcacccgagggagagcgaggaaaccaaattcaaaagccgctgctttggcggaaggtctgcggtgcgtaaggcactgtatatggctaccgtggcagcgacacgttttgaaccgcttattcgggatttctaccaacgcctgctgtccaagggtaagccgtataaggttgccgttacggcatgtatgcgcaaactgctgacgatatcgaatgcccggatgcgtgattattttgccgaaaacgataccgccgaaaacggtatccggacggcttga

SEQ ID NO: 4610 - DNA, 1929 bp, Neisseria meningitidis
atggcaaaagtaatcggtatcgacttaggtacaaccaactcttgtttggccatttccgaaaacggtcaaaccaaagtgatcgaaaacgcagaaggcgcacgcaccacgccgtccgttatcgcttatttggacggcggcgaaatcctcgtcggtgcgcctgccaaacgccaagcggtaaccaacgccaaaaacactatttacgccgccaaacgtttgatcggccacaaatttgaagacaaagaagtccaacgcgacatcgaatctatgcctttcgaaatcatcaaagccaacaacggcgacgcatgggtaaaagcacaaggcaaagagctgtctcctcctcaaatttccgcagaagtcctgcgtaaaatgaaagaagccgccgaagcttacttgggcgaaaaagtaaccgaagccgtgattaccgtccctgcctacttcaacgacagccaacgtcaagccaccaaagacgcaggccgtatcgccggtttggacgtgaaacgcatcatcaacgagccgaccgcagccgctttggcattcggtatggacaaaggcgacaacaaagaccgcaaagtagccgtatatgacttgggcggcggtactttcgatatttccatcatcgaaatcgccaacctcgacggcgacaaacaattcgaagtattggcaaccaacggcgataccttcttgggcggtgaagacttcgaccaacgcctcatcgaccacatcatcgccgagttcaaaaaagaacaaggcattgatttgaaacaagacgtgatggctctacaacgcctgaaagaagctgccgaaaaagccaaaatcgaattgtccagcggccagcaaaccgaaattaacctgccgtacatcaccatggacgcaaccggcccgaaacacttggcgatgaaaattacccgcgccaaattcgaaagcctggttgaagacctgattacccgctctatcgaaccttgcaaaattgcattgaaagatgccggcttgagcaccggcgacatcgacgacgtaatcttggtcggcgggcagtcccgtatgccgaaagtacaagaagccgttaaagccttcttcggcaaagaaccgcgcaaagacgtgaaccctgacgaagccgttgccgtaggcgcagcgatccaaggcgaagtattgagcggcggccgcagcgacgtattgctactggacgtaactcctctgtctttgggtatcgaaaccatgggcggcgtgatgaccaaactgattcagaagaacaccaccatcccgaccaaagcgtcgcaagtgttctctaccgccgaagacaaccaaagcgcagtaaccatccacgtactgcaaggcgaacgcgaacgcgcttctgccaacaaatctttgggtcagttcaacttgggcgacatcgcacctgcaccgcgcggtatgccgcaaatcgaagtaaccttcgacatcgacgccaacggcatcctgcacgtttccgccaaagacaaaggcaccggtaaagcagccaacatcaccatccaaggttcttcaggtttgagcgaagaagaaatcgaacgcatggtgaaagatgccgaagccaatgccgaggaagataaaaaactgactgaattggtcgcttcccgcaaccaagccgaagccctgattcactctgtgaaaaaatctttggccgactacggcgacaaactcgacgcagccgagaaagaaaaaatcgaagccgcgctgaaagaagccgaagaagcagttaaaggcgacgacaaagccgctatcgatgccaaaaccgaggcgctgggcgcagccagccaaaaactgggggaaatggtttacgctcaagcacaagctgaagcccaagcaggcgaaagcgaacaagccaatgcttctgcaaagaaagacgatgatgtcgtagatgccgactttgaagaagtaaaagacgacaaaaaataa

SEQ ID NO: 4611 - DNA, 273 bp, Neisseria meningitidis
atgaagaaaaccggcaaatatcttatctatactgcggcatttaccgcattctgctttgccttccaagaaaaccgttctgaagccaaacagcccgacatcactttatccgcatccctgtgcgaacaattcaacatactgaacgccaaagatatggatgcagaacaagtctccctttccaaagaatgcgacatcatcgagtcttcacacgactgggaaaaagagtacggcaacttgaacgaacaggaaatgctcgccggcatcgtctatgaataa

SEQ ID NO: 4612 - DNA, 687 bp, Neisseria meningitidis
atggaaacctttaaagacagactggtttttttatggaaaagcgaagcgaggcaggcaaaaatcgcatccgatattgaaatgacgattgcgggcttcagcaggatatggaatgaaggcggtctgccaaagtctgaaacattgaaaaaaatcaagcagttgaaggggtgtagtatcgattggctgctgaccggggagggtaatccgtttccggatgaagccccaaaaaaatcccttgcttacgatactttgggcaatgaagtcgatacggacgagtttgtcttcgtgccgagatatgatattcgggcggctgcgggatacgggcagtttgtcgatcatgaggaaccggtatttacaatggcgttcagacggcattggattgagaattatgttacccgcgatacgaaaaacctgtctgtaatttccgtcaagggggattcgatggagggggttttgaatgacggcgattcgattttggtcaatcatggtgaaaatacgccgagggacggtctgtatgtgttgcggattaatgaaaatctgctggttaaacgtttacagattgtaccgggcgggattatcaatgtgatttctgcaaacgaggcttatcctgcttttgaaatcaatttgaacgatttgaccgatgatgtggagattatcgggcgtgtcgagtggttcggcaggacgatttga

SEQ ID NO: 4613 - DNA, 339 bp, Neisseria meningitidis
atgtcggatgaaagccctattatttttactgacagctgctgtgccaaagttgccgatttgattgccgaagaaaacaatcccgatttgaaattgcgggtttttgtcaatggcggcggctgttcgggtttccagtacggatttacttttgacgaaatcaaaaacgacgacgattttgaaattgagaaaaacggtttggtctttttggtcgatccgatgagctatcaatatctggtcggtgcggaaatcgactatacggaaagtttgcagggttcgcaattcgtcatccgcaatccgaatgcggaaacaacctgcggttgcggatcgtcgttttccgtatga

SEQ ID NO: 4614 - DNA, 465 bp, Neisseria meningitidis
atgattgagatgagtaaagattaccgaaacgatttgtacgatgtatatgtttcttacccgccccaagtggatcgcgggcttatccgggagtgccttaaggagaatctcggcgaggaaaaggcggaaggattgatcgaatcgctcgattccaaacctcaagtgctggttgaggaaaaatgcacttgggcgaaacgggaagagttgcatgattatttcagctatttgggtttggatattattacccggagatatatggagttggaaacggtcgtgccgccggaggaaggggagggcgaaggagaaggcgcggatggggaaatgcccgaatatcttgaacttcacggcgggcgggaagatgatatttccgcaccttcgcaacccgaaccgccgtcccgcaatatcaaactgctggttttcgggctgctgattgcctttttgggctatctgctcggtaagattttttga

SEQ ID NO: 4615 - DNA, 1512 bp, Neisseria meningitidis
atgaaatggttgaaacgcctgacggttattgtcgggactttttaccgctatcggctggcaggtctgtgtgcttcgctgatgggtagcggttggatatgcgctctgctgaaaatgatgccgcagtcgtccaaattgaaaaacgaaccgcctgctgtccgtctgcgccttgccttggaaagcctggggccgattttcatcaagttcgggcaggttttgtccacacgccccgatttgattccgcacgattacgccgtcgaactggcaaagctgcaagacaaagtgccgccttttgacgcgcggctttcgcgtgaacaaatcgaaaaatcgttgggtcagtccatcgaaaagctgtatgcggaatttgaaaccgagcccatcgccagcgcgtccatcgcccaagtacacaaagcccgcctgcattcgggcgaacaagtggcggttaaagttttgcgccccaaccttttgcccgtgatcgaacaggatttgtcgctgatgcgctttggtgcaggctgggtcgagcgtctgtttgccgacggcaagcgtctgaagccgcgcgaagtggtggcggagttcgacaaatatctgcacgacgagttggacttgatgcgcgaagccgccaatgccagccagctcggacgcaatttccaaaacagcgatatgctgattgtgccgaaggtgttttacgactactgcaccagcgacgtgctgaccatcgaatggatggacggcacgccggtttccgacatcgccaaactcaaagcagacggcatcgatttgcacaaactcgccgattacggcgtggaaatcttcttcacgcaagtcttccgcgacggctttttccacgcggatatgcaccccggcaatattttggttgccgccgacaaccgctacatcgccctcgatttcggcatcgtcggcacgctgaccgattacgacaaacgttatctcgccatcaacttcctcgccttcttcaaccgcgattaccggcgcgtcgccaccgcccacatcgaatcgggctgggtgcccgccgacacgcgcgcggaagagttggaagcggctgtccgcgccgtgtgcgaaccagtgttcaacaaaccgatttcgcagatttccttcggcttggtgctgatgcgcctgtttgaagtcagccgccgcttcaatgtcgaaatccagccgcagctggtattgctgcaaaaaacgctgctcaacatcgaaggcttgggacggcagcttgatcccgatttggacttgtggaaaaccgccaaaccgtttttggtgaaatggatgaacgggcaggtcggccctaaagccctttggcgcaacctcaaaaacgaagcccccgactgggcgcaaatcatcccttcattgccgcgcaaaatcagtgcgttgattgatgaaaaccgccagcaggaaatgcgtgatgcctatatccatttggtcaaagtgcagcagcggcaaagcctgtggctggctgtgattgcggttgttttgctgctgattttgcttttgaaatag

SEQ ID NO: 4616 - DNA, 819 bp, Neisseria meningitidis
atgaaaaaagaccatttaaacacaaccggtttcgacctctggcacaccatccgcgaagaaaccgcggccgcggtctccgccgaaccgatgctggcaagttttttgcaccaaaccgtgttgcgccacgagtccctcggctccgtccttgcctaccacctttccagcaaactcggcagcccgattatggacgtgcgcgcgctgtttgaaatctaccagcaggcgttgggcagcgacacccaaatcggcaaatgcgtcgaagcagacttaaaagccatctacgaacgcgatcccgcctgcgacgaatattcgctgccgcttttatatttcaaaggcttccacgcgattcaggcacaccgcatcaaccatcggctgtatctcgacgggcgcaaaacgctggcgtatttcctgcaaaaccgtatgtccgaagtattcggcgtggacatccatcccgccgcccgtttcggatacgggctgatgctcgaccacgccaccggctttgttgccggcgaaaccgccgtgttgggcaacaatatttcgattttgcacggcgtaacgctcggcggttcgggcaaagaaggcggcgaccgccaccctaaaatcggcgacggcgtgatgatcggcgcaaacgcctcgatattgggcaatatccgcatcggcagcaatgccaaaatcggggcgggcagcgtcgtggtttcagacgtgccgccgtccatcacggttgtcggcgtacccgccaaacccgtggcgcgatcgctcaaaacaccgtcggcggatatggatcaaaatatccagtttaccgaaatcgactttatgatttga

SEQ ID NO: 4617 - DNA, 579 bp, Neisseria meningitidis
atgagcgaacagacacagcagcaaaacagtgaagaagcggttgaaaatgtggaggcggtggaaaccgtcgagacagtaggaaatgcggacggtgtgcaggaacaggctgccgcagagccggcttatgaggatttgcaggcgcggattgccgagctggaagcgcagttgaaagacgagcagctgcgcgctttggcaaacgagcaaaacctgcgccgccgccaccagcaggaaattgcggatacgcacaagttcgccggacagaagtttgccgtggaaatgctgccggtcaaggattatctggaaatggcgcttttggatcagagcggcaatttcgatgcgctgaaaatgggcgtgcagatgactttgaacgagttgcagaaagcatttgatgctacgcaaatcaaggaaatcaaccctaaagcgggcgataagctcgatccgaatatccatcaggcgatgcaggcggtggcaagcgaacaggagccgaataccgtggtgggtgtgatgaagaagggttatacgctgtccgaccgcgtgttgcgcccggctatggttacggtggcgcagaaggaagcctga

SEQ ID NO: 4618 - DNA, 216 bp, Neisseria meningitidis
atgaaaaccctgctccttaccttcggcatcttcctgaccgtcatcatcggtatggcggtcggctatattttctccaaacgcagcatcaaaggcagttgcggcggcattactgccttgggtatgaaaaaaatgtgcgactgcgacacaccttgcgacaccctgcaaaagaaactggatgaagaaaaacaggcaggcggcatacgggttgaccgttaa

SEQ ID NO: 4619 - DNA, 1056 bp, Neisseria meningitidis; identical to SEQ ID NO: 445

SEQ ID NO: 4620 - DNA, 1218 bp, Neisseria meningitidis
atggagattattttaggtatcgtgatgtttaccgtcatcgttttggttttggcactgatgattctgtttgccaaatccaaactggtcagcgaaggcgacatcaccatcaaagtcaacggcgaaaaagagctgacgatgcccgccggcggcaaactcttgggcgcgcttgccaacgaaggcatctttatcccctccgcctgcggcgggggcggttcgtgcggacaatgccgcgtcgtcgtaaaaagcggcggcggcgacatcctgccgaccgagctgtcccacatcagcaaacgcgaagcacgcgaaggctgccgtctgtcgtgccaagtcaacgtcaaaaccgacatggacatcgaagtccccgaagaagtgttcggcgtgaaaaaatgggaatgcaccgtcatctccaacgataacaaagccacgttcattaaagaactcaagcttgccattcccgaaggcgaagaagtccccttccgcgccggcggctacattcaaattgaagctcctcctcacactgttgcctacaaagacttcgacattcctaaggaatatcacgaagactgggacaaatacaatttgtggcaatacgtttccaaagtggacgagccgattttgcgtgcctactctatggcttcgtatcctgaagaaaaaggcatcattatgctgaacgtgcgtatcgccacgccgcccccgcgcgtacctgatgcgcctccgggacaaatgtcgtcctacatctggtcgctcaaacccggcgacaaagttacgatttccggcccgttcggcgaatttttcgccaaagacaccgatgccgaaatggtatttatcggcggcggtgcgggtatggctccgatgcgttcccacattttcgaccagttgaaacgtttgaactccaaacgtaagattaccttctggtacggcgcacgttccaaacgcgagatgttctatgtcgaagactttgaccaactcgcggcagagttcccgaacttcacgtggcacgtcgccctgtccgacccgctgccggaagacaactgggacggctacacgggcttcattcacaacgtggtttacgaaaaccacctgaaaaaccacgaagcaccggaagactgcgaattttatatgtgcggccctccgattatgaaccagtccgtcatcaaaatgctcaaagacttgggcgtggaagacgaaaacatcctcttggacgatttcggcggttaa

SEQ ID NO: 4621 - DNA, 594 bp, Neisseria meningitidis
atggaacactatttgagcctcttcatcaaatccgtcttcattgaaaatatggcactatccttctttttgggtatgtgcacgtttttggcggtatccaaaaaagtatccaccgcattcggtttgggtgtggcggtaattttcgtactcgggctgtccgtccctgtcaaccaactcgtttactcgctgctcaaagacggcgcgattgccgaaggcgtggatttgacctttttgaaattcatcaccttcatcggcgtgattgccgctttggtgcagattttggaaatgttcttggataaattcgtccccgccctctataacgcattgggcatctacctgccgctgattaccgtgaactgcgcgattttcggcgccgtatcgtttatggcgcaacgcgaatacaacttcggcgagtccgttgtatacggcttcggcgcgggcttgggctggatgttggcgattgtcgctttggcgggcattaccgaaaaaatgaaatattcggacgctcccaaaggcctcaaaggcttgggcattacctttatcgccgccggcctgatggcgatggcgtttatgtcgttctctggcatccagttataa

SEQ ID NO: 4622 - DNA, 627 bp, Neisseria meningitidis
atggctgatatgaaacgcttgaaacatttgatgttttcaccctttatcgacaacaacccgattgccttgcaggttttgggtatttgttcggctttggcggttaccaccaaacttcagacggccatcgtgatgggtatttccgtagctttggtaaccggtttttccagcttcttcatttcgctggtacgcaactacatccccaacagcatccgtattatcgtgcaaatggcgattatcgcgtcgctggttacgctggtcgaccaactcttgcaggcatttgcctacgaattgtccaaacagctttccgtattcgtcggtctgattattaccaactgtatcgtgatgggccgcgccgaagcatttgcgatgaaagagccgccgctggaaagcctgatcgacggcatcggcaacggcgcgggctacgggataatgctgcttgtcgtcgccaccgtccgcgaactgattggctcgggcaaactcttgggctacaccgttttccaaaccgtgcaggacggcggctggtatcagaccaacggcttgttcctgctcgcccccagcgcgttcttcatcatcggctttttgatttggggactgcgtacctggaaacccgaacaggcggaggaataa

SEQ ID NO: 4623 - DNA, 777 bp, Neisseria meningitidis
atggctaagaaattcgataaagacagcttcagcggcacgctgattgtcgtgttggcggtcagcctgatttgctcggtcatcgttgccggtgcggtcgtcggcttgaaacccatccaagagaaacaaaaactccaagacaaacaaggctatatcttgagcgtagccggtttgatggataaggacaccgacatcggtaaaacctttgccgagcgtatcgagcaacgtgttgtcgatttggcgaccggcgaatacgtcgccgatgcgcctaaagacttcagcgcgcgcatcgcaggcaaagaccctgcccaaagcatccgcatcaaaaccgaagacgatttggcaggcatcaaaagccgtgccaaatacaccgaggtttatttggtaaaaggcgaagacggcaaaatcgggcaaatcatcctgcctatgcacggtaacggtttgtggtcggtcatgtacggctttgtcgccatccagcccgacggcaacaccatcaacggcattacctactacgaacaaggcgaaaccccgggcttgggcggcgaaatcggcaatccgttgtggcagcaaaaattcgtcggcaaaaaactgtttgacggacaaggcaaactcgccctgcacgtcggcaaaggcgcgggttcggacaaagaacacggcgtagatgccctctccggcgcatcgctgacatccaaaggcgtgcaaggttcgttcgcctactggttcggcgaaaacggctatatcccctacctgaacaaattgaaatcagcaggagcgcaataa

SEQ ID NO: 4624 - DNA, 1233 bp, Neisseria meningitidis
atgggcttgaaacattttctggaaaaaatcgaaccgcacttcctgccgggcggcaaacatgaaaaatggtatgccctctacgaagctgcggcgacaattttctacacatccggcgcggtaacgcgcaaagcggcgcacgtccgcgacgcgctcgactccaagcgcatgatgattttggtgtggctggctttgttccctgccatgttctacggtatgtacaacgtcggcgcgcaggcattcggtgcgttaacgcctgatttgctgcaacaaaacatcgccaacgactggcattacgcctttgccaacgctttgggcatcaatatgtcgtctgaagcgggcgtgtcggacaaaatgctgtttggcgcgatttacttcctgccgatttacgcgactgtatttgttgtgggcggtttctgggaagttttgttcgccaccgtgcgcaaacacgaaatcaacgaaggtttcttcgttacttcgattctgtttgccttaatcgttccgcccacgctgccgctgtggcaggcggctttgggtatttctttcggcgttgtggttgcgaaagaagtattcggcggtacaggtaaaaacttcatgaaccctgcgctggcaggccgtgctttcctgttcttcgcctaccctgccaacttgagcggcgatgcggtttggacggcggttgacggctattccggcgcaaccgcactggcgcaatgggcggcacacggtgcagacggcctgaaaaacgccgtaaccggtcaaaccatcacttggatggacgcgtttatcggcaaactgcccggctccattggcgaagtctccactttggcactcttaatcggcggcgcgtttatcgtgtttgcccgcatcgcttcttggcgcattattgccggcgtgatgatcggtatgattgcgatgtcttcgctgttcaacttcatcggttcggacaccaacgctatgtttgctatgccttggtactggcacttggtggtcggcggcttcgccatcggtatgctgtttatggcgaccgaccctgtttccgcttcctttaccaatgtcggcaaatggtggtacggcgcactgatcggtgtgatgtgcgtattaatccgcgtggtcaatccggcttaccccgaaggcatgatgttggcgattctgtttgccaacctgtttgccccgattttcgactatttcgtcgcacaagcgaacatcaaacgcagaaaggcgcgcagcaatggctaa

SEQ ID NO: 4625 - DNA, 1344 bp, Neisseria meningitidis; identical to SEQ ID NO: 125

SEQ ID NO: 4626 - DNA, 1422 bp, Neisseria meningitidis
atgcgccacctacccctgttttcactaatgcttttcccagcatcggtttacgccgcagatttggacggcgcaaacctaaacctgctgtggggcctgccctttgccctgattttgctgtctatcgcattgggtcccttgtttttttcgcatacctggcatcaccattacggcaaaattaccgccttttggacattgctcttcctcatcccgttcagtttggtttttggcgcgtccgccggtatccataccgtcgcacacgcactcgttgaagaatacatccctttcatcctgctgctgcttgccctgtacaccatttcaggcggcattttggtttggggcgacttgaacggcacacccaagctcaacaccgccctgcttgccgtcggtacggcacttgcctctatcatgggaacgaccggcgcagcaatgctgatgattcgtccgctgctgaaagccaaccaaaaccgtacccgccgcgtgcacatcgtcatcttcttcattttcctggttgcaaacatcggcggcggtctgacccctttgggcgaccccccactcttcctcggcttcctcaaaggcgtagatttcatgtggacggtcaaacatatgttcgcccccgtcctgatcagcaccgctgtcctgttgaccgccttctatttcatcgacaaccgtttcttcaaacaggaaagcattgcacaagatacgccggcacaacaggaaaaacccgaaaaaatcgccatcttcggcaaatggaacttcctcctgctttcgggcgtggtcggcgcggttctaatgtccggcctttggaaacccgaacacccgggatttgaaatcctcggcagccgttacgccctgcaaaacctcgtccgcgatgtcatcctgattgcattgaccgccgtatctatggcaatcacgcccaaacaagtccgcgcaggcaacgaattcaactttgaacccatcgccgaagtgggcaaactcttcctcggcatcttcatcaccatctttcccgtcctgagcattctgaaagcaggcgaggcaggcgcgctgggcggggtggtatcgctggttcacgatacggcaggtcatccgattaatgtgatgtatttttggatgagcggcatattgtcggcattcttggataacgcgcccacttatctcgtttttttcaatatggcgggcggcgatgcccaagccttgatgacgggtaccctgtttcattcgctgctggcggtttctatgggttcggtattcatgggcgcactgacctacatcggcaacgcaccgaacttcatggtcaaggccattgccgaacagcgcggcgtaccgatgccgactttcttcggctatatgatgtggtcggtcgccttcctgacacccgtcttcatcgtacatacccttatctttttcgttttcaaactgctgtaa

SEQ ID NO: 4627 - DNA, 360 bp, Neisseria meningitidis; identical to SEQ ID NO: 2981

SEQ ID NO: 4628 - DNA, 606 bp, Neisseria meningitidis
atgacaataatgaatatcaatacttccgaaaataaagatgctgttgccgaacacaccggacaatggttggaaaaagccgtcatcggtctgaacctgtgtccctttgccaaagccccccacgttaaaaaccttgtccgcatcgcgatcagcgaagccaaacaccttgacggttttttggaagacttggacgaagaactgcagcgactgggcaatacacccgccaccgaactggaaaccaccctgctggttcacccgaccctattccccgatttcgacgtattcaacgatatgctcgacattgccgatgccgccgttgtcgaaaacggcttagaaggcatcgtccaaatcgccccgtttcatcccgatttccaatttgaaggcacggattcagacgacattggcaactacaccaaccgttctccctatccgacgctgcacctcatccgcgaagacagcattgccaaagccgcacaagcctttcccgacgcttcggcaatattcgaacgcaatatcgccctgctggaaaaaatgggacatgaaggctgggcaaaactcggtatcacatcctgcccttatccgcacaataagaaaaatatttcaaaatga

SEQ ID NO: 4629 - DNA, 564 bp, Neisseria meningitidis
atgttaatatggtctccatctgtgcggattgccgcaaacatacggacagacaatccgaattccttaaaacggaacgcaaatatgccccaactcactttagacaaaaccgatattaaaatcttacaggttctccaggaaaacggcaggctgaccaatgtcgaactgtccgaacgtgtcgcactttcgccttctccgtgcctgcgccgtctgaagcagttggaagatgccggtatcgtccgccaatatgccgcgctgctgtctccggaatctgtcaacttgggacttcaggcatttatccgcgtttccatccgcaaagcaaaagacgcgcgggaagactttgccgcatcggttcgaaaatggcctgaagtcttgagctgcttcgccctgacaggggaaaccgactacctgcttcaggcgttttttaccgatatgaacgcgttttcccattttgttttggatacgctcctgtcccaccacggcgtacaagatgcgcaatcgagctttgttttaaaagaaatcaaacacaccacctccctgccgctcaaccacctgctgaaggaatag

SEQ ID NO: 4630 - DNA, 1101 bp, Neisseria meningitidis
atgactgctctgaaaaccaccccatttcatcaagcccatcaagatgcaggcgcgaagctggtcgattttgccggctgggagctgcccatccattatggttcacaaatcgccgaacacgaagccgtgcgcaccgacgccggtatgtttgacgtatcccatatgctcgttaccgacgtagcaggcgcaaatgccaaagcctttttccgcaaattgattgccaacgatgtcgccaagctcgcttttgtcggcaaagccctttattccgctttgctcaacgacaacggcggtgtgattgacgacttaatcgtttaccgcaccaatgaagccgaaacccaataccgcatcgtgtccaacggcgcgacccgcgaaaaagacacggcgcaattccacaaagtcggacaagagttcggcgtcgccttcaatccgcgctacgacctcggcatgctcgccgtacaaggccctaaagccattgaaaaactcctgaccgtcaaacccgaatgggcagatgtcgtccataacctcaaaccgttccaaggcgcggatttgggcaacgactggtttgtcgcccgcaccggctacaccggcgaagacggcgtcgaagtcatcctgcccggcaccgaagccgtcgcattcttcaaagccctgcaacaagccggcgtacagccctgcggcctcggcgcgcgcgacaccctgcgcatggaagccggcatgaacctctacggcaacgatatggacgacgacaccagcccgctcgaagcaggtatgggttggaccgttgacttgaaagacgaaagccgcgacttcgtcggcaaagccgccttgctggcattgaaagaaaaaggcgttgccgtcaaacaggtcggcctgttgctcgaaaaaggcggcatcctgcgcgcgcatatggaagtgttgaccgacaaaggccaaggcgaaaccaccagcggcgtattctccccaagcctgaaacaatccatcgccatcgcgcgcgtaccgaaagattttgacggcgataccgccaaagtgctgatgcgtggcaaagaagtggacgtgcgtgtactgaagctgccgtttgtccgcaacggacagaaacagtttgattga

SEQ ID NO: 4631 - DNA, 387 bp, Neisseria meningitidis
atgagcaacaacatcccggccgaactgaaatacgttgccagccatgaatggctgcgccttgaagaagacggtacgattaccgtcggcattacccaccacgcgcaagagctgttgggcgacatcgtgttcgtcgagctgcccgaagtcggcgcgaaccttgccgctgaagagcaagccggtgtggttgagtctgtaaaagccgcgtccgacgtgtacgcaccgattgcaggcgaagtcgttgccgtcaacgaagatttgccaagcgctccggaaactgccaacagcgatccttacggtgcaggctggttcttcaaactcaaaccggcaaacgttgccgattacgacagtctgctgactgccgaacaatacgcgggcgaagtggattaa

SEQ ID NO: 4632 - DNA, 1248 bp, Neisseria meningitidis; identical to SEQ ID NO: 2975

SEQ ID NO: 4633 - DNA, 573 bp, Neisseria meningitidis
atgattcatataatatcaatattaaagagtatcggtatatcggggatagtcatgtcctgtttttcaatcaaacgtatgtccgcgtttcgggcgcggataacggcgttttttgccgcctttgtctttttgacggcggcactgcccgcttatgcggagcgtctgcctgattttctggcgaaaatacagccttcggaaatttttccgggtgcggaccgttacggcaagccggaaggtaagcctatggttgcccgcgtttacaaaggcgatgagcagttgggcttggtctatatcacgaccgatgcggtcaatacgcgcggttattcgagcaaaccgattgatacgctgatggtgttggcaaacgacggcacgatagccggggcgaaactggtcgaccatcacgaaccgattatgctgatcggtatcccgcatttgcccgcgcccgggcgggcgatacgctcaaactggcttccggcgtatataaaaccaaacttcacattgacaaaccgattacgattgaagggcctgccgaccgttccgcaaccatcgaaggcgacaggagcgggcgtaccatag

SEQ ID NO: 4634 - DNA, 1035 bp, Neisseria meningitidis; identical to SEQ ID NO: 3029

SEQ ID NO: 4635 - DNA, 621 bp, Neisseria meningitidis
atgaccacacatcatgtcgaattgaggaaggtaaccaaacggttcggggcgcaaaaagccgtcaaccaagtcgatttggttttgaaggcaggagaaagcgtcgggcttgccggacacaacggcgcgggcaagtccaccattatgaagctgatactcgggctgattaccccgaccgaaggcgaagtgatgcttttgggcgaacgtaccggtagcaaagcgggggcgcggcttcgcagccaaatcggctacctgcccgaaaccgttgcgctgcacccttcgctgatcggcatcgaaacgctggatttttatgccaaacttaaaaaacagccgctcacgcagaaccgggggctgcttgagcgcgtcggcatttcacaggcggcacaccgccgcgtcggcacttattctaaagggatgcgccaacgccttgccttggcacaagccctgctgggcgagcccaaagtcctgctgtttgacgaaccgacaaccggtcttgaccctgcatcacgacaaatgttttacgaagtcgtgcgcgaactcaacgggcgcggcgcgaccgtattgctcagcacccacgcccttgccgagttggacgggcacgccgaccgcattatcgtggattaa

SEQ ID NO: 4636 - DNA, 495 bp, Neisseria meningitidis; identical to SEQ ID NO: 2969

SEQ ID NO: 4637 - DNA, 1662 bp, Neisseria meningitidis
atgacagaatccatcacccgcgacagtatgcaatacgatgtcgtgattgtcggcgcaggcccgtcgggtttgtctgccgccatcaaactcaagcagcttgccgaacaaaacgggcgcgaaatcagcgtttgcgtggtggagaaaggttcggaggtgggggcgcattcgctggctggcgcagttatcgatccgattgcgctgaatgagttgatttccgactggaaagaaaaaggcgcaccgctgacacgcacagtaacgcaggacaaagtgttgttcctgaccgagaaaaaagcgttcaacctgccgattaccccgaatttcgacaatcacggcaactacatcgtcagcttgggcgaagtcgtgcgctggttggcggagcaggcggaaaatatgggcgtggaaatctatccgggctttgccgccgccgaagtgctgtatcacgaagacggttcggtcaaaggcattgcaaccggcaatatgggcattggcaaagacggcgagccgaccgattcattccaacccggcatggagctttgggcgcagcaaaccctgtttgccgaaggttgtcgcggttcgctttccaaacaaatcatcgaacgtttccaactcgaccaaaacagccagccgcaaacttacggcttgggcattaaagaagtttgggaagtgccgtccgaacagcatcagcccggtttggtggtgcacagcgcaggctggccgctggacagcaaaacctacggcggcgcgtttgtttaccatttcgacgacaacaaagtcgccgtcggcttcgtggtcggtttggactatcaaaatccttatctgtcgccgtttgaagagttccaacgtttcaaaacccatcccgaaatccgcaaaacctttgaaggcggccgccgcattgcttacggcgcgcgttcgctgattgaaggcggtttgcaaagtttgccgaagctctcgttcaaaggcggcattttggtcggcgatgcggcgggtttcctcaatatgccgcgcatcaaaggcattcataccgcgatgaaatccgccatgctcgccgccgaagccgtgttccccttgttggaaaaccttgaagaagtggagggtttcgacagcggcaaagaggcggcggattatcagcaacgttttgaacaaagctggctgtatcaagagctttacgccgcgcgcaatgtccgtccgtcattcaaatggggcgtttacctcggctcaatctacaccggcatcgatcagatgattttcagaggcaaagccccgtggaccttgaaacatcacggcaaagacaacgagcagcttaaaaaagccgccgcgtgtaagccgattgattatccgaaacccgacggcgtgttgaccttcgaccgcttgagcagcgtcttccttgccaatctcgcgcacgaagaaaaccagcccgaccatttggtgctgaacaatccgcaaacgatgatagacgtgaactacaaagaatacgcctcgcccgaaacgcgctattgtccggccggcgtgtacgaaattgttgaagaaaacggcaatccgcgcctgcaaatcaacgcggcaaactgcgtgcactgcaaaacctgcgacatcaaagacccgacgcaaaacatcacttggatttgccccgaaggcgcgagcgggccgaattacggcgggatgtga

SEQ ID NO: 4638 - DNA, 543 bp, Neisseria meningitidis
gtgcagagttggaaagaaaggcgcgatttcaatattgtaaagcaggatttggatttttcctgcggggcggcttcggtggtgacgcttttgaacaatttttacgggcaaaagctgacggaagaggacgtgttaaaaaaactggataaggagcagatgcccgcgtcgtttgaggatatgcggcgcattatgcctgatttgggttttgaagcgaaaggctatgccctgtctttcgagcagcttgcacagttgcaaatccccgtcatcgtgtatctgaaataccgcaaggatgatcatttctcggtattgcgcggtatagacggcaatacggttttgcttgccgacccgtcgctgggtcatgtttcaatgagcagggcgcagtttttggatgcttggcaaacccgtgagggaaatttggcaggtaagattttggcggttgtgccgaaagggagggatgccggcggggataaggcgtttttcacacgcagtccgaaacgtcagacggagtttgcggtcggacaggtaaaatggtggcgtgcttattga

SEQ ID NO: 4639 - DNA, 669 bp, Neisseria meningitidis
atgttaccctcgaaatatgaagataacgcactgcaaattaaagaaaaaagtacagaaagaactgctccgttttttgtactggaagttaccgcccgttctgccgccgatattttgggtatccatcccaattcggcagcactgttctaccgtaaaatccgcacggttatcaaccatcatttggccttggctgccgatgaggtttttgagggccctgtcgagccggacgaaagcgatttcggcggacggcgtaaaggcagacgtggtcgcggtgcggcaggaaaagtggttgttttcggcattctgaaacgcaacggacgggtctataccgttgtggtggataatgccaagtctgaaacgttactccctgtcatcaaaaagaaaatcatgccggatagtattgtttataccgatagtctgagcagctacgacaagttggacgtgagcggttttatccattaccgcatcaaccattccaaggagtgtgcagaccgtcagaaccacattaacggcattgagaacttttggaatcaggcaaaacgcgtcttgcgaaaatacaacggaatcgatcgtaaatctttcccgctgttcttgaaagaatgcgaatttcgatttaacttcggcacaccgtctcaacagcttaaaatcctgcgggattggtgtggaatttag

SEQ ID NO: 4640 - DNA, 816 bp, Neisseria meningitidis
atgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggttcttgagccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataa

SEQ ID NO: 4641 - DNA, 3909 bp, Neisseria meningitidis
atgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggtgtggaaaacctatgggatgatacggtcggtaaaaagacccgtttagagaaatttgatcgggttgcattgcaacatttcagccaatatgtagatctaattaatgaaaataatggtagattacctaacactagtgaaattgagagaagttactataaagccgttaccgaaaatggtgtttcttctagtgcagctattgatttagttattaatcgctcacttccggatatggcagatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgataatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaatttagagatctgttcccaaatccggaaggctggatcgatgatggtcaccaatgtttcgctccttgggttaaagaaactaaaaaacgcaatggcaaatatcatgtctacgacccccttgccctagatttggacggagacggcatagaaactgtcgctgccaaaggcttttcaggcagcttatttgatcacaccaacaacggtatccgcaccgccaccggttgggtttctgccgatgacggtctgcttgtgcgcgatttgaacggcaacggcatcatcgacaacggtgcggaactcttcggcgacaataccaaactggcagacggttcttttgccaaacacggctacgcggctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcaaagacaaagtggaactcactgccgaacaggcaaaagccgccaatcttgcgggcattggccgtctgcgcgatttgcgcgaagctgccgcattgtccggcgatttggccaatatgctgaaagcttattctgccgccgaaactaaagaagcacagttggcattgttagataatttgattcacaaatgggcggaaaccgattcgaactggggcaaaaaatcgccaatgcgactttcaaccgattggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcctacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaactaatccgcaaaaagcttttgtggatttggccgagatgcttgcatatggcgaacttcgttcttggtatgaaggccgaagactaatgaccgattatgtggaggaggcaaaaaaagcaggtaaatttgaagattaccagaaagtgttgggtcaggagaccgttgcattattagctaaaacatcgggtacgcaagcagatgatatcctgcaaaatgtaggctttggtcataataaaaatgtttctttatatggtaatgacggcaacgacactctaatcggcggcgccggtaatgactatttggagggcggcagcggttcggatacttatgtcttcggcgaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgcaggcaatgattacttggagggcggcagcggttcggatacttatgtcttcggcgaaggcttcggtcaggatacggtctataattaccatgtggataaaaactctgacactatgcactttaaaggatttaaagcagcagatgttcattttatccgttccggaagtgatttggtgcttagcgcttctgaacaagacaacgtacgtatttccggatttttctatggtgaaaaccatcgtgtagatacatttgtctttgatgatgcagctatcagtaatccagattttgccaagtatattaatgctggcaataatttggtacagtctatgtctgtgttcggttctaatactgctgcgacaggaggaaatgtggatgccaatatacaatccgtacagcagccgttattggtaacgccatctgcataa

SEQ ID NO: 4642 - DNA, 915 bp, Neisseria meningitidis; identical to SEQ ID NO: 2135

SEQ ID NO: 4643 - DNA, 876 bp, Neisseria meningitidis
atgaatctctacgacctgctccttgccccctttgcagaattcgactttatgcgctacgccctcgcatccgtcttctgcctgtccctcagtgccgcacccgtcggcgtattcctcgtcatgcgccgtatgagcctgataggcgacgcattgagccacgccgtcctgcccggtgccgccgtcggctacatgtttgccggcttgagcctgcccgccatgggtttgggcggcgtagccgcaggcatgctgatggcactgcttgccggactcgtcagccgcttcaccaccctgaaagaagatgccaactttgccgccttttatctcagcagcctcgccatcggcgtagtcctcgtcagcaaaaacgggagcagcgtcgatttgctccacctccttttcggctctgtacttgccgtcgatattcctgccctgcagctcatcgccgccgtctccagcctcacgctcattacccttgccgtcatctaccgcccgctcgtactcgaaagcatcgaccccctgtttctcaaatccgtcggcggcaaaggcgggctttggcacgtcctctttctcgtcctggtcgtcatgaacctcgtatccggctttcaagccctcggcacactcatgtccgtcggactcatgatgctgccagccattaccgcccgcctgtgggcgaagcatatgggcgcactcatcctcctatccgttctgacagccctgctgtgcggcttgagcggactgctcatttcctaccacatcgaaattccttccggtcccgccatcatcctctgttgcagcgtcctttatctcttttccgtcatactcggcaaagaaggcggcattctgaccaaatggctcaaaaaccaccgccaccacaccacctga

SEQ ID NO: 4644 - DNA, 756 bp, Neisseria meningitidis
atggggcgtttacttttgggcagtatccgcatgagcatcattgtcgaaaacctgaccgtcagctaccgccgccgacctgccgtgcaccatgtggacattacttttgaagaacatagtatgtgggcggttttcggtcccaacggcgcagggaaatccacctttctcaaatccttgatgggattgcagcctatcgatacaggcagcatccggctggacggattgacccgtcagaacatcgcctaccttccccagcagtccgatatcgaccgctcccagcctatgaccgttttcgacttggcggcaatggggctatggtatgaaatcggctttttcaaagggataaataccgctcaaaaacaacgcgttcacgaagccttggagcgcgtcggaatgcaacggtttgccgaccgtcagattgcctatctctcaaacggacaatttcagcgtgtcctttttgcccgaatgctggttcaaaatgccaaattcctgctgctcgacgaacccttcaatgccgttgatgcacggacaacctacgagcttctcgacgtattgcagaaatgccattgcggcggacacgccatcatcgccgtactgcacgattacgaacaagtccgtgcctactttcccaataccctgctgctcgcccgcgaaaaaattgcggcaggcgcaaccgagaccattctgacagaaccctacctcgcccaagccaacgccaaaatgcagcaacaggaaagccccgactggtgcgcctcataa

SEQ ID NO: 4645 - DNA, 366 bp, Neisseria meningitidis
atgaacctgattcaacagctcgagcaagaagaaattgcccgcctgaataaagaaatccccgaattcgcaccgggcgacaccgtagtcgtatccgtacgcgtcgtggaaggtacccgcagccgtctgcaagcctacgaaggcgtggttattgcccgtcgcaaccgtggtctgaacagcaacttcatcgtccgcaaaatctccagcggcgaaggtgttgaacgtactttccaactgtactctccgaccgtcgaaaaaatcgaagtcaaacgccgtggcgacgtacgccgtgccaaactgtactacctgcgcggcctgaccggtaaagctgcacgcatcaaagaaaaactgcctgcacgcaaaggttga

SEQ ID NO: 4646 - DNA, 750 bp, Neisseria meningitidis
atgcttatccaggcagttaccattttccccgaaatgttcgacagcattacccgctacggcgtaacgggacgcgcgaacagacagggaatctggcagtttgaagcagtcaatccccgaaagtttgccgacaacagattgggctacatcgacgaccgcccgttcggcggcggcccgggaatgattatgatggctccgccgcttcatgcggcaatagaacacgccaaaacacaatcctcccaagctgcaaaagtcatctacctcagcccccaagggaaaccgctgacacaccaaaaagcggtagaactggcagaacttccgcatctgattctgctgtgcggacggtatgagggcatagacgaaaggcttctgcaaagcagcgtcgatgaagaaatcagcatcggagacttcgttgtttccggcggagagcttcccgccatgatgctgatggatgcggtattgaggctcgtacccggcgtattgggcgatatgcagtctgccgaacaggattcgttctcaagcggcattttggactgcccccactacaccaaacccttagaatttcaaggtatggctgttccggaagtattgcgttccggcaatcatggcttgatagcggaatggcggttggaacaatcgctgcgccgcaccttggagcgcagacccgatcttttggaaaagcgcgttttaatcccaaaggaatcccgcctcttagaaaccatccggcaagagcaacgggaaatccaatcataa

SEQ ID NO: 4647 - DNA, 510 bp, Neisseria meningitidis
atgacagacactcaaaaccgggtagccatgggctacatcaaaggcgtattcggcataaaaggctggttgaaaattgccgccaacaccgaatattccgacagccttttggactaccccgagtggcatttggtcaaggacggcaaaaccatcagcgttacccttgaagccggaaaagtcgtcaacggcgaactccaagtcaaattcgaaggcataaacgaccgcgacttggcattctcattgcgcggttacaccatcgaaataccccgtgaagcattcgccccgacagaagaagacgaatactactggacagacttggtcggcatgaccgttgtcaacaaagaccataccgttttaggcaaggtaagcaacctgatggaaaccggcgcaaacgacgtattgatgattgacggagaacacgggcagattctgattccgttcgtttcccaatatatcgaaaccgtcgataccggcagcaagaccattactgccgactggggtttggactactga

SEQ ID NO: 4648 - DNA, 246 bp, Neisseria meningitidis
atggtagttatccgtttggcacgcggcggctcgaaacaccgccccttctacaacgtcatcgttactgactcacgcagccgccgcgacggccgcttcatcgaacgcgtaggcttctacaaccccgtagccaacgaaaaacaagagcgcgtccgcctcaatgcagaccgcctgaaccactggattgcacaaggcgcgcaagtcagcgactccgttgcaaaactgattaaagaacaaaaagccgcctaa

SEQ ID NO: 4649 - DNA, 2427 bp, Neisseria meningitidis
atgtcggcacaaaccgatccgggctacttcttcatgcccaaccacatcatcctgataggcgcgagcgaacaaccgtacagcctgggcgaacgtgtactcagcaacctgctgagtacgccctttcaaggaaaaatcacccccgtaaacccgcgccaccacaccatagccggactgcccgcctacaccagcctcaacaaaatccccggcaatgcagacctgattattgccgttaccctacccgacagttacgacaccctcttcaaaacctgccgcaaaaagcagctccgacacatcatcctcatacaggactgggacaacctgtctgccgcagaactgcacaccgccgaaactgccatccgcaaacaccacggcaacggactcaacatcaccgcctgcaccaccgcaggcatccaactgccctcactcggactcaacatcagtacccaagacggatacgccgcaggccataccgccatactgaccggcaatgccgccgtcagccgccaaatcgacaacatcctgaacaaactccgtcaaggcacatcccgccacatcagcctgcatcccggcatcagccccatcacatccgccgattggctcaaccgcttcggacacagcctgcacaccaaaaccgccgtcctacaccacaaccctgaagaggatcagcgcaaactgttcagcgcaatccgccaatttacccgccatacgccgctgattctccacatcacctgccgcacgacagaaaccgaccgtgccgtactgcactgcctcgcccgacactgcaacttcctcgtcagtttcaacgccgacgacctcgaagccgcactgcgcgcccaactgtccgaccttccacccctgtcccgactcgacatcctgtccgacacgcctgccgaatggctgcacgcgcacgcgccaaaaaacctcaccctccactttcccaaccttccccaccacatccgcaacggacacctgaccggcacacccacaccctcaatctgccacgacatcgcctcacgtcagcttgcccaccccgacacccaagccgtcctaaccatcctcagtccctccggacacgaggattacaaaaaaacagcacgcgcccttatccgcctgtccgaacagaccgccaaacccctgctcgtcagcagccccttttcagacggcataacccatttcgacacccccactcaggcaatccgcaccctttcctaccgcaacaccgccgccgccctgaaacaggcacagctcgacattgcaccgccgcagccatgccgtctgaaaacaccgcaaccccaaaacatcaaaaaagcccttgcagcggcaaacccctccctgctcgccgaagccctgcacctccccccctaccggcacaccacccataacgccgtacaattccaattcgacagccaccccctctatggcgacatcctgaccgcacgctgcaacggacaaaccactgccgtactcccgccgtttaccacgctcgacagccgccaccttgcccgctttgccgaactcgacggcacacaaaccctcgaccagttcctgcacacactgaccgtcattcccgaataccgccaacacattctcggcatcaccctcaacctcaacggcggacaatacagcagcgatttcctcttaaagacacccgaaacacacgacacgcccaaacgcaagaacacaggcaaagccgcccaaaccctcgaacatgccgccgcaaaaatgcagagtgccgccgcatacctgaaacacaaaaacccgacagccgccgaatttctccgccacacaagcgaagccgccgcagaactgctcggcagcaaaaccgaaaccggagcagccgtacccaacgtacttgccccctatcccgcagcataccccaaaacactgtccctaagaaacaacacgaccgttaccattacccccattttgcccgaagacgcagaagccaaacagcagttcgtccgcagcctcggtcccgaagcacggtacacacgcttcatgacccacaccaacgaactgcccgcagccacgttggcacgcctgtgcaaccccgattaccactgtgaagccgcatggacggcaaaggatgccgacagcaacatcgtcgccgtcgtccgccacagccgcctgaatcgcaacgaatgcgaattcggcatcacactggcggaacatatgcgcggcagcggactggcacagaaaatgatggaactcatcatccaaaccgccgcacagcaaggctaccggactatgagtgccgacattctcaaaaccaatacccccatgatcaaacttgctgaaaaatcaggatttaccctcaaggaatcggacaccgaaaaaaacctgtaccgcgcatatctgaaccttgcggcagacaaaacaacagaaaaaacaaataaaaacttgcgcaccgaccacaaaataacctaa

SEQ ID NO: 4650 - DNA, 1407 bp, Neisseria meningitidis; identical to SEQ ID NO: 2787

SEQ ID NO: 4651 - DNA, 678 bp, Neisseria meningitidis
atgagccgcgtattactcgtagatgacgatgccctgctaaccgaactgctgaccgaatacctgagcgccgaaggtctgaacgtccgcagcgttcccgacggggaagcaggcgtacaggaaatcctgagcgggcagtacgatgtagtcgtattggattccatgatgcccaaaatgaacggcttggatgtcttgaaaaacgtacgcgcccgaagcaccgtccccatcatcatgctgaccgccaaaggcgacgacatcgaccgaatcatcggcttggaaatgggcgcggacgactatgtccccaaaccctgcacaccacgcgaactcttggcacgcatcaatgccatcctgcgccgcgcacaacacagcggcgaacagaacaacgcacccaacagcatctccgtcagcgatgtcgtcctgtaccccgccaaacgccaggcatccgtcaaagacatgccgctcgaactgaccagcaccgaattcaacctgctcgaagtcctgatgcgccatgccggacaggtagtcagcaaagaaaccctgtccgtcgaagcactcgaccgcaagctggcaaaattcgaccgcagtatcgacgtacacatctccagcatccgccacaagttgggcgatgcctctctgattcaaaccgtacgcggcttgggctacctgtttgtcaaaaactga

SEQ ID NO: 4652 - DNA, 1815 bp, Neisseria meningitidis
atgcccgctgaaacgaccgtatccggcgcgcaccccgccgccaaactgccgatttacatcctgccctgcttcctttggataggcatcgtcccctttaccttcgcgctcaaactgaaaccgtcgcccgacttttaccacgatgccgccgccgcagccggcctgattgtcctgttgttcctcacggcaggaaaaaaactgtttgatgtcaaaatccccgccatcagcttccttctgtttgcaatggcggcgttttggtatcttcaggcacgcctgatgaacctgatttaccccggtatgaacgacatcgtctcttggattttcatcttgctcgccgtcagcgcgtgggcctgccggagcttggtcgcacacttcggacaagaacgcatcgtgaccctgtttgcctggtcgctgcttatcggctccctgcttcaatcctgcatcgtcgtcatccagtttgccggctgggaagacacccctctgtttcaaaacatcatcgtttacagcgggcaaggcgtaatcggacacatcgggcagcgcaacaacctcggacactacctcatgtggggcatactcgccgccgcctacctcaacggacaacgaaaaatccccgccgccctcggcgtaatctgcctgattatgcagaccgccgttttaggtttggtcaactcgcgcaccatcttgacctacatagccgccatcgccctcatccttcccttctggtatttccgttcggacaaatccaacaggcggacgatgctcggcatagccgcagccgtattccttaccgcgctgttccaattttccatgaacaccattctggaaacctttactggcatccgctacgaaactgccgtcgaacgcgtcgccaacggcggtttcacagacttgccgcgccaaatcgaatggaataaagcccttgccgccttccagtccgccccgatattcgggcacggctggaacagttttgcccaacaaaccttcctcatcaatgccgaacagcacaacatatacgacaacctcctcagcaacttgttcacccattcccacaacatcgtcctccaactccttgcagagatgggaatcagcggcacgcttctggttgccgcaaccctgctgacgggcattgccgggctgcttaaacgccccctgacccccgcatcgcttttcctaatctgcacgcttgccgtcagtatgtgccacagtatgctcgaatatcctttgtggtatgtctatttcctcatccctttcggactgatgctcttcctgtcccccgcagaggcttcagacggcatcgccttcaaaaaagccgccaatctcggcatactgaccgcctccgccgccatattcgcaggattgctgcacttggactggacatacacccggctggttaacgccttttcccccgccactgacgacagtgccaaaaccctcaaccggaaaatcaacgagttgcgctatatttccgcaaacagtccgatgctgtccttttatgccgacttctccctcgtaaacttcgccctgccggaataccccgaaacccagacttgggcggaagaagcaaccctcaaatcactaaaataccgcccccactccgccacctaccgcatcgccctctacctgatgcggcaaggcaaagttgcagaagcaaaacaatggatgcgggcgacacagtcctattacccctacctgatgccccgatacgccgacgaaatccgcaaactgcccgtatgggcgccgctgctacccgaactgctcaaagactgcaaagccttcgccgccgcgcccggtcatccggaagcaaaaccctgcaaatga

SEQ ID NO: 4653 - DNA, 354 bp, Neisseria meningitidis
gtgaacagacaaaccgcttacctccttgcctctttcagcctgatcgcactgataatcctgtccctttcctgggaactgtggattgcaccgttgcgcccgggcggctcgtggctcgcgctcaaagccctccccctctgtctgccgctttcaggcatcttgaaaaagaaaatctatacttaccaatacagctccatgctggttctgatttactttgccgaagccgtcatgcgcctgttcgacgcctatcccgcagaacagatttgcgccgcgctttccgcagtattcagcatcatcttcttcatatcctgcctgtcgttcgtcaaacaatacaaggaaacaaacaatgcccgctga

SEQ ID NO: 4654 - DNA, 609 bp, Neisseria meningitidis
ttgaataccctctatttaggttcaaacagcccgcgccgaatggaaatcctgacacagttgggctaccgcgtcatccaactgcctgccggcatcgacgaatccgttaaagccggcgaaacacctttcgcttacgttcaaaggatggcagaagaaaaaaaccgaaccgccctgaccctcttttgcgaaaccaacggcacaatgcccgatttccccctgattaccgccgacacctgcgtcgtttcagacggcatcatattgggcaaaccccgctcccaagccgaagcaatcgaatttttaaaccgattgtccggcaaacaacataccgtcctgactgctgtctgcattcattatcgcggcaaaacgtcaagccgcgtccaaaccaaccgcgtcgttttcaagcccctgagttcggaagaaatttccgcctatgtgcaaagcggcgagccgatggacaaagccggtgcctacgccgtacaaggcataggcggcatctttatccaatctatcgaaggcagcttcagcggcattatgggactgcccgtttatgaaaccgtttcgatgttgcaggatttgggataccgctcccccttgtccgcccttaaaccgtaa

SEQ ID NO: 4655 - DNA, 771 bp, Neisseria meningitidis
gtgtccgaaacacaaaacgaacaacccgtccaaccgcttgtcgagcatctcatcgagctgcgccgccgcctgatgtggacggttgtcggcatcttagtctgctttttcggcctaatgccgtttgcccaacaactctatacttttatcgccgacccgctgatggcaaacctgcccaaagacaccagcatgattgccaccgatgtcatcgcaccatttttcgtgccggtcaaagttaccctgatggcggcatttttaatttcgctgccgcatacgctctaccaaatctgggcatttgtcgcgcccgcactctaccaaaacgaaaaacgcctgattacgccgctcgtcctctccagcgtcagcctgtttttcatcggcatggcatttgcctactttttggttttccccgtcattttcaaattccttgccagcgttacccctgtcggtgtcaatatggcgacagacatcgacaaatacctctccttcatcttggggatgtttgttgcgttcggcacaacgtttgaagtccccattgtcgttatcctgttaaccaaaattggtgtggtaacaaccggacagctcaaacgcgcccgcccctatgtgattgtcggcgcgtttgtcattgccgccatcatcacgccgcccgatgtgatttcacaaaccctgcttgccattccgctgattctcttatacgaagcaggtatttggttcggacgctttttcacgccacgttcagaacaggatggcgacatacggccgcctgcaacaacctga

SEQ ID NO: 4656 - DNA, 687 bp, Neisseria meningitidis; identical to SEQ ID NO: 69

SEQ ID NO: 4657 - DNA, 204 bp, Neisseria meningitidis
atgggcagtttttctctgacgcactggattatcgtactgattatcgtcgttttgatattcggcaccaaaaaactgcgcaacgtcggcaaagacctcggcggtgcggttcatgacttcaaacaggggctgaacgaaggtacagacggcaaagaagcccaaaaagacgatgtaatcgaacacaaaaaagacgaagacaaagcgtaa

SEQ ID NO: 4658 - DNA, 324 bp, Neisseria meningitidis
atggacaactgtattttctgcaaaatcgccgccaaagacattccggcgcaaaccgtctatgaagacggcgaaatggtttgtttcaaagacatcaaccccgctgctccggttcatctgctgctgattcccaaagtccatttcgattcgttggcacacgccgcgcccgaacatcagatgctgctgggcaaaatgatgttgaaagttcccgaaatcgccaaagcggcaggactggcagacggcttcaaaaccctgatcaataccggaaaaggcggcggacaagaggtcttccacctgcatatacacatcatgggtacacccgtataa

SEQ ID NO: 4659 - DNA, 324 bp, Neisseria meningitidis
atgggagattccgtactatccgccatccaacaaaccatcacccagcgaaaatctgccaatccgtccgaatcttacgtcgcacagctcttgcataagggcgaagacaaaatcctaaaaaaagtgattgaagaggcgggcgaagtgttgatggcatccaaagacaaaaacccgtcccacctggtttacgaagttgccgacttatggtttcacaccatgattcttctgacacaccacgacctgaaggcggaagacgtattggacgaacttgcgcgccgtcaggggctgtcggggctggtcgaaaaagccgctcgcacagaatcttga

SEQ ID NO: 4660 - DNA, 1065 bp, Neisseria meningitidis
atgaaagcagcacgtttttacgacaaaggcgacatccgcatcgaagacatccccgaaccgaccgtcgcccccggcactgtcggcatcaatgtcgcctggtgcggcatctgcggtactgacctgcacgaattcatggaaggcccgattttcattccgccttgcggtcatccgcacccgatttccggcgagtccgcacccgtaacgatgggacacgagttctccggcgtggtctatgccgtcggcgaaggcgtggacgacatcaaagtcggccaacacgtcgtggtcgaaccctacatcatccgcgatgacgtaccgaccggagaaggcagcaactaccacctctccaaagatatgaactttatcggcttgggcggctgcggcggcggtctgtccgaaaaaatcgccgtcaaacgccgttgggtgcatccgatttccgacaaaatcccgttggatcaagccgctttgatcgaaccgctgtctgtcggacaccacgcctatgtacgcagcggcgcgaaagaaggcgacgtcgcattggtcggcggtgcaggtccgatcggtttgctgttggctgccgtgttgaaagccaaaggcatcaaagtcatcatcaccgagttgagtaaagcacgcaaagacaaagcgcgcgaatccggcgttgccgactacatcctcgacccgtccgaagtcgatgttgttgcagaagtgaaaaaactgaccaacggcgaaggcgtggacgtggcatttgagtgcaccagcgtcaacaaagtgttggatactttggtcgaagcctgcaaacctgccgccaatttggttatcgtatccatctggagccaccccgccaccatcaacgtccacagcgtcgtgatgaaagagttggacgtgcgcggcacgattgcctactgcaacgaccacgccgaaaccatcaaactggtcgaagaaggcaaaatcaaccttgagcctttcatcacccagcgcatcaagctggacgagctggtttccaaaggcttcgagcgtctgattcacaacaacgaatccgccgttaaaattattgtgagtccaaacctgtaa

SEQ ID NO: 4661 - DNA, 1110 bp, Neisseria meningitidis
atgtccttgacccgcctaatcttgaaattctatgcactgttgcgcctttttttgggcaaaaacgcccgcaccgcatggatttcgcatcccgcctgtgccgggcacgaacccggcgcaaaccatcccgattcgcccgaccgcatcctctgcatcgagcaggcattgcgccgcgccggtatttggcagcacctccaaaccatagaggcggaagaaatcagcgatacgcgcctcgcacttgtccactcgagcaaatatctgaaccgtttggaatcttgcctgccccaaaaaggcaagatttcccgcctggataacgacactgcaatcagcacaggatcgctgtctgccgcacgctttgccgccggttcggcagttcaggcagtcgacatggtcatgaaccgtaaagcatggcatgccttttgcgccgcccgcccgcccggacaccatgcgggcagcggcaaagccggcggattctgcctgctgaacaacgttgccgccggcgtcatgcatgccattgccgaataccgcctgaaacgcattgccgtcatcgatttcgatgtccactacggcgacggtacggcagaaatattcaaagacgatccgcgcatcctgtttttcaacctgtttgaaaccgaccttttccccttccccgaaaacaacgatatgcccgacggcggcaatatggtgcacctgcccttgccgccaggaacgggcagccgcacattccgcgaagccgtccgcaggcagtggctaccccgacttgccgcattcaaacccgaactggtgctgctgtcggcaggattcgacgcacaccgtctagacgaatcgggcaggctcaacctgcacgaggcggattttgcctggctgacacacaaaatcattcagacggcatcgggctgccccggcaaaatcatatccgtactcgaaggcggctacacccttgaacctctggcacaatctgctgccgagcatatccgcgtgctggcagggctgggcaaatccgatgccgcaaccgcctatcagaaaacactggacccaacaaaaaaacggtttgccaaaccgaaaaccggacaggtgcgccaacctacccaatccgaccgttacgacatatag

SEQ ID NO: 4662 - DNA, 267 bp, Neisseria meningitidis
atgaatcaagctgttgcacaatttgctcctttagtgttgattatggtggtgttctacttcctgatcatgcgtccgcagcaaaagaaattcaaagcgcatcaggcaatgcttgccgccttgaaagtcggcgacaaagtggtcttggcggcaggtttcaagggtaaggtaaccagagtcggcgaacagttttttaccgtggatatcggacagggtacaaaaatcgaggtcgaagtggaacgcaatgcgattgccgcaaaagtcgattga

SEQ ID NO: 4663 - DNA, 1857 bp, Neisseria meningitidis
atgatgaaccgttatcctttatggaaatatctgctgattgtgttcacgattgcggttgccgcagtgtattcgctgcccaacctattcggcgaaacacccgccgtgcaggtatcgaccaaccgacaagccatcatcatcaacgaacagactcaattcaaagtggatgccgcgctgaaaaacgcaggtattcagaccgacgggatgtttgttgtggacaattcactgaaagtgcgtttcaaagacacagaaacgcagcttaaagcgcgcgacgtcatcgaaaacactttgggcgaagggtatattaccgcgctcaacctgttggcggacagccccgaatggatggcgaaaatcaaagccaatccgatgtttttgggtttggacctgcgcggcggcgtgcatttcaccatgcaggtcgatatgaaagcggcgatgcagaaaacgtttgaacgttattcgggcgacatccgccgcgaactgcgccgcgaaaaaatccgcagcggcacggtgcgtcaggctggaaacagcctgaccgtccctttgcaggatgcaggtgatgtgcaaaaggctctgccgcagttgcgcaagctgtttcctgaagcaacgctgaattcagacggcagcaatatcgtcttgacgctttcggaagaggcggtcaataaagtgtgttccgatgcggtcaaacagaacatcactaccctgcacaaccgtgtgaacgagttgggcgtggccgagcccgtcatccagcagtccggtgcagaccgtatcgtcgtgcagcttccgggcgttcaggatactgccaaggcaaaagacatcatcggccgtaccgcgactttggaattgcgtatggtggaggacgatcctgccaagttgcgcgaggcattggaaggcaacgtgccgagcggttatgagctgctttcaagcggcggagatcgtcccgaaattctgctgatcagcaaacaggtcgagctgacgggcgacaacatcaacgatgcgcaaccgagtttcgaccaaatgggcgcacctgccgtcagtctgagcttggacagcgcgggcggcagcattttcggcgaactgactgccgcaaatgtcggcaaacgcatggcgatggttttgatcgaccaaggaaaatccgaggttgtaaccgcgccggttatccgtactgccattaccggcggacgcgtggaaatttccggaagcatgacgacagccgaagccaatgatacgtctttgctgttgcgtgccggttctcttgccgcaccgatgcagattgtcgaagaacgtaccatcggtccgtctttgggtaaggagaacatcgaaaaaggcttccattcgactttatggggttttgccatcgttgctgcattcatggtggtttactatcgtctgatgggtttcttttctaccattgcattgagtgccaacatactgttcctaatcggtattttgtctgccatgcaggcaacgttgacgttaccgggtatggccgcgctggcgttgactttgggtatggcaatcgactccaacgtcttgattaacgaacgtatccgcgaagaattgcgtgccggcgtgccgccgcagcaggcaatcaatctcggtttccaacacgcatgggcgaccattgtcgattcgaacctgacttcgctgattgccggtatcgcgcttttggtattcggttccggcccggtacgcggttttgcggtcgtacactgtttgggtattctgacttcgatgtattcatccgtcgtcgtattccgtgcgttggtcaatctgtggtacggacgcagacgcaaattgcagaatatttccattggttcggtgtggaagccgaaagccgaaatggcaggaggcaaggagtaa

SEQ ID NO: 4664 - DNA, 936 bp, Neisseria meningitidis
atggaactctttaaaatcaaacgcgatattccgtttatgagctacggcaaactgacgaccttcatttcgttggttacgtttatcgctgccgtgttctttttggttaccagaggtctgaatttctctgtcgaatttaccggcggtacggtaatggaagtccaatatcagcagggtgcggatgtcaataagatgcgcgaacgcctcgatacgctgaaaataggtgatgtacaggttcaggcattgggtacgaacaaacacatcatgatccgcctgccgaacaaagaaggtgttacttccgcacagttgtccaatcaggttatggatttgctgaaaaaagacagtcccgacgttaccttgcgccaagtcgaatttatcggcccgcaagtcggtgaggaattggtaagtaatggattgatggctttaggttttgtcgttatcggcatcattatttacctgtcgatgcgttttgaatggcgttttgccgtatctgccattatcgccaatatgcacgacatcgtgattattctcggctgctttgccttcttccaatgggaattttcgctgaccgtcttggcgggtatccttgccgtattgggctattctgtgaacgaatccgtcgtcgtcttcgaccgtatccgtgaaaacttccgcaagccggcgatgcgcggacatgccgtgccggaagtcatcgacaacgcgattaccgcaacgatgagccgcaccatcattacccacggttcgaccgaggcgatggtcgtatccatgctggtgttcggcggtgcggccttgcacggcttttctatggcgttgaccattggcatcgtgttcggcatttattcttccgtattggttgccagcccgcttctgctaatgttcggtttgagccgcgacaatatcggtaaagaaccgaagaagaaagaagaaatcgtggtttga

SEQ ID NO: 4665 - DNA, 270 bp, Neisseria meningitidis
atggcactgaccgtagaacaaaaagcacaaatcgttaaagatttccaacgcaaagaaggcgacaccggctcttccgaagtacaagtcgctctgttgactttccgcatcaacgacctgaccccccacttcaaagccaaccccaaagaccaccacagccgtcgcggcctgttgaaaatggtcagccaacgccgccgcctgctggcctacttgcgccgtacccagcccgatacgtatcgcgcgttgattacccgcttgggtctgcgtaaataa

SEQ ID NO: 4666 - DNA, 1260 bp, Neisseria meningitidis
atgctgcccgtgcgctttacaagagtttcagacggcatcaaacgtttaactcccgccagcaatcaaacagctttttatcacccattcgaaaatccgttttgccggtactcgtctttttattggagtattgccattatgaccgcaaccactgcgtcttcagccaaaccttatctcaaaatccaaggtttggtgaaaaagtttggtgacaattacgctgtcgataacatcgacttggacatttatcaacacgaaatcttcgcccttttgggcagttccggcagcggaaaatctacactgctgcgtatgctggcgggtatggaaagtcccaatcagggaaaaattatccttgatggtcaggatattaccaaacttgcaccctatgatcgccccatcaatatgatgttccaaagttacgcgctttttccgcatatgaccgtagaacaaaacattgccttcggtctgaaacaggacaaaatgcctaaaggcgaaatcgccgcgcgcgtcgaagaaatgctccgcctggttcagatgaccaaatttgctaaacgcaaaccgcaccaattgtccggcggtcagcagcagcgcattgctttggcacgcagtctggcaaaacgtccgaaaattctactgctggatgagcccctcggtgcattggacaaaaaactgcgccaacaaacccagcttgagttggtcaatacgctggaacaagtcggcgtaacctgtattatggttacgcacgaccaagaagaggcgatgacgatggcgacccgcatcgccattatgtctgacggtcagttgcagcaagtcggcacacccagcgacgtgtacgactatcccaacagccgcttcactgccgagtttatcggcgaaaccaacatctttgacggtgtggtgattgaagatcatgccgactatgccgttatcgaatgcgaaggtttggaaaaccacgtccgcatcgatcacggtttgggtggtccgagcgagcaggacctttgggttagtattcgaccagaggatattgatttatataaagaaaaacccgaatatttgggcgactacaactgggcgaaaggcacggtaaaagaaatcgcctatttgggcagcttcgccatttaccatatcaagctcggcaacgggcgcgtcgtcaaaagccaagtccccgccccttactggtatgtgcgcaacattacaccgccgacttgggacgaaaccgtctatatcagctggccggaaaaccaaccgactccgttgttccgttga

SEQ ID NO: 4667 - DNA, 966 bp, Neisseria meningitidis
atgaaccttaataaactgaaaaacaaactgttccgccgtccggggcagcgtgcggtgattgccgtaccgtatatttggcttttggtgctgtttctgattccgttcgccatcgtgctgaaaatcagctttgccgaacaagaaatcgccatcccgccgtttactcctttaacgacgatagatgaggatttgggtcgtctgaatattgctgtcagctaccaaaattatgcagacatcttccaaaatttttggagtacgctcaatccgttcggcgacggtgaaaacagcaatatctatctgatgacttattggtcttcaattaagactgcgctgactacgacggtaatttgtctgttggtcggttatccgaccgcctatgcgatttctcgtgccaatccttctgtccgcaatggtttgctgcttgccattatgctgcccttttggacatcgttcctgttgcgcgtctatgcgtggatgggtctgctcgggcataacggcattgtaaacaacctgttgattaaaatgggtattatcagcgagcctttggatttgttctacaatgccttttcgctcaatttggtgatggtttacgcctatctgccgtttatgattctgccgctatacacgcaactggtgaaactcgacaaccgcctgcttgaagcggcttccgatttgggcgcggggccggtcaaatcgttcttgacgattaccctgcctttgtcgaaaaccggcattattgcaggctccatgctggttttcgtccctgctgtcggcgagttcgtcattcccgagctggtcggcggttcggaaaacctgatgattggtaaagtcttgtggcaggcgttcttcgatcaaaacaactggccgctggcttccgccgtcgccgtcgtgatggtcgcgctgctggtcgtgccgattgccctgtttcagcattatgaaaaccgcgaattggaagaaggagccaaataa

SEQ ID NO: 4668 - DNA, 888 bp, Neisseria meningitidis
atgcagaaatccaaattatcttggttcttgaaactgatgttggcactgtcgctggcgtttctgtatatcccgctggttgttttggtcatctattcgtttaacgaatccaagctggtaaccgtttggggcggcttttcgaccaagtggtacggcgcattgctggaaaacgacaccatcttggaagccgcttggctgtcgctgcggattgccgttgtgtcttcgcttgccgccgtcgttttgggcacgctggcaggctatgcgatggcgcggattaaacgttttcgcggcagtaccttgttcgctggcatgatttccgcacctatggtgatgcccgacgtgattaccggtctgtctatgctgctgctgattattcaggtacagatatttttgcagggcagcgaatggttacaacatctctacttcgatcgtggctttttcaccatcttcctcggacatacgacgctgtgtatggcgtacattaccgttgttatccgttcgcgtctggttgagcttgaccagtcgctcgaagaagccgcaatggatttgggcgcgcgcccgctgaaaatcttttttgtcatcactttgcctttgattgcccctgccatcgcttcaggctttctgctcggcattaccctgtctttggatgatttggtgattacctcattcctctccggccccggttcatccacattgccgcaggtgattttctccaaaatcaagttgggtctcgatcctcagatgaatgtcttggcgaccatcctaatcggcatcatcggaacattggtcatcatcgtcaattattggatgatgaggcaggcaaccaagcgtgaccgagaagcggcagaagcctaccgccaggaaaaattggctgccgagaaagcaaattaa

SEQ ID NO: 4669 - DNA, 108 bp, Neisseria meningitidis
atgactgggtcagcctgttttcttcaaccgattttctgtttggacgatatggcccgacagcctgtatcattccgtccgaaaatacacctgataaagcaaacacaatga

SEQ ID NO: 4670 - DNA, 1296 bp, Neisseria meningitidis
atgattcgccctgattttcaagaatatctgccttcttattatttcagttcggttaatcctcatactgtttatccgaaacttcaatgccgtctgaaaaccgatacctgtatcatcggcggcggattgggtggtttgtgcactgcattgcccttggcggagcagggacatgaaacggttgtgttggaagccgcgcgtatcggtttcggcgcgtcgggacggagtggcgggcaggttatcagcgattacgcctgcggtatgggggaaattgaaaaacaggtcggcttggagcaggcgcaatggttttggcaacagtctttgcaggcggtcgaactggtggacgaacgcgtccgcaaacatgccgtcgattgtgattggcagcgcggttatgccacggttgccgtccgtccgcagcattgggaagagttgcagcagtggcatgaacacgcccaacggcattacggtgcgagtcattatcaactttgggataaagccgagttgaaacagcagcttgacagcgatatgtaccaaggggcacaattcgaccccttatccggacacctgcatccgctcacttacactttgggcatcgctcgtgccgctgccgaagccggtgcgcagattttcgagcaatccccgatgacgtgcatcgaaccgcatcaaaacggttggctggtttacacgcccgaaggcagcgtcgagtgcaaaaatgtggtctatgctgtcaatacttatgcaggtttgaacccgatattccggcctttggaacgcaaggcgattgctgtcagcacctttattattgcgaccgaacccttgggggcgcgcgcaaaagggcttatccgtaacaatatggcagtatgcgacaaccgccatattttggattattaccgcctcagcgcggacggcagactgcttttcggcggtaaggataacgagtttatcgacaatcctgagcgtatgaccgagcttgtccgccaagatatgcttaaagtttttccgcagcttgccgatgtcaaaatcgaatattcgtggggcggggagtgcgacattaccgccaaccttgtcccgcatttcggacgtttagccccgaatgttttttatgcgcaaggttattccggacacgggatggcgataacaggcattgcaggtctggcggttgccgaagcaattttaggggacgaatgccgtctgaagccgtttgagcggttgcgccagccgaatattatcctgcaaccgtttttgcgcaaactcggttctttcctcggctcgaaatattatcagtggaaagacagccgttaa

SEQ ID NO: 4671 - DNA, 1305 bp, Neisseria meningitidis
atgaaaaaacacatatgggcggcatctttgctgccggcatccctatcggcagaacctttaaactggtggaagccttattccgccgtcaattcgggcgataccgcctgggtgatgactgcggctgccttggtactgttgatgacgcttcccgggctggctttattctacggcggtatggtgcggaaaaaaaacctgctctcgacgatgatgcacagcttttccatcgcgacattggtgggcatcctttgggtcgccgtcggctattctttagcgttcacgccgggaaatgcctttatcggcggtttggggcgcgtatttttaagcgggatgcagatagacgctaccgcacagatgctgaccgtgtcgcccaatgcgccgactgttcccgaaccggtatttatgttttttcagatgacgtttgccattatttcgaccgccattattaccggcgcgtttgccgaacggatgaaatattcggcaatgatgctgttttcgggcatatggtttttattggtttatgtgccgggcgcgcattgggtgtggggcggcggctttatgagcaagggcggcgtattggattatgccggcggtacggtggtgcacatcaatgccggtatcgcgggactcgtcgccgccttggttttgggcaggcgcataggctacgggcgcgaggcgatgcctccgcacaatatggcgatgacactgatcggcgcggcaatgttgtggttcggctggttcggctttaacgccggatcggcgcttgcggcagacgcggcggcgggtatggcgatggcggtaacgcaggtgtcggccgtattcggcgcggcaggctggcttgcctgcgaaaaaatagcgggacacaaaccttccgctttggggctggcttccggcgcggtttccggtctggtcggcatcacccctgccgccggctttaccggcccgtcgggcgcggccgccatcggtatattgactgccgccgcgtgctttgtgtccgtcaccgtcgtcaaacacaaattgcgttacgatgattctttggacgctttcggcatacacggattcggcgggctggtgggcggaatattgaccggcatctttttcgacaaccgcattttcggcggggatgcggcagtttggcagcagttgtggatacaggtaaaagacggggtcgttatggcggcatacagcgggctaatgagttgggcgattttgaaggtcgtggggaaaatctgcggcggcctgcgcgtcggcaaggatgtcgaacgcgaaggtttggatctgaatatccacggcgaacgcgtggaataa

SEQ ID NO: 4672 - DNA, 405 bp, Neisseria meningitidis
atgagaaaaattcgtctaagccggtataaacaaaataaactcattgaactgtttgtcgcaggtgtaactgcaagaacagcagcagagttagtaggcgttaataaaagtacctcagcctattattttcatcgtttacgattacttatttatcaaaacagtccgcatttggaaatgtttgacggcgaagtagaagcagatgaaagttattttgctgaacgacaaaaccatatcaatggaattgggaacttttggaaccgggcaaaacgtcatttacgcaagtttgacggcattcccaaagcgcattttgagctgtatttaaaggggtacgaacgacgttttaacaacagcgagataaaagttcaaatttccattttaaaacaattagtaaaatcgagtttatcctag

SEQ ID NO: 4673 - DNA, 1260 bp, Neisseria meningitidis
atgcacgtctccgaattacaaaccctgcacatttccaaactcttagaattggcggaagaacacggcatcgaaaacgccaaccgattccgcaaacaagacctcgtatttgccatcgtccgccagatgatgaaaaaaggcgagggtttcacctgctccggcacgcttgaaatcctgcccgacggcttcggcttcctccgcagcgcggacacgtcctatcttgccggccccgacgacatctatgtctcgcccacccaaatccgccgcttcaacctgcatacgggcgacaccatcgaaggaagcgtgcgcgtcccaaaagacaacgaacgctattttgccctggtcaggcttgataccatcaacggcgaccacccggaagtatgccgccataaaatcctgtttgaaaacctgaccccgctgtttccgaccgaacagttgaagctggaacgcgacttaaagtccgaagaaaacctgaccggacgtgccatcgacctgatttcccctatcggcaaaggtcagcgcgccctcttggttgccccgcccaaaagcggtaaaaccgtgatgctgcaaaacattgcccacgccgttaccgcaaactatcccgaagtcgaactcatcgtcctcttgattgacgaacgtcccgaagaagtaaccgaaatgagccgctccgtccgtggcgaagtagtctcctccacctttgacgagccggctcaacgccacgtccaagttgccgaaatggtgcttgaaaaagccaagcgtatggtggaacacaaaaaagacgtggtcatcctgctggattcgattacccgccttgcccgcgcctacaataccgtcgtgcctacctcgggcaaaatcctgaccggcggtgtcgatgccaacgcgctgcatcgtcccaaacgtttcttcggcgcggcgcgcaacgtggaagaaggcggttcgctgaccatcatcgccaccgcattggttgaaaccggcagccgtatggacgatgtgatttacgaagaattcaaaggcaccggcaatatggaattgcaccttgaccgccgtatggcggaaaaacgcctcttccccgccatcaacatcaacaaatccggcacgcgccgcgaagagctgcttgtcccaaacgaccagttacaacgtatgtggctcttacgcaagttcctgcacccgatggacgaaatcgaggcagccgaatttttaatcgggaaaatcaaagcctctaaaaacaacgacgatttctttgaactgatgcgcggcaaataa

SEQ ID NO: 4674 - DNA, 2385 bp, Neisseria meningitidis
atggccgacaactacgtaatctggtttgaaaacctgcgtatgacagatgttgaacgcgtgggcggtaaaaacgcctcgctgggcgaaatgatcagtcagctgaccgaaaaaggcgttcgcgtccccggcggctttgccaccacggccgaagcctaccgcgcattcctcgcacacaacggtctgagcgaacgcatttccgccgcactggcaaaattggatgtcgaagacgttgccgaactggcacgcgtcggcaaagaaatccgccaatggattttggatacgcctttccccgaacagctcgatgccgaaatcgaagcggcatggaacaaaatggttgccgatgccggcggtgcggacatttccgttgccgtacgttcttccgcaactgccgaagacctgccggacgcatcattcgctggacaacaggaaaccttcttgaacatcaacggcttggataacgttaaagaagcgatgcaccatgtattcgcttccctgtataacgaccgtgccatttcttaccgtgtccacaaaggcttcgaacacgacatcgtcgccctttccgccggcgttcaacgcatggtgcgttccgacagcggcgcatcaggtgtgatgttcaccctcgacaccgaatccggctacgatcaagtcgtctttgttacctcctcttacggtctgggcgaaaacgtcgtacaaggtgcggtcaacccggacgaattttatgtgttcaaacccacgctcaaagcgggcaagcccgccatcctgcgtaaaaccatgggttcaaaacacatcaaaatgatttttaccgacaaagcagaagccggtaaatccgtaaccaacgtcgatgtccccgaggaagaccgcaaccgcttctccattaccgacgaagaaattactgagttggcgcattacgcactgaccatcgaaaaacactacggccgcccgatggatatcgaatggggacgcgacggcttggacggcaaactctacatcctgcaagcccgtcccgaaaccgtaaaatcccaagaagagggcaaccgcaacctgcgccgcttcgccatcaacggcgacaaaaccgtattatgcgaaggccgcgccatcggtcagaaagtcggtcagggcaaggtgcgcctgattaaagatgcttccgagatggattccgtcgaagccggcgacgtactcgttaccgacatgaccgatccggattgggaacccgtgatgaaacgtgcttctgccatcgttaccaaccgcggcggccgtacctgccacgccgccatcatcgcgcgtgaattgggcattcctgccgttgtcggctgcggcaatgcaaccgaattgctgaaaaacggtcaagaagttaccgtatcctgtgccgaaggcgataccggctttatctatgccggtctgttggacgtacagattaccgatgtcgccttagacaatatgcctaaagcacctgtaaaagtcatgatgaacgtcggcaatcccgaactcgcattcagcttcgccaacctgcccagcgaaggcatcggcttggcgcgtatggaatttatcatcaaccgccaaatcggtatccaccccaaagccttgttggaatttgacaaacaagacgacgaattaaaagcggaaattacccgccgtatcgccggttacgcgtcccctgtcgacttctacgtcgataaaatcgccgaaggcgtggcgacattggccgcatcggtttatccgcgtaaaaccatcgtccgtatgtccgacttcaaatccaacgaatacgccaacctggtcggcggcaacgtatacgaaccgcatgaagaaaacccgatgttgggcttccgtggtgcggcgcgttatgtcgccgacaacttcaaagactgtttcgccttggaatgcaaagccttgaaacgcgtccgcgatgaaatggggttgaccaacgttgaaatcatgattccgttcgtccgcactttgggcgaagccgaagccgttgtcaaagccctgaaagaaaacggcttggaacgcggcaaaaacggcctgcgcctgattatgatgtgcgagctgccgagcaacgcggtattggcggaacaattcctgcaatacttcgacggcttctccatcggctcgaacgacatgacccaactgaccctcggtctcgaccgcgacagcggcttggtatccgaatcgtttgacgaacgcaaccctgccgtcaaagtgatgctgcaccttgccatctccgcctgccgcaagcagaacaaatatgtcggcatctgcggtcaaggcccgtccgaccatccggacttcgccaaatggctggttgaggaaggcattgaaagcgtttccctgaacccggataccgtcatcgaaacttggctatatttggcgaatgaattgaacaaataa

SEQ ID NO: 4675 - DNA, 822 bp, Neisseria meningitidis
atgagcagtccgcgccatgtgttttacatttccgaccgtaccggtctgactgctgagaatatcggcgaggcgttgctgaaccagtttggcaatctgtcgttcaaacgccatacgcatccgtttgtcgatacgccggaaaaggcgcgcgcggtggtggagaaggtcaatcggagccggcaggaaaacggtcagcgtccgattgcgtttgtcagtgtggttgatgacgaaatccgtcggattatcaaaggggcggatgcttttcagattaatttctttgagacttttttgggactgttggagaaggaactcaataccgaagccacggcatccgggcaggggcatcacagtatcggtaatacgaagcgttatgatgcgcgtatggaagcggtcaatttttctttgaaccacgacgacggggtcagcgataagaaccttcaggaagcggatgtaatcttgatgggtgtatcgcgttcgggcaaaacgccgacctgcctttacctcgccctgcaatacggcatccgtgcggcaaactatccgctgattcccgacgatttggaatcggccgatctgccgcgtatggtcaagccttatagggataagctgttcgggttgaccatccagccggaacgtttgcaggccatccgccaagagcgccgcccgaattcaacttatgccaaaatcgatacatgccgcagcgaggtggcggacgcgcagagtatgttcagacggcatgggattccgtttgcgaatacgacggataagtcggttgaggaattggcggtacacatccttcaggcgtgcaagctcaaacgcaggttttga

SEQ ID NO: 4676 - DNA, 663 bp, Neisseria meningitidis
atgatacaagccgtattgttcgacctcgatggcacgctcgccgacaccgccctagacctcggcggcgcactcaacaccctgctcgcccgccacggactacctgcaaaaagcatggacgaaatccgcacccaagccagccacggcgcggcaggactgatcaagctcggcgcaggcatcacccccgaccatcccgactatgcccgatggcgcaccgaataccttgacgaatacgacagccgctacgcccaagacaccaccctcttcgacggcgtaaacgaactcatcgccgaactcggaaaacgcggcatcaaatggggcatcatcaccaacaaacccatgcgcttcaccgacaaactcgtccccaaactcggcttcatcatcccacccgccgtcgtcgtcagcggcgacacctgcggcgagcccaagcccagcgtcaaacccatgctgtatgcgtgcggacaaatccacgccgacccgcaacacacactctacgtcggcgacgcggaacgcgatatacaggcggggcgcaacgccggtatgacgaccgtcctcgccgaatggggctacatcgctcccgaagacgataccggctcatggcaggcggatttccacatccgcacgccactcgatctgctcgaatgtctggacaaaatacagccctga

SEQ ID NO: 4677 - DNA, 828 bp, Neisseria meningitidis
atgaaacccgatatttatgctttgctggaacgcgccctgctttcgggcgacccagatgaaaaaggacggctgacggatgaggcgtttgccgccgttcaaaatgcggacggggcggaaacaaacgcaccgccggcggacttcccccgcgcgggacgaccggacaagcctgttttggtcgcgccgtcgcagctgacgccacgcaaaatgaacacaaccgaaggctatgcggcgatgctgcacgcgattgcgcatatcgaattcaacgccatcaatctggctttggacgcggcataccgtttccgcacgctgccgtttcagtttgtccgcgactgggtgaaagtggcgaaggaagaggtgtaccatttccgcctgatgcgcgaaaggctgcgcgctttcggcttcgattacggcgattttgaagcacacaatcatttatgggatatggcatacaaaaccgcctacgatcctttgttgcgtatggctttagtgccgcgcgttttggaagcgcgcgggctggacgttacgcccggcatacgcgcgaaggtggcgcagcgcggtgattcggaaacctgcggcgtgttggacatcatttaccgcgacgaagtgggacacgtcgccatcggcaaccggtggtatcaacacctttgccgcgaacgcggtttggagcctgtcgccctgttccgcagcctgattgcccgttacgatatgtttatcttccggggctatgtgaacatcgaagcgcgcgaaaaagcaggcttcagccgctttgaattggatatgttggaagatttcgagcagggtttgaaacaaaataaacatgccgtctga

SEQ ID NO: 4678 - DNA, 624 bp, Neisseria meningitidis; identical to SEQ ID NO: 2327

SEQ ID NO: 4679 - DNA, 1140 bp, Neisseria meningitidis
atgaaaaaaacactggtggcggcggcaatcctgagcctcgccttgactgcgtgcggcggcggaagcgataccgccgcccaaaccccctccgccaagcccgaagccgaacaatcgggcaaactcaacatctacaactggtcggattatgtcgatcccgaaaccgttgccgcctttgaaaaagaaaccggcatcaagacgcgttccgattattacgacagcaacgaaacactggaggcaaaagtcctgaccggcaaatccggctacgacctgaccgcgccgtccatcgccaacgtcggccggcaaatcaaagcgggcgcgtatcagaaaatcgacaaggcgcaaatcccccattacggcaacatcgataaagatttgctgaaaatgatggaagccgtcgatccgggcaacgaatacgccgtcccctatttctggggcatcaataccttggcaatcaatacccagcaggtgaaaaaagcattgggtacggacaagctgcccgaaaacgaatgggatttggtgttcaaacccgaatacaccgccaaactcaaatcctgcggcatcagctatttcgacagcgcaatcgaacagattcccttggcgttgcactatttgggcaaagaccccaacagtgagaatcccgaagacatcaaagccgccgtcgatatgatgaaagccgtccggggcgacgtgaaacgcttcagctcttccggctatatcgacgatatggcggcgggcaacctgtgtgccgccatcggttacggcggcgatttgaacattgccaaaacccgtgccgaagaagccgcaaacggcgtggaaatcaaagtattgaccccgaaaaccggcgtgggcgtgtgggtggattcctttatgattccgcgcgacgcgcaaaacgttgccaatgcccaccgctatatcgactacacgctccggcccgaggtggcggcgaaaaacggcagcttcgttacctacgcgcccgccagccgtcccgcgcgcgagctgatggatgaaaaatacacctccgacgcatcgattttcccgaacaaagaactgatggaaaaaagtttcatcgtatcgcccaaatccgcagaatccgtcaaactgggcgtgaagctgtggcaagggctcaaagcgggcaaataa

SEQ ID NO: 4680 - DNA, 1222 bp, Neisseria meningitidis
atggatttaagtatcgtagttcctatttataatgtcgaaagttatttggaagcgtgtttaagttccatagaatctatattaagtaatgaaaatgtcgaacttatccttgtgaatgacgggtcaaaagacggaagtgaagatatatgttacaaatatatagataaaatatcaaacagcaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaccggacaccaaatatcaaatatatatatcaggataaccaagggttgtcggaggcgagaaataccggaataaaaaattcaaacggaaaatatatagtctttattgattcggatgattttattaactgtcagattttgctggattttcttagtaaagatgatactgatatgccggatgtggtgtttttaaatgcggttaaatatgataagggaagtgtttcatattttggcgaagattatcagcctgaaaaaatactcaatcaatccaaagtcgaagttttgaaaggattatgccgatttagaaaatttccgggttcggcgtggaataagattataaaaagagaattgattattagagaaaaactgttttttgaaaggggaatttattctgaagatatcgaatggtcaatgaggttatttaatgcggcaacaactttttcttatttggacggttgttattactattatcggcagggaagaaaagattctattacgggaactgtttcggaaaaaagtataaagtcattattatatattttggagaaaaatgcggaaatggaatttaatagggatatatcgagttatctttattcttttctttcctacgaatatctcgttttgctttttataatgacgagtaaaaatatagagtgtgatgctgatataaaaagaagggcgtatcatttaaggtttatgctgttaaagtccaataaattgatatataagctgatattcccgataatcacattactcggggtcgatattacaggcaggattttaaaagcaatcagggggaatatttaa

SEQ ID NO: 4681 - DNA, 531 bp, Neisseria meningitidis
atgaacgcaatccgaactttccaaaaccgcacgcccgaaatccacgaaacctgtatgatagacgaagcctgcgtcgtcattggcgaagtgtcgcttgccgaagatgtttccgtgtggccgtgcgccgtgttgcgcggcgatgtgaacagcatcaccgtcggcgcgcgcagcaatatacaggacggcagcgtcttgcacgtttcccacaaaaccgccgccaaacccgaaggatcgccgctggttatcggcgaagacgttaccgtggggcacaaagtgatgctgcacggctgccgtatcggcaaccgcgtcctggtcggcatggggacgacggttctggacgatgccgtgattgaggacgaagtgatgatcggcgcgggcagcctcgttccgccgcgcaaacgcttggcgggcggctatctttatgtcggttcgccggtcagacaggtgcgcgtgctgaccgatgaggaaaaagcctttttgaaatattccgccgcgcattatgtgaagctgtcgaaacagtacgggatgtga

SEQ ID NO: 4682 - DNA, 1596 bp, Neisseria meningitidis; identical to SEQ ID NO: 1495

SEQ ID NO: 4683 - DNA, 396 bp, Neisseria meningitidis
atggataaaaacctgcttgaagccgtcaaatttgacgaaaaaggtttggtttgcgccatcgcccaagatgccgaaaccaaacgtattttaatggtggcgtggatgaacgccgaagccctgcaaaaaaccgtcgaaaccggctttgcccactattacagccgttcgcgccaaaaacaatggatgaagggcgaagagtcgggacacacgcaaaaagtccgcgcactgcgcctcgactgcgacggcgacgccattgtgatgctcatcgcccaaaacggcggcatcgcctgccacaccgggcgagaaagctgcttttacaaagtctggcgtggcagcgcgtgggaaaccgccgatgccgtcctgaaagacgaaaaagagatttacggcagcacgcactga

SEQ ID NO: 4684 - DNA, 768 bp, Neisseria meningitidis
atggcactggcaaaacgcatcatcccctgtctcgacgtaaaagacgggcgcgtcgtcaaaggcgtgaacttcatcggtttgcgcgacgcgggcgaccccgtcgaagccgccaaacgctacaacggcgaaggcgcggacgaattgaccttcctcgacatcaccgcctcatccgacaaccgcgacaccatcctgcacatcatcgaagaggttgccggacaagtcttcatccccctgaccgtcggcggcggcgtacgcaccgttgccgacatccgccgcctgctcaatgccggcgcggacaaagtcagcatcaacaccgccgccgttacccgtcccgatttaattgacgaagccgccggatttttcggttcgcaagccatcgtcgccgccgtcgatgccaaagccgccaaccccgaaaacacacgctgggaaatctttacccacggcgggcgaaatccgaccggtttggatgcggtggaatgggcggtcgaaatgcaaaaacgcggcgcgggcgaaatcctgctcaccggtatggacagggacggtacgaaacagggtttcaacctgccgctgacccgcgccgttgccgaagccgtcgacatccccgtcatcgcctccggcggggtcggcaatgtccggcacctgattgaaggcataaccgaaggcaaagccgatgccgtacttgccgccggcattttccatttcggggaaatcgccatccgcgaagccaaacgcgctatgcgcgaagccggcatcgaagtgcgcctctga

SEQ ID NO: 4685 - DNA, 738 bp, Neisseria meningitidis
atgctgctgatacccgccatcgatttgaaagaaggacgctgcgtccgcctgaaacaagggctgatggaagaggcgaccgtcttttccgattcgcccgccgaaaccgcgctgcactggttcaaacaaggcgcgcgccgcctgcatctggtagatttgaacggcgcgtttgccggcgttccgcaaaacctgcccgccatcaaagacatccttgccgctgtcgccaaagacatccccgtacagctcggcggcggcatacgcgatttgaaaaccatcggacaatatttggatttgggcttaaacgacgtgattatcggcacggcggcggtcaaaaaccccgacttcgtgcgcgaggcgtgcaaagccttccccggcaggattattgtcgggctggatgccaaagacggtatggccgccatcgacggctgggcaaccgtaaccgggcatcatgtaattgatttggcaaaacgctttgaagacgacggcgtcaacagcatcatctacaccgacatcgggcgcgacggtatgatgagcggcgtgaacatcgacgcgacggtcaaactcgcccaaaccgtccgcattcccgtcatctcctccggcggactgaccggcttggacgacatccgcgccctgtgtgccgccgaaaaacatggcgtagcaggcgcgattaccggccgcgcgatttacgagggtagcatcgattttgcccaagcgcagcaactggcagattccctcgactaa

SEQ ID NO: 4686 - DNA, 639 bp, Neisseria meningitidis
atgcaaaccgccattatcgattacggtatgggcaacctgcattccgtattgaaatccgtccggacggcggggcagcttgccggaaaaaataccgaaatctttttaagcggcgaccccgaccgcgtgtcccgcgccgacaaagtcatttttcccggtcagggcgcgatgcccgactgtatggcggcattaaaacgagacggtttggacgaggcagtcaaagatgccttaaaaaacaaaccgtttttcggaatctgcgtcggcgcgcaacttttattcgaccacagtgaagaaggaaacaccgacggcttgggctggttcggcggcaaagtcagacgctttgagcgcgacctccgcgacccgcagggatgccgtctgaaagtcccgcatatgggctggaacaccgtgcgccaaacccaaaaccacccgctgtttaaagatattccccaagacacgcgtttttacttcgtccacagctactatttcgcccccgaaaatcccgaaaccatattgggcgaaagcgactacccgtccccgtttgcctgcatcgtcggcaaagacaacgtattcgccacgcaatttcacaccgaaaaaagccacgatgccgggctgacgatgttgaaaaactttttaaactggtaa

SEQ ID NO: 4687 - DNA, 1503 bp, Neisseria meningitidis
atggcaaaagtactcatcgtacccgtatctgccggactggacgcctccgccgccgcacaagcctttgcaaaagcactggacgcacaaattttccaagccgttgacgcaaccgccgaaaccctgctcgcgcaaggcaaaagcgacgactggttcgacgcactggtcggcaaagttgccgcactcgatgccgccaacctcgtcatcgaaggcatcgcgcccgatgccgacaaaatctacctcgcaggcaaaaacgtcgaactggcattgtcccttgacgcggcagccgtcttcgccgtccgttccgacaacgccgatgccgacgaactggcaaatcgggtgaaccttgccaaacagttcttcgccgccgcgccgggcgtattggaaggttttgtcgtggacggcgcggcagcctccgttgccgaagcggcagccgaaaaaaccggcctgaccttcttcggttcgagcgacgcgctgaaagacgtatccgtattggcaggccgcgaagcaaaacgcctgtcgccggcgcaattccgctacaacctgatcgacttcgcccgccaagccgacaaacgcatcgtcctgcctgagggcgcagaaccccgcaccgtccaagccgccgccatctgccacgaaaaaggcattgcccgctgcgtcctgcttgccaaacgcgaagaagtcgaagccgttgccaaagaacgcggcatcagcctgcccgactctttggaaatcatcgatcccgcctcattggtcgaacaatacgtcgagccgatgtgcgaactgcgcaaatccaaaggcctgacacccgaagacgcgcgcaagcaactgcaagacaccgtggtactcggtacgatgatgatggcgcaaaatgatgtggacggtttggtatccggtgcggttcacaccaccgccaacaccatccgccccgctttgcaactgattaaaaccgcaccgggcgcaagcctcgtgtccagcgtattctttatgctgctgcccaaccaagtcctcgtcttcggcgactgcgcggttaatccgaacccgaccgcgcaacagcttgccgacatcgccatccagtctgccgattccgcaaaagccttcggcatcgacccgaaagtggcgatgatttcctactccaccgtcaactccggcagcggccccgatgtcgataccgtcatcgaagcaaccaaacttgcccgggaaaaacgccccgacctcgccatcgacggcccgctgcaatatgatgcggcaaccgtgccgggtgtgggcaaatccaaagctccgggcagcccggtggcaggacaggcaaccgttttggtcttccccgacctgaacaccggcaactgcacctataaagccgtccaacgcaacgccaacgtcttaagcgtcggcccgctgctgcaaggcctgcgtaaaccggtcaacgacctctcccgcggcgcactggtagaagatatcgtgtttaccatcgccctgactgccgttcaggcaaaacaaatggaaggctga

SEQ ID NO: 4688 - DNA, 1059 bp, Neisseria meningitidis
atgaccgccgccctgcacatcggacacctgtccaaaagttttcaaaacaccccagttttaaacgacatttcgctcagcctcgacccgggcgaaatcctctttatcgtcggcgcgtccggctgcggcaaaaccacccttttacgctgccttgccggttttgaacaacccgattttggcgaaatttcgctttccggcagaaccatcttctcgaaaaataccaacctccccgtccgcgaacgccgtttgggttatgtcgtacaggaaggtgtgctgttcccccacctgaccgtttaccgcaacaccgcctacgggctgggcaacggcaaaggcaagacggcgcaagagcggcagcgcatcgaagctatgttggaattgaccggcatttccgaacttgccggacgctatccgcacgaactttcgggcggacagcaacagcgcgtcgccctcgcccgcgccctcgcacccgatcccgaactgattttgttggacgaacccttcagcgcgctggacgaacagttgcgccgccagattcgcgaagacatgattgccgccctgcgcgccaacggcaaatctgccgttttcgtcagccacgaccgcgaagaagccctgcaatacgccgaccggattgccgtgatgaaacaggggcgcatcctccaaactgcaagccctcacgaattgtaccgacaacctgccgaccttgatgccgccctgtttatcggcgaaggcatcgtgttccccgccgcgctcaacgccgacggcaccgccgattgcggattgggccgcctgcccgttcaaagcggcgcacccgcaggcacacgcggcacactgctcatccgtccggaacagttcagccttcacccccattccgcacccaccgcctccattcacgccgtggttctcaaaaccacgcccaaagcgcggcataccgaaatcagcctccgggtcggacaaaccgtcctcacgctcaacctcccttccgcccccaccctgtcagacggcatttccgccgtcctccatttggacggtcccgccctgttcttccccggaaataccctctga

SEQ ID NO: 4689 - DNA, 1518 bp, Neisseria meningitidis
atgtctcctaaaaaaatacccatttggcttaccggcctcatcctactgattgccctaccgcttaccctgccttttttatatgtcgctatgcgttcgtggcaggtcggcatcaaccgcgccgtcgaactgttgttccgcccgcgtatgtgggatttgctctccaacaccttgacgatgatggcgggcgttaccctgatttccattgttttgggcattgcctgcgcccttttgttccaacgttaccgcttcttcggcaaaaccttttttcagacggcaatcaccctgcctttgtgcatccccgcatttgtcagctgtttcacctggatcagcctgaccttccgtgtcgaaggcttttgggggacagtgatgattatgagcctgtcctcgttcccgctcgcctacctgcccgtcgaggcggcactcaaacgcatcagcctgtcttacgaagaagtcagcctgtccttgggcaaaagccgcctgcaaacctttttttccgccatcctcccccagctcaaacccgccatcggcagcagcgtgttactgattgccctgcatatgctggtcgaatttggcgcggtatccattttgaactaccccacttttaccaccgccattttccaagaatacgaaatgtcctacaacaacaataccgccgccctgctttccgctgttttaatggcggtgtgcggcatcgtcgtatttggagaaagcatatttcgcggcaaagccaagatttaccacagcggcaaaggcgttgcccgtccttatcccgtcaaaaccctcaaactgcccggtcagattggcgcgattgtttttttaagcagcttgttgactttgggcattattatcccctttggcgtattgatacattggatgatggtcggcacttccggcacattcgcgctcgtatccgtatttgatgcctttatccgttccttaagcgtatcggctttaggtgcgattttgactatattatgtgccttgccccttgtttgggcatcggttcgctatcgcaattttttaaccgtttggatagacaggctgccgtttttactgcacgccgtccccggtttggttatcgccctatccttggtttatttcagcatcaactacacccctgccgtttaccaaacctttatcgtcgtcatccttgcctatttcatgctttacctgccgatggcgcaaaccaccctgaggacttccttggaacaactcccaaaagggatggaacaggtcggcgcaacattggggcgcggacacttctttattttcaggacgttggtactgccgtccatcctgcccggcattaccgccgcattcgcactcgtcttcctcaaactgatgaaagagctgaccgccaccctgctgctgaccaccgacgatgtccacacactctccaccgccgtttgggaatacacatcggacgcacaatacgccgccgccaccccttacgcgctgatgctggtattattttccggcatccccgtattcctgctgaagaaatacgccttcaaataa

SEQ ID NO: 4690 - DNA, 996 bp, Neisseria meningitidis
atgaaaacatctatccgatacgcactgcttgccgcagccctgaccgccgcaacccccgcgctggcagacattaccgtgtacaacggccaacacaaagaagcagcacaagccgttgcagatgcctttacccgggctaccggcatcaaagtcaaactcaacagcgccaaaggcgaccagcttgccggtcaaatcaaagaagaaggcagccgaagccccgccgacgtattctattccgaacaaatcccggcactcgccaccctttccgccgccaacctcctagagcccctgcccgcctccaccatcaacgaaacacgcggcaagggcgtgccggttgccgccaaaaaagactgggtggcactgagcggacgttcgcgcgtcgtcgtttacgacacccgcaaactgtctgaaaaagatttggaaaaatccgtcctgaattacgccacgccgaaatggaaaaaccgcatcggttacgcccccacttccggcgcgttcttggaacaggttgtcgccatcgtcaaactgaaaggcgaagcggccgcattgaaatggctcaaaggtctgaaagaatacggcaagccttacgctaaaaactccgtcgcccttcaagcggttgaaaacggcgaaatcgatgccgccctcatcaacaactactactggcacgcttttgcgcgtgaaaaaggcgtacaaaatgtccacacccgcctgaatttcgtccgccacagagatcccggcgcactcgttacctattccggcgcagccgtgttaaaatcctcccaaaacaaggatgaggcgaaaaaattcgtcgccttcctcgccagcaaggaaggacagcgcgccctgaccgccgtccgtgccgaatatcctttgaatccgcacgtggtatccactttcaatttggaacccatcgccaagttggaagcaccccaagtgtccgccaccactgtttccgaaaaagaacacgccacccggctgcttgagcaagccggtatgaaataa

SEQ ID NO: 4691 - DNA, 966 bp, Neisseria meningitidis
atgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgtccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 4692 - DNA, 384 bp, Neisseria meningitidis
atgaccgatacggatacccaagccgaccgcttcgaacagatgatgtggcaggcggtggacaaactttttgaacagcatgacggcaaactcgaaagcatggacgggcgggaacaggagctggttttgatttggcggacagaagccgatatcggtaacggcagcatactgcaatttgtctgcaactggggtttccccgccgccgaaaagacttgttccgttctgaaaaaaatcggcgcggtacacagcgcaatgctgatccatcgggcggcagacgcattggacaaagaaatccgccgcctccaatcggaaggtaaaaacctgaaagaaatgtgggatataacatctcgacaacaaaaccgcctcactgctgaacagtctggatga

SEQ ID NO: 4693 - DNA, 1377 bp, Neisseria meningitidis
atgcacgacaaaacctggtccggacgtttcaacgaacccgtttccgaactcgtcaaacaatacaccgcctccatcggtttcgaccgacggcttgccgaatgggacatccaaggctcgctggcacacgcgcaaatgctgaaagaaaccggcgtgttggacgaaggcgatttggcggacatccgccggggtatggcggaaatcctcgaagaaatccgcagcggcaaaatcgaatggtcgtccgatttggaagatgtccatatgaacatcgaacgccgcctgaccgacaaaatcggcgacgcgggcaaacgcctgcacaccggccgcagccgcaacgaccaagtcgccaccgacatccgcctgtggctgcgcgaccagattaccgttatacaaagcctgattcaaagccttcagacggcattgctggatttggcggaacaaaacgccgaaaccgtcatgccaggctttacccacctgcaagtcgcccagcccgtcagcttcggacaccatatgctcgcctacgtcgaaatgctcggacgcgataacgaacggatggcggactgccgctgccgcgtcaaccgtatgccgctcggcgcagccgcccttgccgggacgacctacccgattcagcgcgaaatcaccgccgagctattgggctttgaacaaatctgccagaactcgctcgatgccgtatccgaccgcgatttcgccattgagttcacagccgccgcctcgctggttatggttcacctgagccgcctgtctgaagaattgattttgtggatgagcccgcgtttcggctttatcgacatcgccgaccgtttctgcacaggttcgtccatcatgccgcagaagaaaaaccccgacgtgcccgaactcgtgcgcggcaaatccggccgcgtcatcggacaccttatcggtctgattaccctgatgaaatcccaacccttggcgtacaacaaagacaatcaggaagacaaagaacccttgttcgacaccgccgacacgcttatcgacacgttgcggatttacgccgatatgatgcgcggcgtaaccgtcaaacccgacaatatgcgcgccgccgtgatgcagggcttcgctaccgccaccgacttggcggattatctggtcaaaaaaggcatgcctttccgcgatgcccacgaagtcgtcgcccaagccgtgcgccacgccgaccaagcgggcgtcgatttgagcgaactgccgctcgaagtcttacaaggtttcagcgatttgattgccgacgacgtttacggcgtgctgacacccgaaggcagcttaaacgcccgcaaccacttgggcggtaccgcgccggaacaagtccgcttccaagtgaaacgctggcgggaaatgttggcttaa

SEQ ID NO: 4694 - DNA, 870 bp, Neisseria meningitidis
atgaaacccatacggaaagccgttttccccgtcgcagggatgggaacccgcttcctgcccgccaccaaggccagcccgaaagaaatgctgcccatcgtcgacaagccgctgatccaatacgccgtagaagaagccgtggaagccggctgcacggaaatggtgtttgttaccggacgcaacaaacgcagcatcgaagaccatttcgacaaggcatacgaactcgaaaccgagttggaaatgcgccataaagacaaattgttggaacacgtccgcaacatcctgccgccgaacattacctgcctctacatccgtcaggcggaagcactgggcttgggacacgccgtcttgtgcgcccgcgccgccatcggagacgaaccctttgccgttatccttgccgacgacctgattgatgcccccaaaggcgcgctcaaacaaatggtcgaagtgtacgggcgcagcggcaacagcattttgggcgtagaaaccgttgaagcatcgcaaaccggctcatacggcatcgtcgaaaccgaacagctcaaacagttccaacgcattaccggcattgtcgaaaaacccaagcccgaagacgcgccctccaaccttgccgttgttggacgctacatcctcaccccgcgcattttcgacctcttaaccaatcttccgcgcggcgcgggcaacgaaatccagcttacagacggcatcgccaagctgctcgatcacgaatttgtcctggcgcacccctttgaaggtacgcgctacgactgcggcagcaaactgggctacctcgaagccaccgtcgcctacggtctgaaacatcccgaaaccggcgaacccttccgccggcttttggaaaaataccgcaccgaataa

SEQ ID NO: 4695 - DNA, 600 bp, Neisseria meningitidis
atgtctgaaaaaccggaaaaaatcgttttggcaagcggcaatgccggcaagctcgaagagttcggcaacttattcaaaccttacagcatcaccgtattgccgcaatccgcattcggcatacccgaatgccccgaaccctatcccacctttgtcgaaaacgcgctggcaaaagcacgccatgccgccaaatacagcgggctgcccgcactcgccgacgacagcggcatctgtgccgccgccttaaacggcgcgccgggcatccattccgcacgttacgcgggcgacaatcccaaatccgataccgccaacaacctgaaacttgccgccgaacttgtcggcaaggcagacaaaagctgctgctatgtctgcgtattggtttttgtccgccataaagacgacccgcgcccgattatcgccgagggcgtatggcacgggcagtggaacgacacgccgctcgggcaaaacggtttcggttacgacccgtatttttatctgcccgaacacggcaaaaccgccgccgaattggatacggaggtcaaaaaccgcgaaagccaccgcgcgcaggcacttgccgaactcttacgcaaactcgccctttaa

SEQ ID NO: 4696 - DNA, 234 bp, Neisseria meningitidis
atgaaccgccgaaaaatctatctgttgtctgttgccctcttcacactggcatttatgctgctcgtcctcttgggtgcttatctgctgaccgtcggcagcaaagccttcgccgtcgcctcctttcttttcgcattcggcgcactgttcggacaaatcggcagcctcgccctctacctgcggcacaaatccctacgcgccgcccaatccgccacaaaggaaaaccgctatgtctga

SEQ ID NO: 4697 - DNA, 534 bp, Neisseria meningitidis
atggcagacttcaaccaaatcctgacccccggcgacgtggacggcggcatcatcaacgttgtcaacgaaatccccgccggcagcaaccacaaaatcgaatggaaccgcaaactggccgcattccaactcgaccgcgtcgaacccgccatcttcgccaaaccgaccaactacggcttcattccccaaactttggacgaagacggcgacgaattggacgtgctgctcgttaccgaacaacctttggcaaccggcgtattcttggaagcgcgcgttatcggcgtgatgaaattcgttgacgacggcgaagtggacgacaaaatcgtctgcgttcctgccgacgaccgcaacaacggcaacgcctacaaaactttgtccgatttgccgcaacagctcatcaaacaaatcgagttccacttcaaccattacaaagacctgaaaaaagcaggtacgaccaaagtcgaatcgtggggcgatgcggaagaagcgaaaaaagtcatcaaagaatccatcgaacgttggaacaaacaggcataa

SEQ ID NO: 4698 - DNA, 459 bp, Neisseria meningitidis
atgccgatggcaaaaccgctcaaataccccgtttccgcactggtcgtcctttatagcggggacggcggcatcctgctcatcgaacgcacgcatccggaaggattttggcagtcggtaaccggcagcctcgaaccgggcgaaaccgtcgcccaaacggcaaggcgcgaagtttgggaagaaaccggcatcctgctggcggacgggcagcttcaagactggcacgacagcacggtttacgaaatctaccaccactggcggcaccgctatccaaaaggcgtgtttgaaaaccgcgaacacctcttctctgccgaaatcccgcgtgatacgcccatcgccctgcaacccgaagaacacgtctcctacggttggttcgatatggaagaagcagcggaaaaagtattttccccgtccaacaggcgcgcgattttggaactgggcaggtttttgggcaaacggtaa

SEQ ID NO: 4699 - DNA, 1827 bp, Neisseria meningitidis
ttgggcatttcccgcaaaatatcccttattctgtccatactggcagtgtgcctgccgatgcatgcacacgcctcagatttggcaaacgattcttttatccggcaggttctcgaccgtcagcatttcgaacccgacgggaaataccacctattcggcagcaggggggaacttgccgagcgcagcggccatatcggattgggaaaaatacaaagccatcagttgggcaacctgatgattcaacaggcggccattaaaggaaatatcggctacattgtccgcttttccgatcacgggcacgaagtccattcccccttcgacaaccatgcctcacattccgattctgatgaagccggtagtcccgttgacggatttagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgccgaccgtttccacaatgccggtagtatgctgacgcaaggagtaggcgacggattcaaacgcgccacccgatacagccccgagctggacagatcgggcaatgccgccgaagccttcaacggcactgcagatatcgttaaaaacatcatcggcgcggcaggagaaattgtcggcgcaggcgatgccgtgcagggcataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgttcggggaaaatacggcttgggcggcatcacggcacatcctatcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaataaggaacggtaatataaacagtaactttagccaacatgctcaactagagagggaaattaataaactaaaatctgccgatgaaattaattttgcagatggaatgggaaaatttaccgatagcatgaatgacaaggcttttagtaggcttgtgaaatcagttaaagagaatggcttcacaaatccagttgtggagtacgttgaaataaatggaaaagcatatatcgtaagaggaaataatagggtttttgctgcagaataccttggcaggatacatgaattaaaatttaaaaaagttgactttcctgttcctaatactagttggaaaaatcctactgatgtcttgaatgaatcaggtaatgttaagagacctcgttataggagtaaataa

SEQ ID NO: 4700 - DNA, 465 bp, Neisseria meningitidis
atggcaatttggaattatcggtactaccttatcccatcagctgctatcagaaataaatttaatgcaaataaagatatcatacttgatgagtatcgatctaatggttttcagaattttaatgagaataaaagttttgaaaattactttatcgataatgatgttatattattatcaataataaatgaagcaaaaaaacagcttaaattgaaagaatcttgggataaagacgcaatcatgttttgtgataattttggtaatagtcttaccgtttggccagatgatatagagtgcgaacttgatttaagatttgattatactaaatttattcagaaaaccattgattgggcaataaaatataattgtctacttgtaatagaaaaaacaggaaatgtagtttcccctaatataaataatctgatgtatgaaataaaagcatatttggaaagcaagccgtggcccatatga

SEQ ID NO: 4701 - DNA, 331 bp, Neisseria meningitidis
atgcggttctcaaggtttgagctaagaggccgtctgaaaacagaaaaactgtttcagacgacctttcttttaaccagttgccacagcaaccggacaaaagcagcctacctccacatccatataggcaatacaggggagatattttgtaaattctacgaatattttacctgctaaacagggtaggatatggtatgaagcgaacattggcttaataaacactatgtcaagatcgaatcaggctggtactagattgttgtattccaattatggattgctatatataacaactgatcattatatctctgcaacacggtttgtagcttggaaatag

SEQ ID NO: 4702 - DNA, 288 bp, Neisseria meningitidis
atgcaattagagattatcggtagtaaaatttatacggaacaagattttcataatcaaatttcaaaaatattttctatacaagattattatgggaacaatcttgatgctttatgggatttattaagcacaaatgtagaacgaccgattactttggtatggaaagatgctatgttctcaaaaaatcaattagaaaatatatttattgaaatcgtaaatgttctagaaagagttaagaaacaagatgaggattatggattcgaagaaaaatttaattatattttagagtaa

SEQ ID NO: 4703 - DNA, 1239 bp, Neisseria meningitidis
gtgattgcatcgctgacgggcgcggccgtgggcggcacgccggtagatgcgcaaaccggaggtgcggtcggacagaatgcggtggaaaacaacctctatctgacatcggaagccttaaagaaggacaagcagacagctcgtaaaatttattccgtcataaaagagcaagtcaagcatgaatgcagttccacaggaagaattaccgaatgtcgtcaaaatataggacgcattatcgaatttacccaagacaaacgctttgacagtaggtttaaggacttaaaaaaagaatccttatattacctaaataaacatcctgatttagtagcctcttatttgaaggctgaatacgaaaagctggatagggaagacaaaagtatcctgcaccgctacatctcacccggggctgaaatcgtttcgggcagtttgggggttgttctttcaggagtagccggaggcggatcttgtgccgagactttcggcttaggctgtgccgccgctttggttggtgtaacgtcttcctacgatcatgtcattactgggacgaaaaacttcggaaaaaaagccagcgagcaacgaccgacgattgcggttcaggccttgaagcagttggggctgtcggagcaggctgcggaatatgttcagttctctatagatttgttcagtgtgggtaaatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataagaaaggcacagtaacaggagggcatagtctaacccgtggtgatgtacgggtgatacaacaaacctcggcacctgataaacatggggtttatcaagcgacagtggaaattaaaaagcctgatggaagttgggaggtgaaaacgaaaaaaggtgggaaagtgatgaccaagcacaccatgttcccaaaagattgggatgaggctagaattagggctgaagttacttcggcttgggaaagtagaataatgcttaaggataataaatggcagggtacaagtaaatcgggtattaaaatagaaggatttaccgaacctaatagaacagcatatcccatttatgaatag

SEQ ID NO: 4704 - DNA, 423 bp, Neisseria meningitidis
atgatgaaaagaattaagtgcttttgtgataaatttccatcaggagatacatttagaatgtgtatcattctggatgactatgataatagggttgattattatgtaggaatatatgattacattacgtctaccttaatgagcgatatttactatcgatccacgattgatgagcatttcaagattatagaattaatagaaaataatccaaatgaaatttatgatgatggcggtggtcaacaattttgcctagaatttcatcatgataaggtcattttttaccacaatgaatttgatgaagaagatggttatccagtattaagctgttcgctgcatacttttaaaactgctttaattgcttggaatgcttttttgcaattgcctaaaagtattcattcggtggtggagactgtgattgaggaataa

SEQ ID NO: 4705 - DNA, 225 bp, Neisseria meningitidis
atgaggctggcaaccaaggatttggcggaagccattaggaaaggacaggttcgcaaatcaagctttaacacagaacaattaagggcaattgaaaaaggagaatctaaaataccggattacacttggcatcatcatcaagatacaggaaggatgcaattgattcgtgaaggcttgcatcatgataccggccatattggttgggaagcaatgaacaaaggaaggtaa

SEQ ID NO: 4706 - DNA, 420 bp, Neisseria meningitidis
ttgggaagcaatgaacaaaggaaggtaactatgtggaaaatcataaaagaggatagtgatgatttagaatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaa

SEQ ID NO: 4707 - DNA, 390 bp, Neisseria meningitidis
atgtggaaaatcataaaagaggatagtgatgatttaggatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaa

SEQ ID NO: 4708 - DNA, 942 bp, Neisseria meningitidis; identical to SEQ ID NO: 313

SEQ ID NO: 4709 - DNA, 1269 bp, Neisseria meningitidis
gtgaaaccgctgcgcagactgacaaacctccttgccgcctgcgccgtagcggcggccgcactcatacagcccgccctcgcggcggacttggcgcaagacccgttcattaccgataacgcccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcaaacatcaacggcacaatcggctaccacacccgcttttccggacacggacacgaagaacacgcccccttcgacaaccacgccgccgacagcgcgagcgaagaaaaaggcaacgttgacgaaggctttaccgtataccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatatccgacaattacagcaacctcggcagcaatttctccgaccgcgccgatgaagccaacagaaaaatgttcgagcacaatgccaagctcgaccgctggggcaacagcatggagtttatcaacggcgtcgccgccggcgcgctcaacccctttatcagcgcgggcgaagccgttgaccagtggatgcaggaaaaccccaatgccgccgaaaccgtcgaagccctggtcaacgtcctgccgtttgccaaagtcaaaaacctgacaaaggcggcaaaaccggggaaggctgcggttagtggggatttctcagactcctacaagcataacactgcttcaagattatctcagtctgtagatggagaaatgtttcaaacccgcaatgttgattttaaagcaaaatctattgggactaaaattcatgatggagctcaagggaaacatatttcaggacatagaaactacattgaaggtaagagtactttaaatcaaaacattaatcctcaagaattgttgaacggaatacattcaggtgcttatccagttatttctaaaggagcaagaggaaatcctgttgttgattttgggtatcctataggcagcgatgggaaatcaggattaagtaccaattttggtacgattcattcaggtaaaaatggagttcacattgttccggctaaccctaaaaccattaaaaaggtgcaatag

SEQ ID NO: 4710 - DNA, 318 bp, Neisseria meningitidis
atgaatatattaccaagctggctgcgagtcggtatgaatatagcaatgctgggcatgatacactcagatatcaggttaattaccgtagattacgaggaaggaagaaggtttttaaaaatcaaaaattatttatcaagagaagccatcacagaagaccatgaagatatggaatatttgattacagagttatggtctatgtgtggagaatattttgatgaagctgactttgaatgtatttattctaatcattcttctatggagttaaaccaaataaatggtgcagtattcaggagaaaggaattaatttcgcaagcgtag

SEQ ID NO: 4711 - DNA, 708 bp, Neisseria meningitidis
ttggtcaaaacggcagacggctacaaagccattgcccgtatccgaaccggcgaccgcgtcttcgccaaggacgaggcaagcggaaaaacgggatacaaacccgttaccgcccgatacggcaatccgtatcaagaaaccgtttacattgaaatttcagacggcatcggcaacaaccaaaccctgatttccaataaaatccacccgttttacagtcaaggaaaatggatacaggcaggtcgtctgaaaaaaggcgacaccctgctttccgaaagcggcgcaaaacagacggttcaaaacattaccttcaaacagcagccgctcaaagcctacaatctgaccgtcgccgattggcatacctacttcgtcaagggcagtcaggcggaaacggaaggggtttgggttcataatgattgtccgtatgataaaggcaaccaacgatataaagacgcttcttatcatggcaaaaatgataattctgtgaaaagtagagcaccaacaaacggacaagcagctcttgataattccgttcaagttaaatcaacttctcctcgaagagttggggttgataaagccaataatgaaatcgttgtattaaacaaaactcaaacttttaataacggttctgcggaatatcacgggcatgtcagaagttggcaagatttgcataccgatcagaaaaatgctttaaaaaaagcaggattggattag

SEQ ID NO: 4712 - DNA, 330 bp, Neisseria meningitidis
atgactgataaaagtaaaacagaaaagttgatttcttctgatgataaacaaagtgttatagatggcattcttgatatggtatttaattccaaagcatatgaagtaccgtggatttctgagaaattgatggaattatcgaaaaataaagacttggatattgccggattatcgctaacctgtttcggacatctcgccaggctacattcaaatatcggtgattacgataaagttattcctttactacattcaaagcaagatgatccagagcttcaaggtagggctgaagatgcgttagaagatatttctttatttttatctgaaaatcattag

SEQ ID NO: 4713 - DNA, 204 bp, Neisseria meningitidis
ttgagaactgagttcttcaaaaatcctacacttgctccttccacggcagcaccttggtcaaaacggcagacggctgaaaagcaaacaccgtccgtcgtgttgccgtttgcggatgagtacgggtcaaccccaatgccgccgaaaccgtcgaagccgccttcaacattgccgccgccaaagccgcaaagttggcaaaaacggtaa

SEQ ID NO: 4714 - DNA, 261 bp, Neisseria meningitidis
ttgctccttccacggcagcaccttggtcaaaacggcagacggctgaaaagcaaacaccgtccgtcgtgttgccgtttgcggatgagtacgggtcaaccccaatgccgccgaaaccgtcgaagccgccttcaacattgccgccgccaaagccgcaaagttggcaaaaacggtaaaaccggggagataaaagccgatggcaggaaagtaaatgtgaggatagacagtacggaggcagacctgctttatccggcagggcaataa

SEQ ID NO: 4715 - DNA, 402 bp, Neisseria meningitidis
gtgaagattaaaccattacaattttctaacaataatcacagattttatgtggacaaaatttgtgttaccgaacaagatgtgaacattttggcatccgaccgaaattatgaattaaatattgaaatatttattgacaatataattcattttcaaataacggatgaatcttataaagtaaaattttcagaatatttatttgaaaataaagaaaaaaatgattgggatagaaatcctgctataaattattttttcgagataatagatgatagttatatggactggttgaaagaagaaagttttgatttttttgaaaagaaatattataaggcttatattttcttttttagcgattctgtaatagaagttatcagctcgacagaacctgtattttattcaaaataa

SEQ ID NO: 4716 - DNA, 390 bp, Neisseria meningitidis
atgtggaaaattagtaaagaaaattgtgaagatttaggatttgcaatagtctgtatgttctatgatgctattaatctttctgaatttaaattatggttggatatagttgtcagagatattcctattgatacaattccattgtatatttttgatttgattgattttgataagagtataggggaaatttatgatgtaattggagtcgttaattatggttacatttcaaatgatcaaaaaaatgcattaacgggcattgccttcttaagggggatagatgtctatgatccgcctatttcaaaagaaaaagcattaaaagccttagagaaatatcctgaaatttatcagaggtttcagcatttctttccttttgtagagcttccgcttttttaa

SEQ ID NO: 4717 - DNA, 2301 bp, Neisseria meningitidis
atggcacattacgcaatcggcgacatacaaggctgtttcgacgaactgaccgcgctgctcggcaaaatcggtttcaaccacggcacggacaccctctggctgacgggcgacatcgtcaaccgcggcccgaaatccctcgaaacgctgcaattctgcatccggcacgaaaacagcgtgcaaatcgtcctcggcaaccacgacctgcacctgctcgctgtcggctgcggcgaaggtgcgcccaaacgcagcgacacaatcgaacccatactcaaacaccccgacggaaaaaaaatgctcgactggctgcgtgcgcaaccgctgttgatacgcgagggcagccgcgtgatggtacacgccggcatcctgccgcaatggcgcataaccaaagccgaatcgctcgctagagaagccgaagccgaactgcgcggcaaaaaatacgtcaaattcttctccaaaatgtacggcaacaaaccggccgcgtgggacgaaggtttgaaaggctatgcccgcctgcgcttcatcgtcaacgccttcacgcggatgcgcgccctgacctttaaaaacgaactggatttcgactacaaatccacagtgaaaaaaatgccgccttacctgcgcccgtggttcaaagcccccgaccggcaaaacctcgacgcacatcatcttcggacactggtcctcgctgggctacacgaatgccgacaacgtcatctcgctggacaccggcgcgctgtggggcggacagctgaccgccgtcaacctcgaaacggaagaaattacccaagtccaagccgccggcggcatagactggaaaagcttcgcaaaataacggaccgccccactatgcacaaaatcctgcccatcgcccacgtcctctcccgactgggtatgctgttttcctttatcctgctgatacccgccgccctctcctacgccttttcggacggcgcgtacaccgccttcgccaccaccgcgaccgttaccctttccggctcgtgcatcgtccggctcgccaccctccggttcaggcgcgaactgcgcccgcgcgacggctttaccctcgtcctgatgttgtggctggcgtttgccgctatggctgcgatgccgatgtacctgtatttcccgaatatgggctttaccgacgcattttttgaatcgatgtcgggactgaccaccaccggcgcgaccgtcatcccccacgtcgacgggctcgccccctccgtcaacttttggcggcatatgctcaactggctgggcgggatgggcatcatcgtccttgccgtcgccatcctgcctatgctcggcgtaggcggcacgcagttattcaaagccgaaatccccggcattgacaaagaaagcaaaatgtcgccgcgcatttcccaagtggcgaaaaaactttggttcggctacaccctgatcaccatcctcgcggcagcctgcctgcattttgccgggatgggctggttcgatgccgtctgtcacgcgatggctaccctctcgctgggcgggttttccacccacgatgccagcatagcttattacaactcccccctcatcgaagcggtcatcatcgttttcaccattgtcggcggcatcaattttgccaaccatttcgccgccctcaacagccgcagcctcaaaacctattggaaagacgaagaatgccggacgatgctgctgctgctctccggcagcatccttgccgccgccctgtacctgtggcacaccggctattacgccggttttaccgaatccctgcgctacaccgccttcaacttcgtctccatcggactggcaaacgggctggccaacaccgacttcgcacaatggccgctcctgatttccctgtggatgtttttcctcgccaacatcctcgccaactccggctcgaccggcggcggcatcaaaaccatacgcgccctcgtcctgttcaaattcagcctgcgcgaaatgatggtgctgctgcaccccaaagccgtccgcaccgtcaaaatcagcggcaaggccatacccgaccgcctcgcgctgaccgttatgtccttcatcttcatctactttatgaccgtcgtcctcttcagcttcctgctgatggcgagcggtatggaatttaccaccgccttcaccgccgtcatcgcctgcatcaccaacgccggccccggcctgggcgaagtcgggcccgccggcaattacgccggtttggacgtgatgcagaaatggatctgcgttaccgccatgctcttgggcaggctggaaatcttcaccgtcttcatcctcttcacccccgcctactggaagaaataa

SEQ ID NO: 4718 - DNA, 390 bp, Neisseria meningitidis
atgtccaaaaccatcatccacaccgacaaagcccccgccgccatcggcgcgtacagccaagccgtccgagcaggcgacaccgtttacatgagcggtcaaatccccctcgatcccgccacgatgaccgtcgtcggcaacggcgatttccgcgccgaagcgcgccaagtgttccaaaacctgcaagccgtcgccgaagcggcaggcggcacgctggccgacatcgtcaaactcaacgcctacctgaccgacttgggcaattttgccgtcttcaacgaagtcatggcggaatttatcgccgagcccttccccgcccgcgccgccgtcggcgttgcctcgctgcccaaaggcgtgcaggtcgaagccgaagccgtcctcgttttgaacgcataa

SEQ ID NO: 4719 - DNA, 525 bp, Neisseria meningitidis
atgaaaaaagcacttgccacactgattgccctcgctctcccggccgccgcactggcggaaggcgcatccggcttttacgtccaagccgatgccgcacacgcaaaagcctcaagctctttaggttctgccaaaggcttcagcccgcgcatctccgcaggctaccgcatcaacgacctccgcttcgccgtcgattacacgcgctacaaaaactataaagccccatccaccgatttcaaactttacagcatcggcgcgtccgccatttacgacttcgacacccaatcgcccgtcaaaccgtatctcggcgcgcgcttgagcctcaaccgcgcctccgtcgacttgggcggcagcgacagcttcagccaaacctccatcggcctcggcgtattgacgggcgtaagctatgccgttaccccgaatgtcgatttggatgccggctaccgctacaactacatcggcaaagtcaacactgtcaaaaacgtccgttccggcgaactgtccgccggtgtgcgcgtcaaattctga

SEQ ID NO: 4720 - DNA, 195 bp, Neisseria meningitidis
atggaaaacgcagccgcatcccccgccgggcgtttcagacggcacagccgccgccggaaatgtccgacgcttaaggcacagacgcacacaaaaccgtatgcctgcacctgcaacaatccgacagataccgctgttttttccaaaccgtttgcaagtttcacccatccgccgcgtgatgccgccgccaccatttaa

SEQ ID NO: 4721 - DNA, 1176 bp, Neisseria meningitidis
atgcacaccatttcctttccaaaccgcacccgactcaccgccctgccgcccctgtcgctttacatccacatcccgtggtgcatcaaaaaatgcccgtattgcgacttcaattcccacagcctgaaaaacggattgcccgaagccgcctatatcgacgcgctgctgaccgatttgcagcttgaattgcccaatatttggggcaggccggtggaaacgatctttttcggcggcggtacgcccagcctgtttcaggcggaatcgattgaccgtttgttaagcggcgtgcgttcgctgttgcgcttgcagccggaagcggaaattaccttggaagccaatccggggacatttgaaatcgagaagtttcaaggatttaaagacgcgggtattacgcggctttctatcggcgtacagagtttcaacgacgatatgctctcaaggctggggcgcgtccacaacggtaaggaagccttaaccgctatcgataccgccttgaaattatttgataaagtcaatatcgacttgatgtatgccctgccgaaccaaaccgttcagacggcattggacgacgtacaaaccgctatcgctacgggcgcaacccacatcagcgcgtatcacctgacgatggaaccgaacacgccgttcggtcatacgccgccgaaaggtttgccgcaagacgaagccgccctcgacatcgaagacgcggtacacggcgcgctggaaggcgcgggttttgtccactacgaaacatcggcttttgcgaaaccagccatgcagtgccgccacaatttgaactactggcagttcggcgattatttaggcataggcgcgggcgcgcacggcaaaatttcctatcccgaccgcatcgagcgcaccgtccgccgccgccaccccaacgactacctcgccttaatgcaaagccaaccgagtgaagccgtcgaacgcaaaaccgtcgctgccgaagatttgccgttcgaattcatgatgaacgccctgcgcctgaccgacggcgtacccgccgcgatgttgcaggagcgcacgggcgtaccgagtgccaaaatcatggcgcaaatcgaaacggcaaggcaaaaaggcctgctggaaaccgaccctgccgtattccgcccgaccgaaaaaggacgcttgtttttaaacgatttgctgcagtgttttttatag

SEQ ID NO: 4722 - DNA, 2526 bp, Neisseria meningitidis
atgaatccaaactcaaaacataacactaactttaccaatcttcttaaaccgtctgatagtgatataaaacaatttgccgcacaacacatctgccgcctcaccgacctcctcaaccgctacgcctacgaatactacaccctcgacgcgcccagcgtacccgatgccgaatacgacaaattgttccgcgaactcgaagcgttggagttaaaccatcccgagctcaaactgcccgacagcccgacccagcgcgtcggcggcgagcctttggcgggatttgccgaagtacgccacgaagtgccgatgctgtcgctgaccaacgctttttccccgcaagatgaaaacggcgtgttcgaccatgccgaaatgtacgccttcgaccaacgcgtgcgcgacggcttggacggcggcaatcccgaatacgttatcgaacccaaattcgacggcctcgccatcagcctgctctaccgcgacggcgtattggtgcaggcggcaacgcgcggcgacggcacgacgggcgaagacgttacccaaaacatcaaaaccgtatccaacatccccttgcggctgcacggcgaaaatacgcccgaactcatcgaggtacgcggcgaagtgctgatgctcaaagccgattttgtcgccctcaataaaagacaagccgaaaacgggcaaaaaccctttgccaatccgcgcaacgccgccgccggcagcctacgccaactcgattcgcgcatcaccgcgcaacgcaaactgcactttttcccctactccgtcgcccgccagcaagatggtttcgtcgcggaagaacacatccaggaactcgcctatttccaagcactcggcttcagtctgcccaatggcaatttcggctgtttcaaaaatatcgacgaagtattggcgttttacgaacacatgcagcaaaaacgccccgaactgccctacgaaatcgacggcatggtcgtcaaagtcaacagcttggcgcaacagcacgaactcggcttcatctcccgcgcgccgcgttgggcggttgcccacaaattccctgccgaagaagccctgaccattgtcgaagcgattgacgtgcaaatcggcaggacgggtgcggtaacgccggttgcccgattacagcccgtattcgtcggtggcgtaactgttaccaacgccaccctgcacaatcaggacgaagtatcgcgcaaagacgttcgcgtcggcgataccgtcgtcgtacgccgtgccggagacgtgattcccgaagttgtgcgcgtgatttttgaacgccgcccgatgcgggaaaccgccgttgccgtttcagacggcatcgggcatcggcaggacgatttgtttgccgaaacaccgtccgccaatcaaacccaatccgttccgctccacaagccctaccgcctgccgacccactgccccatctgccgcagcgaaatcgaacgcgaagaaggcgaagccgtcgcccgatgcagcggcggtatgctttgtcaggcacaacgcgcgcaaggcttaatccacttcgcctcgcgcaaagcgatggacatcgacggcttgggtgaaaaacaaatcgaacagcttgtcgcgcaagacctcgtccgccacttcgccgatctctaccgcctcgacatcccgaccttgcaaaaaatgaaggaaacagcggacaaaaccgttgccgaatcggatcaaatgccgtctgaaggcagttcggtcggcgcgtcgggcaaacataaaaaacaaccagtcaagtgggcggaaaacatcctcgcaggcatagaagccagcaaaacgcccgaactcgcccgcttcctgttcgcgctcggcatccgccacgtcggcgaacgcaccgccaaaacgctggcacaggcattcggcacattggaacgcgtccgccgcgcccccgaacccgtcctcgcctgcctgcccgacatcggtacggtagtggcgcgttccattgcccacttcttcgcccaagccgaacagcaggcgatgatagacgaactgctcgccgcaggcgttgccccgcaaacccaagccgttaccatcccgcccgcccgccacgccgaaccgcaacgctggatcgcccgcctgcccggtttcaaaatcagcgaaaacaaagcccaagccttatgggaactcgccggcaaaaacatagaagggctgcaaaccgacaaagccctccccaccgactggcaggcgtggcgcagcgaaccacaaaacgccgccctgctcgaaaacctgaaaaccttcttcgcgcaaatgccgtctgaagacgaggcggcgcaaggttcagacggcatcaataaagccgtggcgggcaaaaccttcgtgttaaccggcaccctgcccaccctcaaacgcgaccaagcccaatccctaatcgaagccgcaggcggcaaagtttccggcagcgtgtccaaaaaaaccgattacgtcgtcgccggagaagccgcgggcagcaagctggaaaaagccaatgccttgggcgtttccgtcctcagcgaagccgaactgcttaccctgctcggctga

SEQ ID NO: 4723 - DNA, 1287 bp, Neisseria meningitidis; identical to SEQ ID NO: 525

SEQ ID NO: 4724 - DNA, 573 bp, Neisseria meningitidis
atggacaatcacgccgaagcacactggcaaaacggctggcttcaaagcatacgccataccccgtcgcccaatttcagcccgagggaaacgggggaaacggtttccctgatcgtgttgcacaacatttcgctgccgccgttcgaatacggcacggatgcggtggaaaagctgtttgccaaccggctcgaccccgacggacatccgttcttcagcctgatacacactttgcgcgtatccagccatttcttaatcaaacgcgacggagaaacggtacagttcgtttcctgcgacaatatggcataccatgccggcgtatcttcattcggcggcagggaaaaatgcaacgcattttcaatcggcatcgaactggaaggctgcgatttcgaaccgtttgccgaagcgcaataccgttcgctcgaagccttgttggacgcaatctgccgccactaccccgtcacggcggtaacggggcaccaagacatcgcgcccggccgcaaaaccgaccccggccattttttcgactggcggcggatacgggagaaagggtttctcgtggacagaaatgccgtctga

SEQ ID NO: 4725 - DNA, 996 bp, Neisseria meningitidis; identical to SEQ ID NO: 31

SEQ ID NO: 4726 - DNA, 621 bp, Neisseria meningitidis
atgaaaccgcaattcatcactttggacggcatagacggtgccggcaaatccaccaaccttgccgtcatcaaggcatggtttgaacggagggggctgcccgtgctgttcacgcgcgagccgggcggaacgccggtcggtgaggccttgcgcgaaatcctgctcaaccctgaaaccaaagccggtttgcgtgcggaaaccctgatgatgttcgccgcgcgtatgcagcacatcgaggaagtcatcctgcccgcgctttcagacggcatacacgtcgtgtctgaccgttttaccgacgcgaccttcgcctatcagggcggcgggcgggggatgccgtctgaagacattgaaattttggaacattgggtgcagggcggtttgaagccggatttgaccctgctgctggatgtgccgctcgaagtgtcgatggcgcgtatcgggcagacgcgcgagaaagaccgtttcgagcaggagcaggcggatttctttatgcgtgtgcgcggcgtttatctcgaccgagccgccgcctgtcccgaacggtacgccgttatcgacagtaaccgcaacttggatgaagtcagaaacagcatagaaaaagtgttggacggacatttcggctgctga

SEQ ID NO: 4727 - DNA, 1281 bp, Neisseria meningitidis
atggaaaactcattgaaagaagccgccctcaagttccacgaattccccgtgccgggcaaaatttccgttaccccgaccaaatctctggcgaccgacaaagatttggcgttggcgtactctccgggcgtagccgctccttgtatggaaatccatgccgatccgcaaaatgcctacaaatacaccgccaaaggcaacttggtcgctgtcatttccaacggtacggccgttttgggcttgggcgacatcggcgcgctggcgggcaaacccgtgatggaaggcaaaggcgtattgttcaaaaaattcgccggtgtggacgtgttcgacatcgaaatcgatgaaaaagacccgcaaaaactcgtggacatcatcgccgctttagagccgaccttcggcggcatcaacctcgaagacatcaaagcacccgagtgtttctacatcgaacgcgaattacgcaaacgctgcaaaatccccgtattccacgacgaccagcacggcacggccatcattaccgccgccgccgtattgaacgccctgcgttttaccggccgtaaaatcgaagaagcgactttggtgtgttccggcgcaggtgcggccgcgattgcctgcttgaaccaattgctggatttgggcttgaaacgcgaaaacgtgaccgtttgcgactccaaaggcgtgatttaccaaacccgcgaagacaaagaccgtatggacgagtccaaacagttctacgccattgaagacaacggccagcgcgtgcttgccgatgccgtcaaaggcaaagacatcttcttgggcctctccggcgcgaacctgctgacgcctgaaatactgaacaccatgaacgaaaaacccatcgtgttcgctatggccaacccgaatccggaaatcctgccgccgctggcgaaagaaacccgtccggacgtggttatcggtaccggccgctccgacttcccgaaccaagtgaacaatgtattgtgcttcccgttcatcttccgcggtgcgttggatgtcggcgcgacgaccatcaacgaagaaatgaaacgcgcctgcgtgtatgctttggcggatttggcgatggaagaagtaaccgaagaagtggttgccgcttacggtaagaaatttgaattcggcgcggaatacctgattccgactccgttcgattcccgcctgctgccgcgcgttgctacggctgccgccaaagcagcgatggaaagcggtgtggcaacccgtccgattgcagatttggaagcttacgctgccaagctgagcgaatggaagctgtaa

SEQ ID NO: 4728 - DNA, 1035 bp, Neisseria meningitidis
atgccgaattgtttcaaatttcataccgttatcgaacggcattggcaaaaaccttatccggttttgtcttttctgcttaagccgctctccgggctgtttgccaaaattgcggcaaaacggcggacggattttttatcgggaaaacggcaaagcgaaaagctgcccgtgcctgtggtcgtggtcggcaatattcacgcgggtgggacggggaaaacgccgattgttgccgcgctggtgtcgggtttgcaggaaaagggcgtcaaggtcggcatcatcagccggggctacgggcgcaagagcaaggcggttcatgtattgaatgctgagagccgagcggaagatgcgggcgatgagcctttgctgctgttccgcaaaaccggtgcgccgacggcggtgggcagcagccgtgcagaggcaggcagggcgttgctggcggcgcatcccgacatcggactgattgtggcggacgacggtttgcagcattacgccctgcggcgagatgtggaaatcgcggtgtttccggcggcggatacggggcgcacggatttggatttactgcccaacggcagtttgcgcgaacctttgttgcggctggattcggtggatgcggtcgtcgtcagcggcggcaaggcggatgcgctgtttaggccgtctgaaaatatgtttcacagccgtatcgaagcgggacggatttaccgtttgaacaatccgtccgaaatactggacacaggccgtctgaaaaatcaaaccgtcgtcgccgtggcaggtattgccaagccggcgcggttttttgattcgttgcggaatatgggcattaccgtgaagcgaaccgtcgcgctgcccgaccacgccgacatttcggcggcagatttgcccgatgcggacgcggtcattattacggagaaagatgcggtcaaattttcagacggcatttgcaccgataatgtttgggtgttgcccgtttgtgcgataatcgaacctgatttggcggcgtttgtgttggagcggttggaagatgtaccgaaggccgtctga

SEQ ID NO: 4729 - DNA, 588 bp, Neisseria meningitidis; identical to SEQ ID NO: 2597

SEQ ID NO: 4730 - DNA, 183 bp, Neisseria meningitidis
atggaaaaaaaattcttagacatcctcgtctgccccgttaccaaaggcaggctggaatatcatcaggacaaacaggaattgtggagccgtcaggcgaagcttgcctatccgattaaagacggcattccctatatgctggaaaacgaagcgcgagcgttgagcgaagaggaactcaaagcatga

SEQ ID NO: 4731 - DNA, 762 bp, Neisseria meningitidis
atgaccgaattcgtcgtattgattccggcgcggctggattcgtcgcgcctgcccggaaaagccttggcggacatccacggcaaaccgatggtcgtgcgcgttgccgaacaggcggcaaaaagtaaagccgcgcgcgtcgtcgttgccaccgaccatcccgatattcagacggcctgtcaggcgcacggtatcgaagtcgtcatgacttcaaaccggcacgaaagcggcacgacgcgccttgccgaagcctctgtcgcgctgaagctgccgccgcatttgattgttgtgaacgtacagggtgacgagccgctgattgcccccgaactcatcgaccgcaccgccgaagtactcgtcgaaaacaacgtccaaatggcgaccgccgcccacgaattgcacgatttcgacgaattgatgaatcccaacgccgtcaaagtcgtcctcgacaaaaaccgcaacgccatctacttcagccgcgccccgattccctatccgcgtgatgcgatacgtgccggaaaacgcgaaatgccgtctgaaaccgccgtcctgcgacatatcggcatctacgcttaccgcgccggcttcctgcaacgctatgccgaaatgagcgtttcgccgctggaaaccatcgaatcgctggaacagctgcgcgtcctgtggcacggttatcccattgccgtcgaaaccgccaaagaagcccccgccgccggtgtggatacgcaagaggacttggacagggttcgcgccgtatttcagaccgtataa

SEQ ID NO: 4732 - DNA, 402 bp, Neisseria meningitidis
atgcagcaacatattgaaaagtggcaacacttgagccgggaagaacagaaaatccttgctgaagtatggggtctcgtgcaaaacgacgatcaggaggttcactatgaaatgctcaaattgaacgcacccgatgaagccagcggcgaattttggttcagaatggcagaaacactcagcaccctgccgcccaaccgttccctcggccttagaatgaacggcggcaggctggcgaccgccgtatccatcctttccgtcatgattgaagacaatcccgacataccgcagctttgggcgcaaaaaattaccgcgctcaattatagtggattaaatttaaaccagtacggcgttgcctcgccttgtcgtactatctgtactgtctgcggcttcgtcgccttgtcctga

SEQ ID NO: 4733 - DNA, 117 bp, Neisseria meningitidis
atgcacaaaagcattttgcttgaggatgtggcagtcaggaatatttccattcaggaagaaaagaagtgcctgattgggtataatcagggtaaatcttattttatttcaaaagattaa

SEQ ID NO: 4734 - DNA, 786 bp, Neisseria meningitidis
atgagcagaatccggcaggcttttgccgctttggatggcggaaaggcattgattgcctatattacggtgggcgaccccgatattcggacaactttggcattgatgcacggcatggttgcaaacggtgcggatattttggagttgggtgtgccgttttccgatccgatggcggatgggccggttattcagcgtgcggcggagcgggcgttggcaaacgggatttcgctgcgcgatgtcttggatgtcgtcagaaaattccgtgaaaccgacacgcaaacgccggttgttttgatgggatatttgaaccctgtacataagatgggttatcgggagtttgctcaggaagccgcaaaggcgggtgtggacggcgtgttgacggtggattcccctgtcgaaaccatcgatccgctctatcgcgagctgaaggataacggggtcgactgtattttcctgattgcgccgacgacgacggaagaccgtattaaaaccattgccgagctggcaggcggatttgtctattatgtttcgctcaagggcgtaacgggcgcggcaagtttggatacggatgaggtttcgcgtaaaatagagtatttgcatcagtatatcgatattcccatcggtgtcggtttcggcatcagcaatgcggaaagtgcacgcaaaatcggccgggttgccgacgcagttattgtcggcagccggattgtgaaagaaatcgaaaacaatacaggcaacgaggctgccgccgtcggtgctttggtaaaagagttgaaggatgccgtgcgctga

SEQ ID NO: 4735 - DNA, 873 bp, Neisseria meningitidis
atgagctggttagataaaatcctgccacccaaaatcaagaatcgcggaaaagacggttcttccaatgttcccgagggtctatggcacaaatgcccgtcttgttcggcaaccgtttattctaccgagttgcagcagaacaatcaggtttgtccgaaatgcaaccaccacaatccgttgtcggcacgacaacgcctgaacctgcttttggatgaggatggcagggaggaagttgccggaaatgtcaaaccgacagatcctttgaagtttaaagacggcaaaaaatatccggatcgtttgagtgcggcacgcaagctgaccggggaagatgatgctttggtggtgatgaaaggcaagatgaacggcctgcccgtcgtcgttgctgcgtttgagttccgctttatcggcggttcgatgggttcggttgtgggcgaacgattcgtacaaggtatccgtcgggcggttgccgacaattgtccgttcgtctgtgtggcggcttccggcggcgcgcgtatgcaggagggtgtaaactcgctgatgcagatgacgaaaaccagtgccgcgctgcatttgctgacggaaaaacgcctgccatttatatcggtgttgaccgatccgactatgggcggcgtatccgccagcttcgcatttttgggcgatgtcgtgcttgccgaaccgaacgcgctgatcggttttgccggtccgcgcgtgattgagcagacggtgcgcgaaacgctgccggaaggcttccaacgcgccgagttcctgctggaaaaaggcgcaatcgaccagattgtcgaccgccgcgatatgaagcggcgcatcagtgatttgattacgctgttgtgccgtcaggacaaagtttccgccgcctga

SEQ ID NO: 4736 - DNA, 612 bp, Neisseria meningitidis
atgcgccgcaccgccctcctgctgctcgcactcgccgccggcacgtccctcgctgccggcttcagccaaaaagacacgccgatcaacacccgctaccgcgaaacgcccgaagaggccgccgcccgcgaatttaaagaacataccgccaaactgccgccgctgcccgatacgcactcggacggctggttcgacatttatgtggatgaaaattacggcaaacagccgaaaatcctgctcgacagcctgcaaattatgcccgcgcccgacggcagcatccgctacattctcaatatccgctccgacaaaggctacgacaacctgactgccaaaggcatattctgcgcccgcttctccatcaggttcggcaacggcaaaccttcctcctataaagtgttcggctacggcgacacggtcaaccgccgctggatacagccccgaaacgccgaatggaaaccgataggcggtacattaagccgcaacgacgcactgcgcaccgtcctgtatcaggcattctgcgagggcggtgtacccgccgacacgaaaggtttggtacaacgcctgaaagaacgtgccggacgctatgccccatcgataaagccgcacaacaaataa

SEQ ID NO: 4737 - DNA, 225 bp, Neisseria meningitidis
atgaacagcgaaactttagacgtaaccggattgaaatgtcccctgccgattttgcgggcgaaaaaggctttggcgcaaatgcagcagggcgacgtgttgaccgttctggcaaccgacggcggcgcaccgggggattttgaggctttttgccgccaaaccggtcatgtgctgttggatgcttccgaacaggacggcgtgttcacgctggtcgtccaacacaaataa

SEQ ID NO: 4738 - DNA, 1035 bp, Neisseria meningitidis
atgcaaaccctgaccattatccgccccgacgatatgcacctgcacctgcgcgacggcgacgcgctcaaagccgttgccccttataccgcccgccaaatggggcgcgccgtcattatgcccaacctcaaaccgcctgtcgtcagtgtagccgacgcgcttgcctacaaagcgcgcattatggcggcgttgcccgaaggtagcgcgtttgagccgttgatgacgctttatttgactgataacgccacgcccgaacttgtacgcgaagccaaagccgccggcatcgtcgccttcaaactctaccctgccggcgcgaccaccaattccgattccggcgtaaccgacctgttcaagctcatccccgtgttggaagaaatggcgaaacagggcattttgttcctcgttcacggcgaagtaaccgaccccgaaatcgacatcttcgaccgcgaagccgcctttatcgggcgcgtgatgaaacccgttttggcgcaagtgccgaatcttaaagtcgtgttcgaacacatcaccaccgccgaagccgcccgcctggttttggaagcaggcgacaacgtagccgccaccgttaccccgcaacacctcctgctcaaccgcaacgacctcttggtcggcggcgtgcgcccccatcatttctgcctgcccgtactcaaacgcgaaacccaccgtcaggcattggtcgccgccgttaccggcgagaaggcgcataaattcttcctcggcaccgactccgcgccgcacgccaaatccgccaaagaaaacgcctgcggctgcgccggtatgttcagtgcgatgaccgctatcgagctttacgccgaagtatttgaaaaagcaggcgcgttggacaaactcgaagccttcgcctcaaaaaacggcgcaaggttctacggcattcctgaaaataccgacacgatcaccctcgtcaaacaaagccaaaccgttcccgcaagtgttccctacggcgacggcgaacttgtcccgatgcgcgcgggcggcgaaatcggctggacggtgcagtattga

SEQ ID NO: 4739 - DNA, 426 bp, Neisseria meningitidis; identical to SEQ ID NO: 3197

SEQ ID NO: 4740 - DNA, 477 bp, Neisseria meningitidis; identical to SEQ ID NO: 3203

SEQ ID NO: 4741 - DNA, 324 bp, Neisseria meningitidis
atgaacgcatttgcacaagcactttcctcggcactcgaccgctgtatcgccaccaacaccgtcgccaaacaaaaccggcccgtcggcttcctctaccgcgaagcccccgtttttgaaaacgacagcggctggcgtttcttcagcggcgacgagaccgacgaatacaccgacgatccggacaacttcagcatcgtcagcctcgccgacatcgccaaaaccaaccctgaaaccgccgcactgctctcccaacccgaaggcagcgcatgggagcttgccgaagacggcacattccaaaccgtcgccgactggcagccgcaagactga

SEQ ID NO: 4742 - DNA, 720 bp, Neisseria meningitidis
atgaaagacgatgttttgaaacagcaggcacacgcggcgatacagaagaaactgggctacgcgttccgcgatatttcgcttttgcggcaggctttgacgcacaggagccatcatgcgaagcacaacgagcggttcgagtttgtcggtgattcgattttgaattatacggtggcgcggatgctgtttgacgcgtttccgaagttgaccgagggcgagttgtcgcggttgcgggcaagtctggtcaatgagggcgtgctggcggaaatggcggcggaaatgaatgtcggcgacggcctgtacttgggggcgggcgagttgaagagcggcggcttcagacggccttcgatactggcagacgcgatggaggcgatgtttgctgccgtcagcttcgatgccgatttcaacacggcggaaaaggtggtgcgccatttgtttgccgatcgcgtccggcgcgccgattttcaaaatcaggcaaaagacggcaaaactgctttgcaggaggcgttgcaggcgcgccgtttcgccttgccgaaataccgtatcgaagagcaaatcggttatgccaacgacagtatgtttgtcatttcctgcgatttgggcgaactgggtttcgtgtgccgtgccaaagggacgagccgcaaggcggcggagcaggaagcggcgaaagaggctttgaaatggctggaagagaagctgccgctgaagaggaaaaagaaatga

SEQ ID NO: 4743 - DNA, 975 bp, Neisseria meningitidis
atgaggcggcgcgtgaatatgccgtctgaacatatggatacgaaagcaaatatggatattgaaaccttccttgcaggggaacgcgccgccggcggataccgttgcggcttcgtagcgattgtcggccgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgcccggctttcaaaccgaccaccgcaacgcgctcaacgacaggctgaatcaaaatgttaccgaggcgctcggcggcgtggatgtggtggttttcgtcgtggaggcgatgcgctttaccgatgccgaccgcgtcgtgttgaaacaactgcccaagcacacgccggtcattttagtggtcaacaaaatcgacaaggacaaggcgaaagaccgttacgcgctggaggcgtttgttgcccaagtgcgcgccgaatttgaatttgcggcggcggaggcggtcagcgcgaaacacggattgcggattgccaacctgttggagctgattaagccgtatctgcccgaaagcgtgccgatgtatcccgaagatatggttacggacaaatcggcgcgttttttggcgatggaaatcgtgcgtgaaaaattgttccgctatttgggcgaggaattgccttatgcgatgaacgtcgaagtggagcagtttgaagaggaagacggtttgaaccgcatctatatcgccgttttggtcgataaggaaagccaaaaggcaattttaatcggtaaaggcggagaacgtttgaagaaaatttccaccgaagcgcggttggatatggaaaaactgtttgataccaaagtatttttgaaggtctgggtcaaagtcaaatccggttgggcggacgacatccgcttcctgcgcgagctgggtttgtag

SEQ ID NO: 4744 - DNA, 627 bp, Neisseria meningitidis; identical to SEQ ID NO: 3185

SEQ ID NO: 4745 - DNA, 492 bp, Neisseria meningitidis
atgagtaccgaaaccaaaaactacattacgcccgccggatggcaggcattgaaagacgagctttatcaactggtcaacaaagaacgccccgaaatcgtccaaatcgtcaactgggcggcaggcaacggcgaccgcagcgaaaacggcgactatctttacggcaaacgccgtatgcgcgaaatcgaccgccgcatccgtttcctgaccaaacgtttggaggctgccgtcgtcgtcgatcccgaattgcgcgaagcgaccgaccaagtgtttttcggcgcgacggtcggactgttgcgcgacgacgggcgcgagcaaaccgtcaaaatcgtcggcatcgatgaaatcgataccgcgcaaaacaaaatttcttggatttcgccgctggctcgttgtctgattaaagcgcgcgaaggcgacgaagtggttttgaacacgccggaagggcgtgaggaaattgaaatcctttctgtcgaatacatcaaaatcgactga

SEQ ID NO: 4746 - DNA, 1545 bp, Neisseria meningitidis
atgtgcggcgtattaggtttggtcagtcatgaacccgtgaaccagcttctgtacgacggcttgcagatgttgcagcacagggggcaggatgcggcgggcattgcaacggcggaaggcggtaccttccatatgcacaaaggcaaaggcatggtgcgcgaagtgttccgcacacgcaatatgcgcgatttgaccggcaacgccggcatcgcccacgtccgttatcctactgcgggcaacgcaggcagcagcgcggaggcgcagcctttctacgtcagctcgccgttcggcatcgttttggcgcacaacggcaacctcaccaacactgccgaactgtatgaaaacgtgtgtaacaaacacctgcgccacgtcaacaccagctccgattccgaagtcttgctcaacgtattcgcgcacgaattacgccgcgaagtctctaaaaacgccgacccgcaccggctcaatgccgacaatattttcaacgccgttgcccaagtccaccgcctggtgcgcggcgcatacggtgtgattgccatgattgcgggctacggtatgctcgccttccgcgacccttacggcatccgcccgctggtattgggttcgcaaaccgacagcgaaggcagaaaatcctatgccgtcgcctccgaatccgtcgccttcaacgcgcttacctacgatttggaacgcgacatccggccgggcgaagcggtatttgtcggctttgacggcacaatgattgcccgccaatgcagcgaccgtgccaaactcagcccctgcctttttgaatatgtttattttgcccgccccgactctgtgattgacggcgtatccgtttaccaatcgcgcttggatatgggcgtgtcgctggcggaaaaaatcaaacgcgagctgcccgtggacggcatcgatgtcgtgatgcccattcccgacaccagccgccccagcgcgatggagcttgccgtccatctcgacaaaccctaccgcgagggtttgattaaaaaccgctatatcggccgcacctttattatgcccggacaggcgacgcgcaaaaaatccgtgcgccaaaaactcagcccgatggaaaccgaatttgcaggcaaaagcgtgttgctggtggacgactccatcgtgcgcgggacgaccagccgcgaaatcgtcgaaatggtacgcgcggcgggcgcgcgcaaagtctatatcgcctccgccgcgcccgaagtgcgctatcccaatgtgtacggcattgatatgcccacgcgcgaagagttgattgccaacgggcgcagcgcggcggaaatcgccgccgaaatcggcgcggacggcatcgtatttcaagacttgggcgatttggaagccgtcgtcaaagcactcaatccgaaaatcgaatccttcgattcgtcctgtttcaacggcatttatcagaccggcgacatcgatgatgcctacctcgaccgcctgtctgccgagaaatccggctgcggcggtctgaaaatccacccgagcaggatggaacacagcatcagcatcagcgatgcgggcgacgaagaataa

SEQ ID NO: 4747 - DNA, 498 bp, Neisseria meningitidis; identical to SEQ ID NO: 3215

SEQ ID NO: 4748 - DNA, 999 bp, Neisseria meningitidis; identical to SEQ ID NO: 3535

SEQ ID NO: 4749 - DNA, 1275 bp, Neisseria meningitidis
atgaaaacactacaagactggctctcgcatttggaaaccgcccacagcggcggtttgatcgacatgggtttggagcgcacgagcgaagtgaaaaaacgcatgaagctcgagccgcaatgccccgtcgtcgttgtcgcgggaaccaacggcaaaggttcggtctgtgcctacctgacacagatttacaaacaggcgggctacaaaatcggtacgctgaccagcccgcatttattgcgttacaacgaacgcatcgccatcaacgccgaacccgtttcggacgatacgattattgcctctttcgagcgcatcgaagccgcgcgcggcgaaatatcactgacttattttgaattcaatgccttggcggctgtcgacatcttcatgcgcgaacaggttgacgtgatgatattggaagtcggcttgggcggccgcttggacgcggtcaacgcgtttgacggcgattgcgcggtggttaccagcgtggatttggaccatcaggcatttttgggcgatacggtcgagcaggtcggctttgaaaaagcaggcgtgttccgtagcggcaaacccgccatctgcggtcaaaaccccgcgcccaaatcgttgctttcacacgccgaagccataggcgcgaaactgctgatggtgcagcgcgatttcgagtttcacgcgatggaaaacatccaatggaactaccgcttccggccgcaacattcagacgaccccgcgcgcaaccgcaatgccctgcccttccccgcattgcgcggcacataccagctttccaatgccgcctgcgcgctgaccgtattggaatgcttgaacgacaaattgccggtggacatcggtgccatcaagcgcggtttgttgctggttgaaaatcccggacgcttccaagtcctgcccggccggccgctgaccgttttggatgtcggacacaatccccacgccgcccgcgccctgcgccgcagcctgattaatttggcgtttgcgcaaaaacgcaccgccgtgttcagcatgttgtccgacaaagacatagacggcgtgttggaaaccgttaaagaccagtttgacgagtggtatatcgcaccgttggatgtaccgcgcggcatgacgctcgagagcctgcaaaacaaactgcacgaacacagcatcgaaaacatacaaacattcgccgccgtccgcgaagcataccgggcggcagcctcaaaagcgggcgagaacgacagaatcgtcgttttcggctcatttcataccgttgccgatgtcatgtcggtactttaa

SEQ ID NO: 4750 - DNA, 447 bp, Neisseria meningitidis
gtgcgcgcctttcagacggcattgaggccgtcccgcatcctgaacatcctgactgtatcgcttcacgccgcctcccttgccgtctgcctgacttggttttacggccggatgatgtggttcggtttggcggctttggtggcaagttacgcatactcgctcaggataacgaatctgaaacaccgccatgccataaccgccattaccatagaccgcgacggacaggcggaaatcgtatccggcaaagacaaaacggcaaaggcggcggcactgtcgggcagcagtatggttacgccttatgccttattcttacaatgggacaccggcggcaaaaccgtccgccaatgcatcatgcccgacatgacggacaaagaatcctaccgcaagctgaaagtttgggtactttggcggcagccgaaaaaaaccgccgaaaccgatacatcagactga

SEQ ID NO: 4751 - DNA, 360 bp, Neisseria meningitidis
atgtattttgttgaccgcaccgccgtcgtcctcaagccgaccgcgcgctttttggaatggctcaaaagcaccgacgaaaatatgcccgacctgaccatagagcagcttcgtgccaactgttccgtcttcctcgttccgcagttcgacgaaccggaagccgtcgtttcctacttcgacgaacgctaccggcagattttcgaggcggagctggcaggttgggacatcgataaggataaatggccgcaagatatggggctgaaggcgttttgggaatttttcgacatcgaaatccacgatatagtgttgaacatggaagaagcggaattgaacattacccccgtgttcgacaacatgatgtaa

SEQ ID NO: 4752 - DNA, 729 bp, Neisseria meningitidis
atgatcaaattcaaaaacgtacacaaacatttcaaagacctgcacgtcatcaacggcgtaaacttggaaatcaaaaaaggcgaagtggtcgtcgtctgcgggccttcgggcagcggcaaatccacactcatccgcactgtcaaccagcttgaaagcatcgaaagcggcgagatttgggtggacggtgtcaacgttgccgaccccaaaaccgatttgaacaaaatccgcgaagaagtcggcttcgtattccaaggcttcaacctctacccgcacctgaccgtgttggaaaacattaccctcgcaccgatgaaggttaaggggcaaaatgcggaacaggcggagaaaaaggcaatggagcttttggaacgcgtcggactggcacacaaaaaagacgccttcccttcccaactttccggcggccagcagcaacgcgtggcgattgcacgcggtttggcgatggaaccgcgcgtaatgttgtttgacgaaccgacctccgcactcgaccccgaaatggtcggcgaagtgttgaaagtgatgaaagacttggcagaaagcggcatgacgatgatgtgcgtaacccacgaaatggggtttgcccgcgaagttgccgaccgcgtgattttcgtcgataaagggcaaatcctcgaagacgaaacgcccgaagcgttttttaccaacccgaaacacgaacgcgccaagcagttcctgcaacaggtcatgacccactga

SEQ ID NO: 4753 - DNA, 780 bp, Neisseria meningitidis
atgaaagaacacaaagcccgcaagcgtttcgggcagaattttttgcaggacacgcggattatcagcgatattgtcaacgccgtgcgcccgcaggcggatgatgtcgtgattgaaatcggcccgggtttggcggcgattaccgaacctttggcgaaaaagctgaaccgcctgcacgttgtcgaaatcgaccgcgacatcgtatgccgtctgaaaacgctgccgtttgcggataaactggtgattcacgaaggcgatgtattgcagtttgatttcaacggcatcgcaggcaaaaagaaaatcgtcggcaacctcccgtacaacatttccacaccgcttttgttcaagctggcggaggtggcggacgatgtcgtcgatatgcactttatgctgcaaaaagaagtggtcgagcgtatggttgccgcgccgaaaagcaacgactacggccgcttgggcgtgatgctgcaatattttttcgatatggaaatgctgattgacgtaccgcccgaatcgttcgaccctgcgccgaaagtggattccgccgtcgtccgtatgattccggtgaaacaccgcatcggcaaggcggacgatttcgagcattttgccaaactcgtgaaactcgccttccaccaacgccgcaaaaccatacgcaacaatctgaaagagcttgcaggcgacgatgatttgcaggcagtcggcatcaatccgcaagaccgcgccgaacatatcgcgccagagaaatacgtggcgttgagcaattatctggcgggcaaggtcgtctga

SEQ ID NO: 4754 - DNA, 690 bp, Neisseria meningitidis
atgctgtttgaaggcttgccgtgtttggcggtttggtgcaaaaaccggctgtctgccgttttgcctgttggaggattgaacgtgtctgaaaatctgcttgaaatcgaaacccatcccttcgatcccgtgttgccgccgaaggctgctgtcatgatgatggggacgtttccgcccaaggaagacaaacgcgcgatgcagtttcattatccgaatttccaaaacgatatgtggcgcgtttatgggctggtgttttttaatgatgcggcgcatttccaaaggttgtctgaaaaagcgtttgatgccgagaaaatcaaggcgtttttgcacgaacgggggattgcgtcctgtccgaccgttttgaaggcggtacgtcagcacggcaatgcgtccgacaagtttttaaaggtagttgaaaccgtcgatttggcggcggtgttggcaaaaatacccgagtgccgccatatttgtacgacaggcggcaaggcgacggaaatcctgctcgatattcagggcggcggtatcaaaatgccgaaaacgggcgaaaccgtgccgtttccgtttgccggacgggatttgacgctgacgcgcctgccttcgacttcgcgcgcctatcctttgagtttggcgaaaaaagcggcggcgtatcgggcgttttttgaaatggcgggcttgtgtgaaaaacagttataa

SEQ ID NO: 4755 - DNA, 1203 bp, Neisseria meningitidis
atgaagaactaccacgcgcccgacgagaagggctttttcggcgaacacggcgggctttatgtctccgaaaccctgattcccgccttgcaagagctggcggatgcctataaggcagcgaaaaacgatcctgaattttgggaagcgttccgccatgatttgaaacattatgtcggcaggcccagccccgtttaccacgccgcgcggttgtccgaacatctgggcggcgcgcaaatctggttgaagcgcgaagacttgaaccacaccggcgcgcacaaagtcaacaacaccatcggtcaggcactgttggcaaaacgcatgggtaaaaaacgcgtcatcgccgaaaccggcgcgggtcagcacggcgtggcgagtgccaccgttgccgcacgcttcggtatgacttgcgacgtgtatatgggcgcggacgacatccaacgccaaatgcccaacgtgttccgtatgaaattattgggtgcgaacgtggtcggtgtagaaagcggcagccgcacgctgaaagacgcgatgaacgaagccatgcgcgaatgggtcgcccgcgtggacgacacgttctacatcatcggtaccgccgccggccccgcgccgtatcccgaaatggtgcgcgatttccaatgcgtgattggcaacgaagctaaagcgcagatgcaggaagccatcggcagacagcccgacgttgccgttgcctgcgtgggcggcggatcgaacgccatcggtttgttccacccgtatatcggcgaagaaaacgtgcgcctcgtcggcgtggaggctggcggtttgggcgtgaacacccccgatcacgccgcgccgattacttcgggcgcaccgattggcgtattgcacggtttccgcagctatctgatgcaggacgaaaacggtcaggttttgggtacgcactctgtttccgcaggcttggattaccccggcatcggcccggaacacagccatctgcacgacatcaagcgcgtcgaatacactgttgccaaagacgacgaagcactcgaagcctttgacttgctctgccgcttcgagggcatcatccccgcgctcgaatccagccacgccgttgcttgggcggtgaaaaatgcgccgaaaatgggtaaagaccaagtgattttggtcaacctctcaggtcgtggcgacaaagacatcaataccgtcgcgaagctcaaagggattaaactgtaa

SEQ ID NO: 4756 - DNA, 5448 bp, Neisseria meningitidis
atgaaaaccaaacgttttaaaattaacgccatatccttatccatctttcttgcctatgcccttacgccatactcagaagcggcattggtcagagacgatgtcgattatcaaatattccgtgactttgcagaaaacaaaggcaaattttttgtcggcgcaaccgatttatcagtgaaaaacaaacaaggtcaaaacatcggcaacgcattatccaacgtaccgatgattgattttagcgttgcagatgtcaacagacgtacattaaccgtcatcgatccccagtatgccgtcagcgtcaaacatgtaaaaggagacgaaatctcttattacgggcatcacaatgggcacttagatgttagcaatgatgaaaacgaatatcgttcagttgcacaaaatgactacgaaccaaataaaaattggcatcacggtaatcaaggtcgtcttgaagactacaacatggcacgccttaataaattcgtaacagaagtcgcacctattgcaccaaccagtgcaggcggcggcgttgaaacctataaagataaaaaccgtttttctgagtttgtgcgagttggagcaggtacgcaatttgaatataacagccgctacaatatgacagagctttcacgagcttatcgttatgccattgcaggtacgccttatcaagacgtgaatgtcacatcgaatctaaatcaagaaggcttgattggcttcggtgataattcaaaacatcattccccagaaaaactcaaagaagttttatctcaaaacgcattgactaactatgctgtgttaggcgatagcggttcaccattatttgcttatgataaacaagaaaaacgctgggtctttttaggtgcttacgattattgggcaggctatcaaaaaaactcttggcaagaatggaatatctataaaaaagaatttgcagatgaaatcaaacaacgcgataacgccggcaccatcaaaggtaatggagaacatcattggaaaaccacgggcacaaacagccatatcggttcgacagcggtaaggcttgccaacaatgaaagggatgcaaacaacggacagaatgttacctttgaaaacaacggcactttggtattggatcaaaacatcaaccaaggcgcgggcggtctgtttttcaaaggcgattacacagtcaaaggtataaataatgacatcacttggctaggtgcggggattgatgttgccgacggcaaaaaagtcgtttggcaagtcaaaaatccgaatggcgacagattggcaaaaatcggcaaaggcacattagaaataaacggcacaggcgttaaccaagggcaattaaaagtcggcgacggtacggttattctgaatcaacaagccgatgccgacaaaaaagtccaggctttctcccaagtcggcattgtcagcggacgcggtacattggtattaaatagttcaaatcagattaatcccgataacctatatttcggtttccgtggcggtcgtttggatgccaatggcaatgacttgacttttgaacacatccgcaacgtggatgaaggcgcgcgcattgtcaaccacaacacaggccacgcctccacaatcacgctaacgggtaaatctttgattaccgatcccaaaaccatctctattcattatattcaaaataatgatgatgacgatgctggttattactattaccgccctaggaaaccgattccacaaggcaaagatctttatttcaaaaactaccgttattacgccctaaaatccggcggcagcgtgaacgcaccgatgcccgaaaacggacaaacggaaaataacgactggattttaatgggcagcacacaagaagaagccaagaaaaacgcgatgaaccacaaaaacaatcagcgtattagcggttttagcggtttctttggcgaagaaaacggaaaaggacataacggtgcattaaaccttaatttcaacggcaaaagcgcgcaaaaccgtttcttgttaacaggcggcactaatttaaacggaaaaataagcgtaactcaaggcaatgtcttgttatcaggtcgtccaacaccacacgcaagagattttgtgaacaaatcttcagcccgaaaagacgcacatttctccaaaaacaatgaagtcgtatttgaagacgactggataaaccgcacattcaaagccacagaaattgcggttaatcaatccgcatcattctcttccggcagaaatgtatccgacatcaccgccaacatcaccgcaacagacaacgccaaagtaaatttgggttacaaaaacggcgatgaggtttgcgtgcgctcggactataccggttacgttacctgcaacacaggcaacttatccgataaggctttaaacagctttggagcgacacagattaacggcaatgtgaatctgaaccagaatgcggcattggtcttgggcaaggctgcattatgggggcaaattcaagggcaaggaaacagccgtgtcagcctaaaccaacatagcaaatggcatttgaccggcgacagccaagtacacaatctgtcattggcggatagccatattcatttgaacaatgcctccgatgcgcaaagtgcaaataaataccacacgctcaaaatcaatcatttatccggtaacgggcattttcattatctgacgcacctggcgaaaaatcttggggataaagtgcttgtgaaggaatccgcatccggtcattatcagctccatgttcaagataaaacaggcgaacccaatcaggaagggctgaatctctttgatgcatcatccgtacaagaccgctcccgcctttctgtttccttggcgaataaccatgtagatttaggggcattgcgttatacaatcaaaacagaaaacggtattacccgattgtacaatccttatgccgagaaccgccgccgagtcaaaccggccccgtctcctgccacaaacacggcttctcaagcacaaaaggcaacacaaacggacggtgcacaaattgccaagcctcaaaatatcgtcgtcgcaccgcctagcccgcaggcaaatcaagccgaagaagcaaaacgccagcaagcaaaagcggagcaagtgaagcgtcagcaagcagaagcagagcgtaaatcggcagagttagcaaaacaaaaagcagaagccgaacgcgaagcaagagagctggcgacccgccaaaaagcagaacaagaacgcagcagcgccgaacttgcacgtcgacatgaaaaagaacgcgaagcggcagagttgtcggcaaaacaaaaagtcgaagccgaacgtgaggctcaagcattggcggtacgccgaaaagcagaagccgaagaggcaaaacgccaagctgcagagcttgcacgccggcatgaaaaagaacgcgaagcggcagagttgtcggcaaaacaaagggtcggggaagaggaacgccgtcaaacagcccaatcccagccgcaacgccgcaaacgccgtgccgcaccgcaggattatatggcagcttcccaagaccgtcctaaacgccgcggacaccgttcggtacagcaaaacaatgtggaaattgcccaagcccaagcagaacttgcgcgccgacagcaggaagaacgcaaagcggcagagttgttggcaaaacaaagggcagaagccgaacgtgaagctcaagcattggctgcgcgccgaaaagcagaagccgaagaggcaaaacgccaagctgccgaacttgcacatcgccaggaagcagaacgcaaagcggcagaattgtcggcaaaccaaaaagccgcagctgaagcccaagcattggcggcacgccaacaaaaagcccttgcgcgtcaacaggaagaagcacgaaaagctgcagagttagccgtcaaacaaaaagcggaaaccgaacgcaaaaccgccgaacttgccaagcaaagggcagcagccgaagcagcaaaacgccagcaagaagctcgccagaccgccgaacttgcacgtcgtcaagaagcggaacgccaagcagcagagttgtcggcaaaacaaaaagccgaaacagatcgagaagcggcagaatcggcgaaacgaaaagctgaggaagaagagcaccgtcaagcagcccaatcccagccgcaacgccgaaaacgccgtgccgcacctcaggattatatggcagcttcccaaaatcgtccgaaacgtcgcggacgcagatctactctgccggcaccgccctcgccatcatttgattcgtcagcttacgcagcacccagggccttgcataatccggactggtatgaaaatgactatgaagaaatccccttggatgcgttggaagatgaaaatgtatctgaatcagttgacacatcagacaaacagcctcaagacaatacggaacttcatgaaaaatatgaaaatgattatgaagaaatccccttggatgcgttggaagatgaagatgtatccgaatcggttgacacatcagacaaacagcctcaagacaatacggaacttcatgaaaaagttgagacagtgagtttgcaaccaagagccgcgcagccgcgagcccaagccgccactcagctgcaagcccaagccgccgcgcaagccgatgcagtcagcaccaataccaactcggctttatctgacgcaatggcaagcacgcaatctatcttgttggatacaggtgcttcattaacacggcacattgcacaaaaatcacgcgctgatgccgaaaaaaacagtgtttggatgtcgaacaccggttatggtcgtgattatgcttccgcacaatatcgccggtttagttcgaaacgcacgcaaacacaaatcggcattgaccgcagcttgtccgaaaatatgcagataggcggcgtattgacttactctgacagtcagcatacttttgatcaggcgagcggcaaaaatacttttgtgcaagccaacctttatggtaagtattatttaaatgatgcttggtatgtggccggcgatattggtgcaggcagcttgagaagccggttacaaacgcagcaaaaagcaaactttaaccgagcaagcatccaaaccggccttactttgggcaatacgctgaaaatcaatcaattcgagattgtccccagtgcggggatccgttacagccgcctgtcatctgcagattacaagttgggtaacgacagtgttaaagtaagttctatgtcagtgaaaacactaacggccggactggattttgcttatcggtttaaagtcggcaaccttaccgtaaaacccttgttatctgcagcttactttgccaattatggcaaaggcggcgtgaatgtgggcggtaattccttcgtctataaagcagataatcaacagcaatattcagcaggtgccgcgttactgtaccgtaatgttacattaaacgtaaatggcagtattacaaaaggaaaacaattggaaaaacaaaaatccggacaaattaaaatacagattcgtttctaa

SEQ ID NO: 4757 - DNA, 255 bp, Neisseria meningitidis
atgacgaatccatccgtacggaaacctgcaccgcgtcattcccacgaacccccatctcgtcattaccacgaaagcgggaatctaggactcagggttaagaaaacctacatcccgtcattccctcaaaaacagaaaaccaaaatcagaaacctaaaatcccgtcattcccgcaaaagcgggaatccaaaaacaaaaagccgcagaaatttaacggaagaaccgaaccccgaaaatcggcttcccgccttcgcttga

SEQ ID NO: 4758 - DNA, 2076 bp, Neisseria meningitidis
atgctgtgcgtgttggcgggcgcggcttacggcgtattcagaacggaagcggcactgtcttcgcaatggcgggcggaggcggtttcaggtgtgccgttgacggtggaagtggcggatatgccgaggtcggacgggcggcgcgtgcagtttgcggcaaaggctgtggacagcggtggtcggacgtttgatttgctgctgtcggactacaaacggcgcgaatgggcggtcgggagcagatggcggataacggcacgtgtgcaccccgtcgtcggcgaattgaacctgcgcggtttgaaccgtgaggcgtgggcattatccaacgggataggcggcgcggggacggtcggtgcggacagggttttgctgcatggcggaagcggttgggggattgcggtttggcgcagccgcatcagccgtaattggcagcaggcggatgcggacggcgggctttcagacggcatcgggctgatgcgcgcgttgagcgtgggcgaacagtcggcattgcgccccgaattgtggcaggcgttccgaccgttggggctgacgcatttggtcagtatttcgggtttgcacgttacgatggtggcggtgatgtttgcgtggctggcgaagcggctgcttgcctgttccccgcgccttcctgcccggccgcgcgtgtgggttttggcggcggggtgtgcaggcgcgctgttttacgcgctgcttgccggtttttccgtgccgacgcagcgcagcgttttgatgttggcggcgtttgcgtgggcttggcgcaggggaagattgtcggcgtgggcgacgtggtggcaggcgttggcggcagtgctgctgttcgaccctttggcggtcttgggtgtggggacttggctgtctttcggtttggtggcggccctgatatgggcgtgttcggggcgtttgcacgaagggaaacggcaaaccgccgtgcgcgggcagtgggcggcttcggtgttgtcgctggttttgctcggttatctgtttgcttcgctgcctttaatcagccctttggtcaatgcggtggcgattccgtggttttcttgggtattgacgccgctggcgttgctgggttcggtcgtgccgtttgcgcctttgcaacagttgggggcatttttggcggaatatactttgcggtttttggtgtggcttgccgatgtgtcgcccgagtttgccgttgccgccgcacctttgccgctgttggtgttggcggtgtgtgccgctttgctgttgctgctgccgcgcggcttgggtttgcgtccgtgggcggtgttgctgttggcagggtttgtgttttaccgttcacccggcgtgccggaaaatgaggttgcggttacggtttgggatgcggggcagggtttgtcggtgtcggttcagacggcaaatcatcatcttttgtttgacactggaactgcatcggcggcacagacggggattgtgccgagtttgaatgcggcgggtgtccgccgtttggacaagctggttctgtcgcatcacgacagcgaccacgacggcggttttcgggcggtgaggaatattcccgccggcgggatttatgccgggcagccggaattttatgagggggcgcggcattgtgcggaacagcgttggcaatgggacggcgtagatttcgagtttttgaggccgtctgaacgcaaaaacatcgatgataatgggaaaagttgtgttttgcgtgttgtggcgggcggtgcggcactgctggtaacgggcgatttggatacgaagggcgaggaaagcctggtcggcaagtatggaggcaacctgtacagccaggtgttggtgttggggcatcacggcagcaatacgtcctcgtcgggcgtgttcctcaatgccgtttcgcccgaatatgccgttgcttcaagcggttatgccaacgcctacaaacatccgaccgaagcggtgcagaaccgtgtccgcgcacacggcattaaactgctgcgtaccgatttgtcgggtgcgctgcaattcggcttgggacgcggcggcgtgaaggctcaacgtttgagagggtataaattctattggcagaaaaaaccgtttgagtga

SEQ ID NO: 4759 - DNA, 804 bp, Neisseria meningitidis
atgaaaaaaattcttttaacggtttcattaggtttggcactgagtgcctgtgccactcaaggtacggtagataaagatgcccagattacccaagactggagtgtggaaaaactctatgccgaagcccaggacgagctgaacagcagcaattatacgcgagctgtcaaattatacgaaatcttggaatcgcgcttccctaccagccgccatgcccagcaatcccaactggatacggcatacgcctactataaagatgatgagaaggataaggcgctggccgccattgaccgcttccgccgccttcaccctcaacacccgaatatggactacgcgctatacctgcgcggtttggtactgttcaacgaagatcaatctttcttgaacaagctggcctcgcaagactggtccgaccgcgacccgaaagccaaccgcgaagcgtatcaggcctttgcggaactcgtccaacgcttcccgaacagcaaatacgccgccgatgcgaccgcacgcatggtcaaactggtcgatgctttgggcggcaatgaaatgtcggtagcgcgttactacatgaaacgcggcgcatatatcgccgccgccaaccgcgcccaaaaaattatcggcagctatcaaaatacacgctatgtcgaagaatcgctcgccatattggaacttgcctacaagaagttggacaagccccggcttgccgccgatacgcgccgcgtgttggaaaccaacttcccgaaaagcccgttcttaaagcagccgtggcgatctgacgatatgccctggtggcgttactggcactga

SEQ ID NO: 4760 - DNA, 1125 bp, Neisseria meningitidis
atgcagaatacttcctttgataatgaatccgattatagcgacgattcagactttgcgtcagcttccgaaactgaaaaccgtatcggtctgaccgttccgctcgagcttgcaggcgggcggttggatgcggtattggcgaaacttctgcccgactactcgcgcagccgcctgacatcatggattaaagaaggcgcggttattgtaaacgataaaccttcgcaacccaaagacaaaatgataggcggcgagcaaatttgtgtaaccgtccgtccgagtgaggaaaatctggcgtttgttccagagcctatggctttggatattgtttacgaagacgataccgtcatcgtcgtcaacaaaccggccggactggtggtgcatccggcggcgggcaactggacggggacgctgctcaacggcctgttggcgcactgtcccgaattgagccaagtaccgcgcgcgggcatcgtacaccgtttggacaaggaaaccagcgggctgatggtggttgccaaaaccctgccggcgcaaaattccctcgtgaggcagcttcaagagcgcacggtcaaacgcatctaccgcgccgtcgccaacggcatcgtccccttcgacggtaaaatcgaaacccaaatcggacgcgatccgcacaaccgcctgaaaatggcagtcgtcaaattcggcggcaaaccagccgttacccacgtcaaagtgttggaacgctatcttacccacagctatatcgaatgctcgctcgaaacgggcaggacgcaccaaatccgcgtccatatgcgcgaggccaaccatccgcttgccgccgacccggtttacggcaacccgcgccatccgtgcggcgacacggtgaaagaagccgttaaaagtttgggtgcgcgtcaggcgttgcacgcctaccgcttgagtttcacccatccggaaagcggcgaaaccgtttcgtttgaagcaccgattccaaacgacatatatcatttgttatccgtcctccgtcttgaagccggtttggattcgtctttgagcaatgaagaagaatggcaggacaaattcggcgcggacgacgacgatgattggaacgaagacgactatgatgtcgaagtggtttatgtaagggagtga

SEQ ID NO: 4761 - DNA, 948 bp, Neisseria meningitidis
atgaatatcctcagtaaaatcagcagctttatcggaaaaacattttccctctgggccgcgctctttgccgccgccgcttttttcgcgcccgacaccttcaaatgggcggggccttatattccttggctgttgggcattattatgttcggtatgggtttgacgctcaaaccttccgacttcgatattttgttcaaacatcccaaagtcgtcatcatcggcgtaatcgcacaattcgccattatgccggcaaccgcctggctgctgtccaaactgttgaacctgcctgccgaaatcgcggtcggcgtgattttggtcggctgctgcccgggcggtacggcttccaatgtgatgacctatctggcgcgtggcaatgtggctttgtcggttgccgttacgtctgtttccaccctgatttccccattgctgactcccgccatcttcctgatgcttgccggcgaaatgctggaaatccaagcggccggtatgttgatgtccatcgtcaaaatggttttgctccccattgttttgggtttgattgtccataaggttttgggcagtaaaaccgaaaagctgaccgatgcgctgccgctggtttccgttgccgccatcgtgctgattatcggcgcggttgttggggcaagcaaaggcaagattatggaaagcggcctgctgatttttgcggttgtcgtactccacaacggcatcggctacctgctcggcttctttgccgccaaatggaccggcctgccttatgatgcacaaaaaacgctgaccatcgaagtcggtatgcaaaactcgggcctggccgccgcgcttgccgccgcacactttgccgccgcgccggtcgttgccgttccgggcgcattgttcagcgtgtggcacaatatctccggctcgctgctggcaacttattgggcggccaaagccggtaaacataaaaaaccctaa

SEQ ID NO: 4762 - DNA, 780 bp, Neisseria meningitidis
atgaaaaccatcacagaaaccctaaatctcgccccgaaaggcaaaaacttcctgaccgccgattggcccgcgcccgccaatgtgaaaaccctgattaccacgcgcaacggcggcgtgagccaaggtgcgtatcagagtttgaacctcggtacgcacgtcggcgacaatcccgaagccgtgcgccgcaaccgcgaaatcgtgcaacagcaggtcggactgcccgttgcctacctcaatcaaatccacagcaccgtcgtcgtcaatgctgccgaagcgttgggaggcacacccgatgcggacgcttccgtagacgacacgggcaaggttgcctgtgccgtgatgaccgcagactgcctgcccgttctattttgcgacagggcgggtacggcggttgccgccgcacacgcgggctggcgcggtttggcgggcggcgtactgcaaaacaccatagccgcaatgaaggttccgcccgtcgaaatgatggcgtatctcggccccgccatcagtgcggatgcgtttgaagtcggacaggatgtgtttgatgcgttctgcacgcccatgcccgaagccgccaccgcatttgaaggcataggcagcggcaaattccttgccgacctttacgcgctcgcccgcctgattctgaagcgcgaaggcgtgggcggcgtatatggcggcacgcattgtacggttttggaacgggatactttcttttcctaccgccgcgacggagcgacagggcgtatggcgagcctgatttggctggacggcaatgccgtctga

SEQ ID NO: 4763 - DNA, 480 bp, Neisseria meningitidis; identical to SEQ ID NO: 2621

SEQ ID NO: 4764 - DNA, 999 bp, Neisseria meningitidis
gtggcggcacatatcggacgcattgatacggacgcgcctttgaaacccctgtacgtcatccacggcgaggaagaactgttgcgtatcgaggcattggacgcattgagggcggcggcgaagaaacaaggttaccttaatcgggaagtttatacggcagacaatgccttcgattggaacgagctgctgcaaaccgcaggcagtgcgggtctgtttgccgatttgaagctgttggaactgcatatccctaacggcaagcccggcaaaaccggcggcgaggcgttgcaggattttgccgcccgattgccggaagatacggtaacgctggttttgctgcccaaactggagaaaacccagctccagtccaaatggtttgccgcattggcggcaaagggggaagtgtgggaagccaaaccggtcggcgcggcggctttgccccaatggatacgcggacggctggacaaaatcggtttgggtatcgaggcagacgcattggcactgtttgctgagcgcgtggaaggcaatctgttggcggcgcgtcaggaaatcgacaagctcgggctgctgtatccgaaagggcataccgtcaatatcgatgaggcgcaaaccgccgttgccaacgtcgcccgcttcgacgcgttccaactggcaggcgcgtggatgaagggcgatgtcctgcgcgtatgcaggcttttggacggattgcgggaagagggcgaagaaccggtgctgttgctgtgggcggttgccgaagacgtgcggacgctgatccggcttgctgccgccctgaagcaggggcagagcatccaatccgtccgcaacagcctcaggctttggggcgacaagcagacgctcgcaccgcttgcggtcaagcggatttccgtcgtccgcctgcttgacgcgctcaaaacctgcgcccaaatcgaccgaatcatcaaaggtgcggaagacggcgacgcatggacggtattcaaacggcttgtcgtgtcgctggcggaataa

SEQ ID NO: 4765 - DNA, 420 bp, Neisseria meningitidis; identical to SEQ ID NO: 2615

SEQ ID NO: 4766 - DNA, 567 bp, Neisseria meningitidis
atgccgtctgaagcctgttggcgtttcagacggcatattctgattgaaaagatgatgacactgaaaaccgccccgctcaaacgccgctttgccgccatgctgtacgaaatgctgctggtcggtgcggcaacctgtttggcagcattgattgccggtattgccgccatttttctgaatcccgtttctatcgcggtttctgcattggtaacaagtatcctgataatgggagcatggtggctttatttccgcgccaactggcatggtcaggggcagaccttggcgatgaggacatggaaaatcggcttgtgcgaccttaacggcatacagccgtctttgcacctgctgcgcctgcgctttatttgggcgtgcatatttatcgtatttatccctatgttagcctatgccggattacgccacttcctcggcattccgcccaagggcgcggccggcgcggcattgatttggctgattttaccgtgggggttcgcactgctgaatcccgatcggcagtttctgtatgattttcttgcaggaacaagattggtggcggtcaaaggaaagccttaa

SEQ ID NO: 4767 - DNA, 885 bp, Neisseria meningitidis
atgagcagcggaaatatccacatccacagcatgaccggatttgccaacgcggcggcagagtgcggcagcaaacgcatcaatctcgacctgcgtgcggtcaaccaccgttttctagatattcaaatcaggatgcccgacgatttgcgctatttggaaagcggtatccgcgagaaaatttcatcccatatcgcacgcggcaaagtcgaatgcaaaatccaaattcaagatgcggaaaacggcagtcagtccttggaactgaatcgcgacttggtcggacagcttgccgaaatcaacaaagacctccgcaagcatcacgatttggcaaaactgggcgttgccgacatcctgcgtttccccggcgtattggcaagccaaagggaaaatacggaagaattggcaaaaagcattaccgaactgaccgaaaaagcgttaaaagactttactgccgcacgcaagcgggaaggtaagaaattaggcgagcacctgctgcaacgccttgaggctatggaagaaatcatagatgcattaagcgaactctttcctaccctgttggaaacacataaagaaaaaatccgcgcccgcctcgtcgaagcggtcggcagcatcgacaacgaccgcctgcaacaggaatttgccctctttatccaaaaatccgacatcgacgaagagttcagccgcctacgcacccacattgccgaagtgcgccgtatcgttaccgaacacaaaggcagcagcggcaaacggctggacttcctgatgcaggaattaaaccgcgaagccaacactttgggcagcaaatccattgccgccgaatgcacccaagcctcggtcgaactgaaagtcttaatcgagcagatgcgggaacaagtgcagaatatcgaataa

SEQ ID NO: 4768 - DNA, 873 bp, Neisseria meningitidis
atgtcccaaatgaataacgctttcgcattacccgccatccaaagcggcaacggcagcctcgaacaatacatccacaccgtcaacagaattcccatgctgacccaagaggaagaaacacgccttgccgaacgccaacacaaaggcgacctcaacgccgccaaacaactcatcctgtcccacctgcgcgtcgtcgtttccatcgcgcgcggctatgacggctacgggctgaatcaggcagacctgattcaggaaggcaatatcggactgatgaaggcggtcaaacgctacgagcccggtagaggcgcgcgtctgttttcatttgccgtacactggattaaagccgaaatccacgagtttattttgagaaactggcgtttggttcgcgttgccaccaccaaaccgcaacgcaagctgtttttcaacctgcgcagcatgcgtaaaaacctcaacgccctgtctcccaaagaggcacaagacatcgccgacgatttgggtgtcaaactttccgaagttctggaaatggaacagcgaatgacgggacacgacatcgccatcatggcagacaacagcgacgacgaggatagtttcgcccccatcgactggcttgccgaccacgattccgaaccgagccgacaactatcgaaacaggcgcattacgccctgcaaacagaaggtttacaaaacgctttggcgcaactggatgacaggagccgccgtattgtggaaagccgctggcttcaagacgacggcgggctgacgctgcaccagcttgccgccgaatacggcgtatctgccgaacgcatccgccaaatcgaagcaaaagccatgcagaaactgcgtggtttcctgaccgaagaagccgaagcggtttga

SEQ ID NO: 4769 - DNA, 1575 bp, Neisseria meningitidis
atgttcagacggtatcttccgaacagacagatgaatatggtttccaaactggacaaatactggcagcaccccgccctctactggcctttgctcatcctttttgccgccgccaccccctttaccttcgcaccctactaccacttttggctgatgcccttgattttcggtgccttcgtccgcctcatcgaactgcgtccgcgttttgctgtctcttccgcctacctgttcggcctgaccgcatacacgacacagttctactggatacacaccgccctgcacgacgtttccggcctgcccgacctctatgccgtaccgctgaccttcctactccccgcctaccttgccctttatccggcactgtgtttctggctgtggaaaaaatttaccctgcctcggggcataaaaatcggtttggtactgcccatcctgtggacgctgaccgagtttgcccgcgaacgtttcctgaccggattcggctggggcgcaatcggctactcccaaatcaccccggacagcccgctcgccggctttgccccattgggcggcatccacatggttacactggcaaccgcctttctcggtgtctggctggttttggcgagtaataacaccgcacgttcgggcaaacgcctgcttccgattatcctgattgccgccctgcttgccgcaggctacaccgcccgacaaaccgacttcacccgccccgacggcagccgcagcaccgtcgccctgcttcaaggcaacatcgaccaaaccctcaaatggcgtgaagaccaagttatcccgaccatacagaaatattacgaacaagtcggcaaaaccaccgccgacatcgtcatcctgcccgaaaccgccatccccgttatgcgccaaaacctgccggaaaacatactggcgaaatttgccgaacaggcgcaaaacaacggcagcgcgctcgccgtcggcatcagccaatacacttcggacggcaacggttacgaaaacgccgtcatcaacctgaccggttatcaggaaaacaatcaggacggtatcccctactacgccaaaaaccacctcgtccccttcggcgaatacaaaccgctgcctttcctgaccacgccgctttacaaaatgatggatatgcccctttccgacttccgcaaaggcggcggcaagcaatccgccctgctgatgaaaaaccaaaaaatcgccttcaacatctgttacgaagacggattcggcgacgaactgattgccgccgcaaaagatgccaccctgcttgccaatgccagcaatatggcgtggtacggaaaatccaacgccatgtaccagcacctccaacaatcgcaggcgcgggctatggaactcggacgctatatggtccgcgccaccaacaccggcgcaaccgccatcatctcccccaaaggcaacatcatcgcccaagcccaacccgatacggaaaccgtattggaaggacacatcaaaggctatgtcggcgaaacgccctatatgaaaaccggcagttcatggtggttgatgggcatattggccctagccgcactgattcttttcatcttccgaaacaaagaacactga

SEQ ID NO: 4770 - DNA, 756 bp, Neisseria meningitidis
atggcatttgcctcactatttaccctgccggacgacatcaccgccgttttggacgatgttgccctgatgaccaaagccgccgcaaagaaaaccgccggcgtggtcggcgacgatttggcacccaatgccaaccgggttacgggcgtatcggcagaacgcgagttgccgattgtttggtcgatggcgaaaggttctttttccaacaagccggttttggtgcctgcggccctgctgctttccgccttcctgccgcaactcattacgccgcttttgacggcaggcggcatttatctgtgctttgaaggcgtagaaaagctgctgcacaagtttctgcaccgacatgacgcgcatgctcgtaatggcggcaatcggcatcggcatgactgttttggtgtacggaatcgttgccgtcatcgtcaaactcgacgacttaggcatgctgctgatgcgccgcccacaaaccttttcgcgcagtttggggcaaatgctgactgcctttatgccttgctttatgcgcggtttgagcgtggtcggcacgcttgccatgtttcttatcggcggcgtactggtcgcccacaacctcggccttctgcacgatttcctgcacgcgcaacactgggacgctggctgggcggagtacttcgccaacctcgttgtcgggctgctttccggttcgattgcctgcgcccccgccttgccgctgatgaatcgtttcggcaggcattgattcctttttcaaataccgatgccgtttga

SEQ ID NO: 4771 - DNA, 321 bp, Neisseria meningitidis
gtggattggatgggcagtctgttcctgccgggtggcgcactgttgtttctgagcgtggtttcgaccactttgtccgcacgtttgggaatgcctttgctgctggtttctcctgccaacgtgttggacagggcggcggaagccttggcgattgcggcgttcctgatgctggtcgcgcgtccgtcggcagtgttcggcggtttgtggaaattcaattacagcctgcgtgaaaaggcgtatagccgaatagaaatgcagtccgacaccgtgcttcaggcggggatttggcgtggtacatcctgcccgacggcaaggtcgatatag

SEQ ID NO: 4772 - DNA, 291 bp, Neisseria meningitidis
atggcgaaatactttaccgagacgggtattagcgtccgtgagcattttgatttcttcggtgagtttgtcgtttcgccggcagcacgttcgggtgatttggcacttacttacggtttgaggctggaagcgggcgaagagggtttgagccttgccgagcttttcgataagcgttccgatagtcaggagccggtcgagggcggccgtattgacatcggcggctttatgctgaccgcaaaggaggttgacggtggcggcaatatcgggtctatggggctgaaagtgctgcgttag

SEQ ID NO: 4773 - DNA, 417 bp, Neisseria meningitidis
atgaaggaaacaccaatgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaagcaaaaaaaactaa

SEQ ID NO: 4774 - DNA, 1083 bp, Neisseria meningitidis
atgccgtctgaagccgcttcagacggcattttgccgctttaccctacccgcactatttttcagaaaccgatcatgcttccattctttccagaaccctccctttcctatacgcaacaaaaccgtaccgccgttttgctgttgaacctcggcacgcccgacgcgccgaccgcgcaggcggtacgaccttatctgaagtcctttctgaccgaccggcgcgtcgtcgaactgcccaaatggctgtggtatcccattctgcatggtctggtactgacgctccgccccaaaaaaagcgcgcacgcctatgaaaaaatctggtttaaggaaggttcgcccttagaagtttacacagcacgccaagctgccgcgcttgccaaacgtatgcccgacctcatcgtccgccacgccatgacctacggcaatccttcggtggcagacgtattgtcggaactgaaggcgcaaggcgcgggcagactgctggtcatcccgatgtacccgcaatatgccgcttccagcagcggagcggcagtagataaggtgtgcgaacaattactgctgcaacggaaccaaatgagcgtccgcaccgtttcgcgcttttatgacgataccggctacattgatgcgatgaaaaaccacatcctccgatattgggcggaacacgggcgcgggaaaaaactgatgttgagttttcacggcgtaccgcagaagcaccacgacctcggcgacccctatcccgacgagtgccgccacaccgccaaactgcttgccgaagcactggaactgaccgaagaccaatatgtcgtatcgttccaaagccaattcggcagggcaaaatgggttacaccgagcacgcaggatttgttcggcaaactgcccaaacagggggtaaccgagctggacgtattttgcccgggctttttggcagactgtttggaaaccatggaagaaatcgccctgatggggcgggaacagttttatgaagcaggcggcaaaagctaccgctacatcccctgcctcaacgacaaccccgactggatagatgcactcgtcgcacttgccgaagaaaaccttggcagctggcgttga

SEQ ID NO: 4775 - DNA, 1116 bp, Neisseria meningitidis
atgcttaaatttaccttacacaaaaaagacggtctcgcccgacgcggcacgctggagttgaaccacggcaaaattgaaacgccggtatttatgcctgtcggtacttacggttcggttaaggcgatgaacccgcaaaacctgcacgatatcaaggcacaaattattttgggcaacacttatcatttgtggctgcgtccgggtttggaagttatcgggcaattcggcggcctgcacggttttatcggctgggacaaaccgattctgaccgactcgggcggttttcaggttttttctttgtcggatatgcgcaagctgacggaagaaggctgtacgttcaaaagcccgattaacggcgacaagctgtttttatcgcctgaaatttccatgaaaatccaaacggttttgaactcggatatcgcgatgcagttggacgaatgcacgccgggcgaggcgacgcgcgaacaggcgcgaaaatcgctgcaaatgagcctgcgctgggcggaacggagcaaaaaagcctttgaagatttgaaaaacccgaacgcgctgttcggcatcgtgcaaggcgcgatgtatgaggatttgcgcgaagaatcgctgcgcggtttggaacagtttgattttcccggccttgccgtcggcggtttgtccgtcggcgaacccaagcccgaaatgtaccgtatgctgcgcgccgtcggtccgattctgccggaacacaagccgcattacctgatgggcgtaggcacgccggaagacctcgtgtacggcgtggcacacggcatcgatatgttcgactgcgtgatgcccacccgcaatgcacgcaacggctggctgtttacccgtttcggcgatttgaaaatcaaaaacgccaaacacaagctcgacaagcgtccgatagacgaaagctgcacctgctacgcctgccaaaacttcagccgcgcctacctgcaccatctgcaccgcaccggcgaaatcttgggcgcacagttgaacaccatccacaatctgcatttctaccaagtcattatggcggaaatgcgcgaagccgtcgaacaaggcaaatttgccgactggcaggcgcgattccacgaaaaccgcgcacgcggcacagactga

SEQ ID NO: 4776 - DNA, 1914 bp, Neisseria meningitidis
atgttgaatattaccttgccggacggctcagtccgccaatacgaatcccccgttaccgtggctcaaattgctgcgtctatcggtgccggtttggcgaaggcgacggtggcaggcagggtaaacggcaaattggtcgatgcgtgcgacccgattgttgaagattctgctgttcaaatcattactccgaaagatcaggaaggcatcgaaatcatccgccattcctgcgcgcatcttgtcgggcatgccgtcaagcaactctatcctaatgcaaaaatggttatcggccccgtcattgaagagggcttttattacgacatcgccacggaaaaaccgtttacaccggaagatgttgccgccattgaagcgcgtatgaaagaattgattgcccaagactatgatgtggtcaaaatcatgactccgcgtgcggaggcgattaaaatttttcaagagcgcggcgaagaatacaaactgcgcctgattgacgatatgcccgaagtggaagcgatggggatgtatcatcaccaggaatatgtcgatatgtgccgcggcccgcacgttccgaatacccgtttcctgaaaaacttcaaactgaccaagttggcgggcgcatactggcgcggcgacagcaataatgaaatgctgcaacgcatatacggtacggcttgggcgacaaaagacgaattaaaagcctatattcaacgtatcgaagaagccgaaaagcgcgaccaccgcaaacttggcaagcaattggatctgttccacctgcaagacgaagcgccgggcatggtgttttggcatcctaaaggctgggctttgtggcaagtgattgaacagcatatgcgtaaagagctgaacgccgccggttataaagaggtcaaaacgcctcaaatcatggataaaaccttttgggaaaaatccggccattgggacaactacaaagataatatgttcgtaaccagttcggaaaaacgcgaatatgcggttaaaccgatgaactgtccgggtcatgttcaaatttttaacaacggtttgcgttcgtatcgagatttgccgatgcgtttggcggaattcggttcttgccaccgcaatgagccgagcggtgcgctgcacggtctgatgcgggttcgcggttttgtgcaggatgatgcgcatattttctgtaccgaagatcaaatcgtcagcgaggctcgtgcgttcaatgaattgttgattcgcatctacaaacagttcggtttccatgatgtatccgtcaagctttctcttcgccctgaaaaacgcgcaggttcagatgacgtgtgggataaggcagagcagggtttgcgcgaggcattgactgcctgcggcgtggaatggggcgaattgccgggcgagggtgcgttttacgggcctaaaatcgaatatcatgtcagagatgccttgggtcgttcttggcaatgcggtacattacaactggatttcgtattgccggagcgtttgaatgccgaatatgtaactgaaaacaacgaccgtgcgcgtcctgttatgttgcatcgcgccattttaggttctttggagcggtttatcggcattctgattgagaaccatgcaggctcattcccgttatggttggctccggttcaattggtaattatgaatattaccgaaaatcaggcagattattgtcgggaagtggctgccaaattgcaggcggcaggattccgcgccgagttggatttgcgtaacgaaaaaatcggttacaaaatccgcgacaacagccaataccgtttcccttatcaaatcgttgtcggcgataaggagaagcaggaaaacaaagtggcggtacgccgcaaagcagaagatttgggttctttggatttggatgatttcattgcgcaattgcagcaagaaatcactgatgccctcgtcaatcattaa

SEQ ID NO: 4777 - DNA, 468 bp, Neisseria meningitidis
gtgcgtttaatcagtgagtcaggcgaacagcttggtgtcgtttcagttcgtgaagctttggctatggccgaagggcaggatgtcgatttggtagagatttccccaactgctaaaccgcctgtgtgcaaactgatggattacggtaaatacaaataccagcaggccaagaaacgcgacgaagccaagaaaaaccaaaagcaggtgcaaatcaaggaaatcaaattccgtccgggtacggatgagggcgattatcaaatcaagatgcgcaacattaaccgcttccttgccgacggcgataaagtcaaagtgacattgcgtttccgcggccgtgaaatggctcaccagcaactcggcgcgcaacttttggaacgtgtaaaagaagatttggctgaagtggcgcaaatcgagtcctttcccaaaatggaaggtcgccaaatggtgatgatgattgcgccgaagaaaaaataa

SEQ ID NO: 4778 - DNA, 198 bp, Neisseria meningitidis
atgcctaaaatgaaaaccaagtctagcgcgaaaaaacgctttaaagtactgggtaacggcggtgtgaaacgcgctcatgcgttcaaacgccacatcttgactaaaaagaccaccaaaaacaaacgccaactgcgcggtacctctatggtaaatgatcgcgatttggcttctgttgctaaaatgttaccctacgcttaa

SEQ ID NO: 4779 - DNA, 360 bp, Neisseria meningitidis
atgccacgcgtaaaacgcggtgttaccgctcgtgcccgtcaccaaaaaatcttcgcgttagccaaaggctaccgcggccgtcgtaaaaacgtttaccgcgttgccaagcaggcggtaatgaaagccggtcaatacgcgtaccgtgaccgccgccaacgcaaacgccaattccgtcaattgtggattgtccgtatcaatgcaggtacgcgtgaaaacgggttgtcttacagcaaatttatgaacggtctgaaacgcgcctctattgaaatcgaccgcaaagtattggctgatttggccgtgttcgataaagccgcttttgcacaattggttgaaaaagccaaagctgctttggctgcttaa

SEQ ID NO: 4780 - DNA, 993 bp, Neisseria meningitidis
atggaaaatgtaaaccgcatcgttgcagaaggcattgccgcagtagaagctgcgcaagacttcaacgctctagaacaaatcaaagcccgttatcttggtaaaaccggcgagttgaccggacttctgaaaactttggggcaaatgtcgcctgaagagcgcaaaaccataggtgcgcatatcaatgaatgcaaaaaccggtttcagacggcttttaatgccaaacgcgaagccctcaacgaagtcaagctgcaagcccgacttgccgccgaagccctcgatattaccctgcccggacgcgctcaggaaggcggcagcctgcatcccgtaaccctgaccttgcaacgtgtggtcgaactctttcacggaatgggtttcgaagtggcggacgggcctgaaatcgaagacgattttcacaatttccaagccctgaacatccctgcaaaccatcctgcccgtgcgatgcaggatacgttttacgttgaaaacggcgatgttttgcgtacgcacacttccccgattcaaatccgctatatgctcgataaaaaagagccgcccatccgcattatcgcccccggccgcgtttaccgtgtggacagcgatgccacgcactcgcctatgttccatcaggcggaaggtttgtgggtagaagagggcgtaacttttgccgacttaaaagcagtgttcacggattttatccgtcgcttctttgaacgcgatgatttgcaagtacgtttccgcccgtctttcttcccgttcaccgaaccgtctgccgaaatcgacattatgggcgaaaacggcaaatggctggaagtaggcggttgcggtatggtacatcctaacgtgttgaaaaacgtcaatatcgaccctgaaaaatataccggtttcgcctttggtattggtctcgaccgcttcgctatgctgcgttacaacgtgaacgacttgcgcctgttcttcgataatgatttgaactttttgaagcagtttgcgaaatga

SEQ ID NO: 4781 - DNA, 1059 bp, Neisseria meningitidis
atgatgataggggcttctttgttttcgagtgcagggattgcagaaacctacttgcataatgcgggtattaagattatagctgcaaatgaattggtgccagaacgtgctaatttatataaagctctatatcccgaaagtaaaatgattataggtgatatacttcatgaggaagtgtttcaaaatttaatacagagcgtgccgaatcgattagattttttaattgcttctcctccttgtcaaggcatgagtgttgcagggaaaaatcgtaacattcaagagatggctaatgataaacgtaatcatttaatattcagagtaatcgaatttattttattaaaacgcccaacttttgttttgattgaaaatgttccattttttttaaaaattaagttaccttataaggggacattacaaacagtagaagtaattttgcaagatttatttggttgcgaatattatattcaaactcatatttttgattctgccgattatggtgttgcacaacatcgtaaacgagctattattcgtatgaataaacattcaactatttggggaatgccggaaaaagttacaaaaaccatttctgttcgtgatgctattagttttttgcctagtattgagtctggacaaaagtctaatgtgaaatggcattttgcacgtacacatgctccggagcacattatatggctaaaaaatacgccaacaggacgatctgcttttgataatatagaacattatccaaagaaaaaaaatggtgaaaaaattaaaagttataatacaacttatcgccgtatggagtgggatgctcctgccccaactattactattcgtaatgacgctatcagttcacaattaaatgttcatcctggacggtctatgcctgatggaacatattcagatgcaagagttttaacaccattagagttaatgcttttaacatcattacctattgattggaatattcccgacgatacatcagaattattaattcggcaatgtattggtgaatctattcctccattgttaattaaaaaaattgtagagagaataggaaaatag

SEQ ID NO: 4782 - DNA, 1470 bp, Neisseria meningitidis
atgacaactgcgcgctgggtaatagataaacatttacagaattttcatattttatgtaaatttgcaggtattttgaaaacaaattcttttatatctgtagaggataaagctaagttatctgaaaaattggaaaaactagatttataccatagacgaaatacaggtaaatcattggatgctactactcataaaataaaagaattatcattctatatgtttggttatcgtgatgtgtgtgggcaagttacacagaaattcctgttcagtccattgggtaatttatttttgaaacacttggataataatgaatatattcaaaaaatttttcttactatgttgtgggcgataccatttcctcatccgtacattaagactgatgaaagtattcaattatatcccatgagactaatatttaagttgttatctgatgaaagattggattgtaaactattttcttatgaatatatctatttaatttcatttgtgaaatctgctgatcagaatagctatgaaaaattagtacaagacattttggtgttacgaacatgtgctgaagtaaaaattaaacatcaattaactgcggaaaatagtcgtagtcatgcttatgtaaatgcagcacatgagtgggaatcttatttttcaaaaacattgactgatgcaggtgttttgcaaaaaacagatggtaaaattatttgccgtctaaagcatggtaagaccgaaacatatcgtaaagtaacatcaagtgagttttcgattcctaagcaacttcaggaatttgtgaaaaaattgcaaagtgcttattcgttttcagaaatgccattaaatctgaacgatagtgatcgtttgaaaattgatgtcattaaggaaatttatagcttctatccaaaagagttattggaggaaattggtgagcttaaggatgaagcagcatatgaattattgcacttacctaggttgattgaacaatatgcagataataataatggaacagaggcatatctatttgaagatgttctagaaatggggttcaatatgttttataacgtagaagctaaaaaaattggtggaccaggtaatacggatttagagtgcttatatattacgcaaaagagaaaatttgcagtggaggcaaaatcaactaaaaataagttatcaggtattaattcaggaagattggaagatcataaaaataaaattaaggccatttacacaattgttgtcacaccacgttatgtccctgccgtattatccgatattcgtaattgcccaattgtaattattcgtgccaatacatttgctgaatttttatataattgtttgattaatcgctccagtattccagagattgattatcggtattttgatgaaattattattaaaaatcttggaaaagatattagttcagaaatttccaatttgactatgcaacagtttgcaagtaacaccacaatggaagcgtatagtacatga

SEQ ID NO: 4783 - DNA, 651 bp, Neisseria meningitidis
atgataactatttcaaatgaagataacatgatcttaatgtctcggtatcctgacaagtattttgatttggcaattgtagatcctccttatgggattttgaataaaactaaacgtggtggtgattataaattcaatatgaatgaatactcacaatgggatattaagccagaccaaacttactttaatgaattatttcgcgtgtcaaaaaatcaaattatttggggtgggaattattttggcgagttatggttgagaagtgaatataataaaggatttattatttgggataagaatcaaccagagacattaaataatttttctatggcggaaatggcttggtcgtcattcgataggccatctaaaattttccggtttagtgtgcggaaaaatcgtaataaaactcacccaacacaaaaaccagtcgaattatatcagtggttgttaaaaatgtatgcaaagcagggtgataagattttagatacacatttaggaagtggaactcttgctattgcatgctgcattgcacagtttgatttgacagcttgtgaaatcaattccgattattaccaacaatcgattgagaaaataaaaaataatttacctgaagctagaatcagttttgggcatccaggttattgtattattgaataa

SEQ ID NO: 4784 - DNA, 2364 bp, Neisseria meningitidis
atgcaattctcctactcatggctgaaaacccaagccgataccgaactttcctccgataagctggaacatctgttaacgatgtccggcttggaagtggaagaggctgaaactgccgcgcctgcgtttgcgggcgtggtgattgccgaagtgaaatccgttgaaaaacatccggatgcagaccgtttgaacgttacccgagttgatgcgggtacgggcgggttggtgcagattgtgtgcggtgcgccgaatgtgaaagcgggcatcaaagtgccgtgttcgctgccgggtgccgttttgccgggtaatttcaaaatcaagccgaccaaaatgcgcggcgaggtgtcggacgggatgttgtgttccaccgacgaactcggtctgcccgacgacggtgtgaacggcctgcacattctgcctgaagatgcgcccgtcggtaccaatatccgcgaatacttggatttggacgatacgctgtttacgttgaaaattacgcctaaccgcgccgactgcttgagcatcaaaggcattgcgcgcgaagtgtccgcattgacggggtgcgcgttcaggcagcccgaaatccataccgcgccgatcacgggcagtcgaaaacagcccgtgcagattaacgcgcctgccgattgcggccgttttatcagccgtgtgattgaaaacgtgaacgcgcgcgctactacgccggattggatgaaacaacgtttggagcgcagcggcatccgcagtatttccgcgctggtggacatcggcaattatgtgatgctggaaatcggtcagccgatgcacgtttttgatgccgacaaactttccggcagcctgcacatccgccgcgcgcgcgaaggggaaacgctggaatgcctgaacgagaaaaccgtttccctgtctgaaaacacgctggtcgtggcggacgaaaaaggcgtgttgagtttggcgggcttaatgggcggcgcggcgagcgcggtttcagacggcacgcaaaatatcgtgctggaagcggcttggtttgcgcccgaaatcatcgccggcaaatcgcgccaatacggtttcggttcggattcgtcgttccgcttcgagcgcggcgtggattaccgtttgcaggcggatgccattgaacgtgctaccgaattggtgttgcagatttgcggtggtgcggcaggcgagatggtggaagcgcaaggcgaattgcctgaagcgaagcaggttggattgcgtttggaccgtctgaaaaccgtgttgggcgtggacattcctgccgaacaggtggaaaccattttgcaacacttgggcctgcagcccgagaaaacggcggaaggcttccgcgttaccgcgccgagcttccgttttgacatcgaaattgaggctgatttgattgaagaaatcggacgcgtttacggctatgaaaacatccccgacgattacacgtcaggccgtctgaaaatgctggaactgcccgaaacacgccgcccgcgttttgccgtttacaacgaaatggcggctcgcggttaccgcgaagtggtcagctatgccttcgttgacgagcagtgggaacaagattttgccgccaacgccgaccccatccgcctgcaaaacccgctggcggcgcagtatgccgtgatgcgttccacgctcatcggcggcttggtggaaattctgcaaaacaatctgaaccgcaaacaaaaccgcgtgtgcgtgtttgaaatcgcccgcgtgttcagcaaaggttcagacggccagtttgtccaaaacgaacgcatcggcggattgtggtacggcgcggtcatgccggaacaatggggcgggaaaacgcgcaatgcggatttttacgacatcaaggcggacgtggaaaatctgttgaaaaacaaagcagtcgagttcgttaaaaccggacatcccgccctgcatcccggacgtgccgccaatatcgtttcagacggcaaagtcatcggctttgtcggcgaactgcatccgaaatggctgcaaaaatacgacctgccgcaagcgccgctggtatttgaaatcgatatggcggccgtgttggaatgcgggaaaacgcgctatcgggtcgtatcgaaattccagccggtgcgccgcgatttggcgtttgtgatgccggaagctatgagccatgatgatttgctgcttgtcttgaaaggcgcggcaaacaagttggtacaggaaatcagcgtgtttgacgtgtatcgcggcacgggactgcccgaagggatgaagagcgtggcggtcaaagtgattttgcaggatatggaaaacacgctgacggatgaggcagtcgagccgcttatcggaaaactgattggcgcggcaacggcggcaggggcgcggcttcgcagttaa

SEQ ID NO: 4785 - DNA, 303 bp, Neisseria meningitidis
atgactctcactaaagcagaactggccgatattttggtagacaaagtcagcaacgtcaccaaaaacgatgccaaagaaatcgtcgaactcttttttgaagaaatccgcagcactttggcaagcggcgaagaaatcaaaatttccggtttcggaaatttccagttgcgcgacaagccgcaacgcccgggtcgtaatcctaaaaccggcgaggaagtgccgattaccgcccgccgcgtggtaactttccatgccagccagaaactcaaaagcatggtggaacactactatgacaaacaacgttga

SEQ ID NO: 4786 - DNA, 486 bp, Neisseria meningitidis; identical to SEQ ID NO: 279

SEQ ID NO: 4787 - DNA, 228 bp, Neisseria meningitidis
atgaatgtttggtatatatgggacaggatggtggaaatctatcataagtataagaagccgtgcctggttttggcggtggattttgtgatgggtatggtattcatagagccgaatgaggagccgtgcatcggtaggtgctatgcgcctatgtcggagtcccctgattttgctaacgctgttgcgatggctgttgctatgatctgtatcgtatggattgccgttttatag

SEQ ID NO: 4788 - DNA, 1302 bp, Neisseria meningitidis
atgccgtctgaacatcaacacatatcatcattgcttgatttcgaccgtacccatctgcttcatccctatacttccatgaccgatccgctgcccgtttatcctgtcaaacgtgcagaaggggtgtttatcgaattggcggacggcacgcggctgattgacgggatgtcctcctggtggtgtgcgatacacggctacaatcatcctgttttgaatcaggcggttgagacgcagatgaaacaaatggcgcacgtgatgttcggtggtttgacgcacgagccagcggtggagctgggcaagttgttggtcgggattttgccgcaggggctgaaccgtattttttatgcggattcgggttcgatttcggtggaagttgcgctgaagatggcagtgcaataccagcaggcgcggggtttgacggcgaagcagaatatcgcgacggtgcgccgcgggtatcacggcgatacttggaacgcgatgtccgtctgcgatccggaaacggggatgcaccatattttcggcagcgcgttgccgcagcgttattttgtcgataatccgaaaagccgtttcgacgatgaatgggacggggcggatttgcagcctgtccgcgccttatttgaagtgcatcatgcggatattgccgcctttattttagagccggtcgtgcagggcgcgggcggcatgtatttttatcatccgcagtatcttcgcggattgcacgatttgtgcgacgaatttgatatcatgctgatttttgacgaaatcgccactggattcgggcgcacgggcaagatgtttgcctgcgaacacgcggaggtcgtgccggatattatgtgtattggcaagggtttgagcggcggctatatgacgctggcggcagcaatcacttcgcaaaaagttaccgaaacgatttcgcgcggcgaagcgggcgtgtttatgcacggcccgacgtttatggcaaacccgctggcgtgtgccgttgcctgcgcttcggtcaaactgcttttgtctcaagactggcaggcaaatatccgccgcattgaaagcatcttaaaaggccgtctgaaagccgcgtgggacattcgcggcgtgaaagacgtgcgcgttttaggtgccatcggggtgatcgagctggaaaaaggcgtggatatggcgcgttttcaagcggactgcgtggcgcagggcatttgggtgcgcccgttcggcaggctggtgtatctgatgccgccctatatcatttcagacggcgttttgaccaaacttgccgacaaaaccgtgcaaatcttgaaggaacacagcaaatga

SEQ ID NO: 4789 - DNA, 648 bp, Neisseria meningitidis
atgaaaggcgtttacttcgtcagcggcatagacacggacatcggcaaaaccgtcgccaccggcgtgttggcaaaacaattgttgcagcagggcaaaagcgtgattacgcaaaagcccgtgcaaaccggttgccaaaacattgccgacgacatcgccgtccaccgcaaaattatgggcataccgatgcaggaagccgacaaacggcggctgactatgcccgaaatcttcagctatcccgcttcgcctcacctcgccgcccgactggatggcagggctttggacttggacaaaatccgcaccgccacacaagaattggcggcgcagtacgaagtcgttttggtcgaaggcgcgggcggattgatggttccgctgacggaaaacctgttaaccattgattatatccgtcagcaaggctatcccgtcatcctcgttaccagcggacggctcggcagtatcaaccacactttactcagtttcgccgcgctcaaacaatacggcattcgcttgcacagcctcgtgttcaaccacatccacgacagccgcgacgcacacatcgcccaagacagcctgagctacttgaaatgccgtctgaaagccgatttttccgaagcggaatggatggagttggcaaaaacagacgcggtataa

SEQ ID NO: 4790 - DNA, 477 bp, Neisseria meningitidis
atggaacacctatttgggaaatggctgcccgacttgcccgccgccatttcagacggcatcagcctgccgatggtgcggctgctgcacacccggtcgctgaccgccgcattgcgcgccttgccgcatacattttcggtggaactgctgaaactgggcgaattggagacggaatgcggagggaggctggtgcgcgaagttttgttgaagctggaccgtatccctgttgttgaggcaaggagcgaatgccgtatcggttcggcgttttggcaaaacattttggactgcggcacgcgtcctttgggcgagcgtctgtttcaagccgatttggaaggggcgcgttcggcgtttgagtttgccgttgccggcgaaggatgcggacggtactttgccgcgcggcgttctcggttttcccgtcacggcgaggaaatgctgctgaccgagtattttctgcccgaactgaaacgttttatcggataa

SEQ ID NO: 4791 - DNA, 891 bp, Neisseria meningitidis
atgaatcctaaatcccctttatttttacgcctgtccgaccgtttggatgtgtacctgcgcctgatgcgggcggacaagcccattgggacgctgcttttactgtggccgacctactgggcattgtggctggcttcagacggcattcccgatttggcggtattggcggcgtttacaatcggcacgtttttaatgcgcagtgccggctgcgtcatcaacgactttgccgaccgcgattttgacggtgctgtcgagcgtacaaaaaaccgtccgttcgcacagggcagggtcaagaaaaaagaagcgctgctgctgacggcatttttgtgcctgcttgccgcattgtgcctgattccgctgaatcatctgacttggctgatgagcctgcccgcgctgtttcttgcgctgacttacccgtttaccaaacgtttttttccgattccccaactctatctcgggcttgccttttccttcggtatcccgatggcgtttgccgccgttgccggaaacgtgccgcctcaagcgtggatactctttgccgccaatgtgttatggactctggcgtatgacacggtttatgcaatggcggacaaagaagacgatttgaaaatcggcatcaaaacctccgccgtcacgttcgggcgttacgacatcgccgccgttatgctgtgtcacggaggctttaccctgctgatggcagtattgggtgcggttatcggtgcggcatgggcatattggacggcaatccccatcgtcctgctgctgcaataccgccaatatgccgccatcaaaagccgcgtccggcaaatctgttttgaaacgtttttggcaaacaacagaattggttgggtgtggtttaccgccatttttgcccatacgtttttcgcgaaataa

SEQ ID NO: 4792 - DNA, 450 bp, Neisseria meningitidis
atgagccttatcggcgaaattttgcctttgtcccatattgttttggatatggaggtaggcagtaaaaaaaggctgtttgaggaagcaggcctgcttttggaacgcgaatcctcattgtcccatgctgatgttttcgaatgtctttttgcccgtgaaaaactcggttcgaccggtttggggcagggcgttgccatcccgcacggccgtcatgccggcgtgaagcaggcgacgggcgcgttcatccgcacgcgcgaacccgtcggatttgacgcaccggacggcaagccggtttccctgatttttatcttgctggttccggaaaacgcaaccggcgagcatttggaagtcttatccaaactggccggcaagttttcccaaaaaagcatcagagaatcgctgatgacggtttcctctgcggaagaagtccgtgccatcctgactgaagaataa

SEQ ID NO: 4793 - DNA, 963 bp, Neisseria meningitidis
atgcccagtatctccgtccgccgcctgtttgatgacaaccaatacaaactgcaactcgcttgggccgccggcaattcgggtgcggacaaccgtatcggcgtagaggcggacaagcccgtcctcgccctagtcggacacctgaatttcattcatcccaaccaaatccaagtggtcggtttggcagagtcggaatatctgaaccgcctcgaatcgggggaaacgggttatcagtttggcgacctgttcgatatttctatgtctttggttattgtggcaaacggcttgccggtttccccgggactgcgcgactattgtcataaaaacgatattccactgctgacttccaaactcgaaagcccctatctgatggacgtgttgcggatttacctgcaacgcaccttggcggcatcgtccgtcaaacacggcgtatttctcgatgtgtttgaaatcggcgtgctgattaccgggcattccggcctgggtaagagcgaattggcattggaactgatttcgcgcggccacagcctgattgccgacgatgcggtcgagctgttccgcatcggcccggaaacgctggaagggcgttgttcgcctatgctgcgcgattttttggaagtgcgcggcttggggatactcaatatccgccatattttcggcgaaacttccatccgccccaaaaaaatcctgcaactcattatcaatttagtcgaggcggacgacgagtatatgaagcagcttgaccggttgagcatccgcaccgaaaccgaatccatcctcaacgtcaacgtccgttcggttacgctgcccgtcgccgtcggacgcaacctcgccgttttggttgaggcggcggtacgcaattacattttgcagttgcgcggtaaggacagtacgcgcgaatttttggaacgccatcagacgcaacttaaagaaaacgaacaacacaatgaagatcgtcctgattag

SEQ ID NO: 4794 - DNA, 855 bp, Neisseria meningitidis
atgaagatcgtcctgattagcggcctgtccggttcgggcaagtccgtcgcactgcgccaaatggaagattcgggttatttctgcgtggacaatttgcctttggaaatgttgcccgcgctggtgtcgtatcatatcgaacgtgcggacgaaaccgaattggcggtcagcgtcgatgtgcgttccggcattgacatcggacaggcgcgggaacagattgcctctctgcgcagactggggcacagggttgaagttttgtttgtcgaggcggaagaaagcgtgttggtccgccggttttccgaaaccaggcgaggacatcctctgagcaatcaggatatgaccttgttggaaagcttaaagaaagaacgggaatggctgttcccgcttaaagaaatcgcctattgtatcgacacttccaagatgaatgcccaacagctccgccatgcagtccggcagtggctgaaggtcgaacgtaccgggctgctggtgattttggagtccttcgggttcaaatacggtgtgccgaacaacgcggattttatgttcgatatgcgcagcctgcccaacccgtattacgatcccgagttgaggccttacaccggtatggacaagcccgtttgggattatttggacggacagccgcttgtgcaggaaatggttgacgacatcgaaaggtttgttacgcattggttaccgcgtttggaggatgaaagcaggagctacgttaccgtcgccatcggttgcacgggaggacagcaccgttcggtctatattgtcgaaaaactcgcccgaaggttgaaagggcgttatgaattgctgatacggcacagacaggcgcaaaacctgtcagaccgctaa

SEQ ID NO: 4795 - DNA, 1518 bp, Neisseria meningitidis
atggcaatccaatggtttcccggccatatgaacaaggcgaaaaaagccatcgccgagcgtgcaaaaagcgttgatatggtgattgaaatgctggacgcgcgtatgcccgcctccagcgaaaaccccctgcttgcccagctttccaaaggtaaacccaaacttaaaatcctcaacaaacaagatcttgccgaccccgagcgcaccaaaatctggctcgaacactataacagccgccccgacacctgcgccatcgccctcgattcctccgaaacaggcgcacacggcaaaattacccaagcctgtcgtgccatgattccccaccgccaaggcatagataaacccctgcgcgtcctcatctgcggcatccccaacgttggcaagtccaccctcatcaacggcatgataggcaaaaaatccgccaaaaccggcaacgaacccggcatcaccaaagccgaacaacgcctcttcctcgccgatgacttctggctctacgacacccccggaatgctatggccgaaaatcatcgtcgaagaaggcggctacaaccttgccgccggcggcgcagtcggacgcaacgcgttggacgaagaagaagtcgccctcgaacttttagactacctccgccgccactacctccctatgttgcaagaacgctaccaagccgacaaagaccccagcagccactgggacgaaaacgtttggctcgaatggatagccaaaaaacgcggcgcagtcctcagcggcggacggatcaactaccaaaaagccgccgaaaacatcctcaccgacttccgtgaaggcaaaatcggcagaatcaccctcgaaacgccgaaccaatgggaaacttggctcaaaaaagcccgtcagaaagaagccgaactcaaagccatacgcgaagccagaaaagcagagcgtaaagggcagaagcttcggaagcataaagaatgccgtctgaaaaatatttttcaggcagcttctctctactccaaccgatttcagacggcatatccaaacccatgccgtttcagcacggatacccgtatgaccgacaaaatttctcccgacgcgctgattgaagccgcactgctgacccaaaccgaaccgctgaccgaaaaatctatgcgcgaactgtgtgtgccgccgttgtcgcaagacaaactgattgatgtgttggcgcagttgaaaacgcgttggcaggatagggcgttgcaactggtgcatacgcaagagggctggcgttttcagattgttcagacggcattcgagcggctgggcagcctgcaagaacagcgtgcgccgcgctactcccgcgccgtgatggaaacactggcgattatcgcctaccagcagcccgtaacgcgcggcgacatcgagggcatacgcggcgtggcggtgtcgcagaacgtgatgcagacttgcaggatcgggggtggattgaagtcatcggacatcgggacacattgggaaaacccgcattgtgggcgacaacggcaacgttcctcagcgatttgggtttga

SEQ ID NO: 4796 - DNA, 1674 bp, Neisseria meningitidis
atgcttctaacactttctttgcgtgattttgtcattgttgaaaatctgaatctggattttcaaagcggctttaccgtattgaccggagaaactggcgcgggcaagtccattactttggatgcgattggtctgctgttgggcgataaagccgattacagccaagtccgcagcggcgcaaaagaagcgcagttgtcggcgttgtttgatatttcccatttacctgttttaaaagcagaattgtatgaacaggggcttttaaacgacggagaagaagaactcagtatccgccgcattatcgatgccaaaggcaaaagccgcagctttatcaacaatcaggccgctaccttggcgcaactcaaagccgtcggtagccagcttatcgacatccacgggcaaaacgcccatcattcgcttaatcaggaagccgcccagcgcgaattgttggacgcatttgcgggtagcagggagcaggcggaaaccgtcaggcagctttatcaaaattgggccaatgcgaaaaaagccctccaagaggcgcaggaacacgccgatgccgtcattatcgagcgggagcgtctggaatggcagtttaacgaattgaatcagttggacattaaacaaggcgagtgggaagccctcagccaaagccacgacagccttgcccattctgccgagctgttgcaggctgccgaagaagtcggaagcaagattgacggcgacaacggcatccaacgccatatctatcaatgtcaaaaactattggccaatctgcaaaacatcgagccgcgctttgccgagagcctgaatatgttggcaagcatcgaagccgaattgggcgaaatcagtgccaatatgcgcgatgtggcaggtcgcagcgacatcaatcccaacgaacttgccgcacaagagcagcgcatgggcgagctgatggggatggcgcggaaataccggatcgagcctgaagagttgcctgccaagttggcagaaatcgaagaacgcctgcaaagcctgcaagctgccgccgatttggacgcgctcgagcataatgttgcccacaattttgccgaatatcaggaagctgcccacatcctttctgccatgcgccatcaggcggcagagcgtttgagcggcgaaacgaccgagcatatgcaacaccttgccatgaaaggcgcgcgtttcgacatcgtcctgttgccttcgtcgccgacggcacacggtttggagcaggttcaatttcaagttgccgccaacaaaggcaatccgccccgtctgctgaataaagttgcctccggcggcgaattggcgcgtatcagccttgccttacaggttgttgccagccaatatacccaagttcccaccctgatttttgatgaggtcgataccggtattggagggggagtggctgaaatggtcggcaaggcattacgtgcgttgggcagaaaacatcaggtgcttgccgttacccaccttccccaagtcgcatcctgcggagaaaaccactggcgggtgcgcaagcacagcgagggagagcaaaccgtcagcgaaatcagtatattggatgaaatccaacggatcgaagaggttgcccgtatgttgggcggagaagtcattaccgatacgacgcggcaacatgcggcagaattgctgcaacttgcgtcgaaaaatagtttattttaa

SEQ ID NO: 4797 - DNA, 1440 bp, Neisseria meningitidis
atgcagtgcctccagttcgacagcatcaacctcatcgaacacatcctgcccgatgtccgcttctggctggttcccccttcacgcacccaccacctgcacgaacatttccaccacatttcctggcagaccgaagccatcccgcaaaccgaaagcaagcccgacaaaccctggtttgcacttccacaaacatccgaacggcaaaaaccggaacacatcctcgttatcggcgcgggcatatccggcgcggcaaccgcccacgccttagcatcacacggcatttccgttaccgtattggaagcccgaaaagccgcccaagccgccagcggcaaccgccaagggctgctctacgccaaaatctcgccgcacgacaccgaacagaccgaacttttgcttgccggctacggctacaccaaacgcctgctcggacacatcctgcccgaatccgaaacctggggcggcaacggcatcatccacctcaattacagccgcaccgaacaacaacgcaatcacgaattgggtttgcaaaaacaccataaccacctctaccgcagcatcacatctgcagaagccgaaaaaatcgccggtatcccactgtccgtcccatacgaccacccttcatgcggactctactggcaacacggcgtatggctcaatccacccgcattcgtccgcaccctcctcaaccatccgctcattggactacacgaagacacacccttgaccgacatttcccacgacggggaaaagtggattgcaagcacgccaaacggcacatttaccgccacacacatcatctactgcaccggtgcgaacagcccctacctacccgaaaccaacctcgccgccctgcctctcaggcaaatacgcggacaaaccggcctcacaccgtccaccccgttttccgaacaactgcgttgcgccgtttcaggcgaaagctacatcagcccgtcgtggcacggactgcactgctacggcgcgagttttattcccaacagcagccataccggatggaacgaagccgaagaagcctcaaaccgccaagcattggcacaccttaaccccgccctttccgaatcattgtttgccgccaacccaaacccccaaaaacaccaagggcacgccgccatacgctgcgacagccccgaccaccttcccctagtcggcgcactcggcgacattgccgccatgcggcagacctacaccaaactcgcgctggacaaaaactaccgcatcgacaccccatgcccatacctgcctaatgcctacgtcaacaccgcgcacggcacccgcggactcgccaccgcccccatctgcgccgccgccattgcagcccaaatcctaggcttgccccatcccttttcacaacgcctgcgccacgccctacaccccaaccgcaccatcatccgcgccatcgtcagaaggaaggatctaaccccttaa

SEQ ID NO: 4798 - DNA, 360 bp, Neisseria meningitidis
ttgaataatattcctgttgaaatccgtttgttgaaaaaccgtaccgtgttggttttgacttatggggacgaacctaaaaatctgcctgccgaatttttacgcgtctattcgccgagtgcggaagtgcgcggacacggcgtgggacaggatgttttgcagaccggcaaggcggatgtccaaatcgcggatttgcagcctgtcggacagtacgcgctgaaaatcagtttttcagacgggcacgacagcggtctttacgattgggcgtatctgcacagactggcatacggatacgatgcgatgtggcaggaatatttggacaaattggcggcggcgggcgcgtcgcgttttgaagagaaataa

SEQ ID NO: 4799 - DNA, 738 bp, Neisseria meningitidis
atgggcggacagaaaacgcatttcggattcagtacggtcaacgaagatgaaaaagccggcaaagtggcggaagtgttccactccgtcgccaaaaactacgacattatgaacgatgtgatgtcggcagggctgcacagggtgtggaagcatttcaccatcaacacggcgcacctgaaaaaaggcgataaagtgttggacattgcgggcggtacgggcgatttgtcgcgcggttgggcgaaacgggtcggcaaggaaggcgaggtttggctgaccgatattaattcctctatgctgaccgtcgggcgcgaccgtctgttgaacgaaggcatgattttgcccgtatcgcttgccgatgcggaaaaactgcctttccccgacaattatttcaacttggtttccgtggcgttcggcttgcggaacatgacgcataaagatgccgcgctgaaagagatgtaccgtgttttgaaaccgggcggcacgttgctggtgttggagttttccaaaatctacaaacctttggaaggcgcgtatgatttctattcgttcaagctgctgccggtcatgggcaggctgattgcgaaagatgcggagagttaccagtatcttgccgaatccatccgtatgcaccccgatcaggaaactttgaaacagatgatgctggatgcgggcttcgacagcgtggattatcacaatatgagtgcgggcatcgtcgcgctgcataagggcgtgaaattttaa

SEQ ID NO: 4800 - DNA, 480 bp, Neisseria meningitidis
atgccggaaagtattttcaaacagatttcccttgatattttgaaactgcatcgggattctgtttattcgctgcttgccacttccggctgcaactgtcaggtgcatgaagcggcgtatgtcaacatcgacggcaaatattatattgcgctttcatgcgagcccgaggtgggggaagtcaaaacaggcattttgctgattgaggatgaaagccgcaaccttcgtttgagctgggtcggcagtgcgcgggagcttgactgcaaggataatgcctacaaacgcgccctgtccgcgttgtccagaaagctggggcggtgtaaggacaggctgcatacggcggttcaaccgtttctgttggagctggtaccggagaaaggcagattttctgtcggcgatgaagaagtttggatttctcgaaacgatttagtgagggctttatatcctgtcggatacagtatgcggcaggcagtgtttcagatttaa

SEQ ID NO: 4801 - DNA, 495 bp, Neisseria meningitidis
atgaacaacagacattttgccgtcatcgccctgggcagtaatcttgaaaaccctgcccaacaggtacgcgccgcattggacacgctgtcgtcccatcctgacatccgtcttaaacaggcttcctcactgtatatgaccgcgcccgtcggttacgacaatcagcccgattttgtcaatgccgtctgcaccgtttccaccactctggacggcattgccctgcttgccgaactcaaccgtatcgaggctgatttcggacgcgaacgcagcttccgcaacgcgccgcgcacattggatttggacattatcgactttgacggcatctccagcgacgacacccgactcaccctgccgcatccgcgcgcgcacgaacgcagtttcgtcatccgccctttggcagaaatcctccctgattttgttttaggaaaacacggaaaggttgccgaattgtcaaaacggctgggcaatcaaggtatccgtcttttaccggacaggtaa

SEQ ID NO: 4802 - DNA, 375 bp, Neisseria meningitidis
atgcagtatctgattgtcaaatacagccaccaaatcttcgttaccatcaccattttggtattcaacatccgttttttcctactttggaaaaatccagaaaagcccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcgtcgcctgcatcgtttaccttgccaaaaccaaagtcctgcctttctga

SEQ ID NO: 4803 - DNA, 567 bp, Neisseria meningitidis
atgttattgcaaaacatccttccattcgcccattgccttttgcggaaggcacttcccgaaggtggcaatgctttggacggcaccgccggcaacggacacgacacccttttcctcgcacaaaccgcaggcatccgggggaaagtgtgggcattcgacatccagccgcaagccctgaacaacacccgatgccgtctgcaggaagcaggttacagcaatgtacggctcatcttggacggacatgaaaacctgaagcaatatattccaaagccgctggatgcagccattttcaatttcggctggctgcccggcggggacaaaagccttaccacccgcacggaaaccagcattgccgccctttctgccaccttatccctactgaaagaaaacggtatgcttattgccgtcctctatccgggacacgaaaacggcaaacaggaggcagaagcaatcgaacaatgggcaaaaaacctgcctcaagaacagtttgccgttttgcgttacggctttaccaaccggaaaaacagcccaccctatcttttggtatttgaaaaactgcgtcaaaaataa

SEQ ID NO: 4804 - DNA, 294 bp, Neisseria meningitidis
atgacagctaaaggacaaatgttgcaagatcccttcctgaacgccctgcgtaaagagcacgttccggtttcgatttacttagttaacggtatcaaattacaaggtcaggttgagtctttcgatcaatacgttgttctcctgagaaacacttccgtcacccaaatggtttacaaacacgccatttccaccatcgtaccggcacgctccgtcaacctacaacatgaaaacagaccccaagccgcaccgacttcgaccctcgtccaagtggaaaccgtccagcagcctgccgaataa

SEQ ID NO: 4805 - DNA, 939 bp, Neisseria meningitidis
atgtccatccatactctgaaacgcctgccctcatcgctgctgctcggtctctgcctttccctgccgtcagcccacctttttgccgacaacgacattttagggcaatttttagaacagaacatgcttacctcctccgatccgatagaaatattcgccgaaagcacgatacaccccaccaacacccaagccattacaggcggtctgattctctcctcacagtctgccctggtcgtcaacaacaaaaccggacagatactgtatcagaaaaacgccgacaggattatgcccatcgcctccatttccaaactgatgagcgcgatggtcgttttggatgcaaacttggacatgaacgaaaccgttaccattacgcccgacgaaatcgaccgcatcaaagggaccggcagccgtcttgccataggtacggcacttacacgcaaaaaactgctgcacctgagcctgatgagcagcgaaaaccgcgccacccatgcattgggcagaacctaccccggcggcatgggcgcatttgtcgccgccatgaaccgcaaagcccaaagcctcggtatgtacggcagccgcttttacgaaccgaccggactcaacttccaaaacgtttctaccgccaaagacctgagccttatggtcaacgccgccgcccaatatccgcaaatccgcaccaactcgacttccaactacgcctcggtacagaccaaaaacgggcagcagaactacaaaaactccaatgccctggtcagagaaggcatgtggaacatcgaattgcagaaaaccggctacatacgcgaagcaggcaggtctatggttgtcaaagccaacattcaaaaccaacccgttaccatcgtattgctgaactcgcccacatccgccacacgcgtcaacgacgcccgcaaaatcgaatcgtggatgctgcagcaacgctcctga

SEQ ID NO: 4806 - DNA, 441 bp, Neisseria meningitidis
atggatgtgaaatatgaatttaccctgccttcgagcagcggtgcggattttcattcggcagaacatctgcctttggtcgtgtatttttatccgaaagacagtacgctgggctgtacgacggaaggcttggatttcaatgcgcgtttggaacagtttgaggcattgggttataccgtggtcggtatttcccgcgacggcgtaaaggcgcatcagaatttttgcgccaagcagggtttccggttcgagctgttgagcgacaaggatgaaacagtgtgccgcctgtttgatgtcatcaaattgaagaaactgtacgggaaagagtcgttaggtatcgagcgcagtacgttcgtcttgaataaggatggagaaatcgcccatgaatggcggaaagtcaaagtggcgggtcacgcgcaggaagtattggaaacgctttcccgataa

SEQ ID NO: 4807 - DNA, 876 bp, Neisseria meningitidis
atggaagaaggtttgatcgacaggctgcttgaaacgctgtggttggacaggcggctcagtcagaatactttaaacggttaccggcgcgatttggaaaaaatcgcccgccgcctgtcccaatcgggcagaatgctgaaggatgcggacgaagcggatttggcggcggcggtttatgttgacggagagcaacggagttcgcaggcgcgcgcattatcggcatgcaaacgcctgtatatatggatggagcgtgaaggcataaggacggacaatcccacccgtttgctgaaaccgcccaaaatcgacaagaatattccgaccctgatcaccgagcagcagatttcccgactgcttgccgccccggataccgacacgccgcacggtttgcgggacaaggctttgctcgaattgatgtacgcgaccggcttgcgcgtcagcgaggcggtcgggctgaacttcggcaatgtggatttggacaggggctgtattaccgcgctgggaaagggtgataagcagaggatggtcccgatggggcaggagtcggcgtattgggtggaacgctattatacggaggcacgcccacttctgctgaaaggcaggaattgcgacgcattgtttgtcagtcagaaaaagacgggcatttcccgtcagttggcatggatgattgtcaaagaatatgcaagtcaggcaggcatcgggcacatcagcccgcacagcctgcgccacgcctttgccacgcatctggtgcggcacggcttggatttgcgcgtggttcaggatatgttgggacatgccgatttgaatacgacgcagatttatacccatgttgccaacgtatggttgcagggtgtagtgaaggaacaccattcccgaaactga

SEQ ID NO: 4808 - DNA, 201 bp, Neisseria meningitidis
atgtttgtctgcatctgcaatgccgttaccgaccatcaaatcaaggaaaccatcgccgccggcgcgaccacaatgggcgatttgcagtcgcaattgggcgtagcgagctgctgcggctgctgcggggagcttgccgcttcgtttctgacggcgcacaatgcgcaaccgacggttacggcgggtatcaacgttcaagcgtaa

SEQ ID NO: 4809 - DNA, 234 bp, Neisseria meningitidis
atgaaattgaccttgatgtttcgtgaatattgcagcttgtgccacaaaatgcgcgacgaactcaaaccttttcaggatgaatacgggttcgggctggaagtggtcgatgtggatgaaaatcctgttttggaagaaaaatacaatgagctggttcccgttttgttggcgggagatgaggaaatctgtcactggtttttggatgaggacaggttgaaacagtttctcgaacggtaa

SEQ ID NO: 4810 - DNA, 111 bp, Neisseria meningitidis
atgccgtctgaagcaggacttcaggcggcatttttttcaaatcaacgttctttacgtttttgcggggcggatgacctgccggtaaaggaagcacgtttggatgcttggtaa

SEQ ID NO: 4811 - DNA, 144 bp, Neisseria meningitidis
atgttgcatattaaccctttctttattttatttgtcggttgggaggattcttatttattgattttttcaataaaaattagaaaatttattgtgagatgttattgttggcaatcatatcatgttttactgttgatggaagcatga

SEQ ID NO: 4812 - DNA, 921 bp, Neisseria meningitidis
atgagaatcctattgacaggctcgaaaagccaactggcacgctgcctgcgcgaccgtcttccggaagactgggaaaccattgcgacggattccgcatccctagacattaccgatgccgatgccgtctgcaacatggtcaaaagtttccaacccgacgccattgtcaacacggctgcctatactgccgtcgacaaggcggaaggcgatgcggcagcggcatttgccgtcaatgcttccgccgtttacaaccttgccttggcagcacatcgcgcccatgcccgattcatccacatctcaaccgactatgtctttgacggtaaagggaaaagaccctatcaggaaagcgactttaccaatccttccaatgtatacggacaatccaaaaccgcaggcgagctgctcgcactgtctgccaatcccgacagccttatcctgcggacttcttggctgtttagcgaatacggggacaactttatccgcacgatgctgaaccttgcgcgggaacgttccccgctgtccgccgtccacaaccaaatcggctgcccgacctatgccggcgacttgtccgccaccatcatccgcctgttgcagcactccaatcccgttcgcggcatttaccactacgccggcagcaaatccgtatcctggtacgaatttgcccaacatattttccaagcggcatcgcaacagcagacatccttccccgttcccgaattgactgccgtttcagacaaggaatatccgaccgccgcccccaggcccgcatacagcattttggactgccgcaaaatcgaaaacgacttcggcatcaaaccgtcagactggcaaaaagccttgcacaggtcgtttccaagctgctctgatgccgcccgcccctctgtttccgccgtcaagcaccgccttggcggttttcttatatag

SEQ ID NO: 4813 - DNA, 864 bp, Neisseria meningitidis
atgagtgagattggtttggtaaagatctattttggaaaagtgcgcgatttatatgaaatcgacgataaacgtatgctgatggtcgcttccgaccgcctgtccgcgtttgatgtgattttggacgacccgattccgagcaaaggggagattctgacgcagatttccaatttttggtttaaaaaactggcgcatattatgcccaaccactttaccggtcaaacggtttacgatgttttgcctgaaaacgaagccaaagctttagagaaacgcgccgtcgtggctaaaaagctcactccggtgaaagtagaggcgattgtgcgtggttatctggcaggcagcggttggaaagattatcaaaaaaccggctcggtttgcggtattcaactgcctgaaggtatgcaggaagcgcaacaactgcctgaagtgatttttacgccctcaaccaaagccgcagtcggcgatcacgatgaaaacatcagctttgaagaatgcggacgcattatcggcaaagaattggcggaagaagtgcgcgccaaggcggttcggctttacaccgaagcggcggaatatgccaaatcgcgcggtattattatttgcgataccaaatttgaattcggtttggatgaaaacggtacgctgacgctgatggatgaggtattgactcccgattcgagccgtttttggcctgccgaccaatacaaagtcggcaccaatccgccgtcttttgacaaacaattcgtccgcgactggctggaacaaagcggttggaacaaaaaagcccctgcgccgaaagtgcctgccgatgtgattcagaaaactgtcgagaagtatcgggaagcattgactttgctgactcaggattga

SEQ ID NO: 4814 - DNA, 2124 bp, Neisseria meningitidis
atgatgttcgacaaacacgttaagaccttccaatacggtaatcagaccgttactttggaaaccggcgaaattgcccgccaagccgccgctgccgttaaagtctctatgggcgacaccgttgttttggttgccgttaccaccaacaaagaagtgaaagaaggtcaagacttcttccccctgaccgtcgattatttggaacgcacttacgccgcaggcaaaattcccggcggtttcttcaaacgcgaaggcaaacaaagcgaaaaagaaatcctgaccagccgtctgatcgaccgtccgattcgtccgctgttccctgaaggtttctaccacgacatccaaatcgtagcgatggtcgtgtccgtcgatcctgaaatcgattctgatattcctgcaatgttgggtgcatctgccgcgctggtgttgagcggcgtaccgtttgccggcccgatcggcgcggcacgcgtcggttatgtaaacggcgtgtacgttttgaatccgactaaagccgaattggcgaaatcgcaattggacttggtggtcgccggtacttcaaaagccgtgttgatggtggaatccgaagccaaaatcctgcccgaagacgtgatgctgggcgcggtggtttacggccacgatcaaatgcaggttgccatcaatgcaatcaatgaatttgccgacgaagtcaatccggaactttgggattggaaagcacctgaaaccaatgaggaactggttgccaaagtccgcgggattgccggcgaaaccattaaagaagcgttcaaaatccgtcaaaaacaagcgcgttctgccaaattggacgaagcttggagtgcggtaaaagaagccttgattaccgaagaaaccgacactttggcagccaacgaaatcaaaggcattttcaaacacttggaagccgatgtcgtccgcagccaaattttggatggccaaccgcgcatcgacggccgcgacacccgcaccgtccgtccgctgaacatccaaaccagcgtattgccgcgcacgcacggttctgcattgtttacccgtggcgaaacccaagctttggccgttgcaactttgggtacttcgcgcgacgagcaaatcatcgacgcgctgtccggcgaatacaccgaccgctttatgctgcactacaactttccgccgtactctaccggcgaagtgggccgcatgggcgcaccgaaacgccgtgaaatcggtcacggccgtttggctaaacgtgcattgttggccgtattgccgaaacctgaagatttcagctacaccatgcgcgtggtctccgaaattaccgaatccaacggctcttcctctatggcttccgtctgcggcggctgcctgagcctgctgtctgccggcgtgcctttgaaagcacacgttgccggtatcgcgatgggtctgattctggaaggcaacaaatttgccgtcctgaccgacattttgggcgacgaagaccacttgggcgatatggactttaaagtggccggtacgaccgaaggcgttaccgcgctgcaaatggacatcaaaatccaaggcattaccaaagaaattatgcaaatcgctttggcacaggccaaagaagcgcgtctgcacatcttggatcagatgaaagccgccgttgcgggcccgcaagagctgtccgcacacgcgccacgcttgttcacgatgaaaatcaaccaagacaaaatccgcgaagttatcggtaagggcggtgaaaccatccgttcgattaccgctgaaaccggtacggaaatcaatattgccgaagacggtacgattaccattgccgcaaccactcaagaagccggcgatgcggcgaaaaaacgcatcgagcagattactgccgaagtggaagtgggcaaagtgtacgaaggcactgtggtgaaaatcctcgataacaatgtcggcgcgattgtcagcgtgatgccgggcaaagacggtttggtacacatcagccaaatcgcccacgagcgcgtacgcaatgtcggcgactacctgcaagtcggtcaggtggtgaacgtgaaagcattggaagtggacgacagaggccgtgtccgtctgtccatcaaagccctgctggacgcgcctgcccgtgaggaaaatgccgccgagtaa

SEQ ID NO: 4815 - DNA, 729 bp, Neisseria meningitidis
atgtgccggactgccgcaaatcatcccttttcccgaaaaatatttgacttcaaactgcctatgaaccacgacatcactttcctcaccctgttcctactcggtttcttcggcggaacgcactgcatcggtatgtgcggcggattaagcagcgcgtttgcgctccaactccccccgcatatcaaccgcttttggctgatcctgctgcttaacacaggacgggtaagcagctatacggcaatcggcctgatactcggattaatcggacaggtcggcgtttcactcgaccaaacccgcgtcctgcagaatattttatacacggccgccaacctcctgctgctctttttaggcttatacttgagcggtatttcttccttggcggcaaaaatcgagaaaatcggcaaaccgatatggcggaacctgaacccgatactcaaccggctgttacccataaaatccatacccgcctgccttgcggtcggaatattatggggctggctgccgtgcggactggtttacagcgcgtcgctttacgcgctgggaagcggtagtgcggcaacgggcgggttatatatgcttgcctttgcactgggtacgctgcccaatcttttagcaatcggcattttttccctgcaactgaaaaaaatcatgcaaaaccgatatatccgcctgtgtacgggattatccgtatcattatgggcattatggaaacttgccgtcctgtggctgtaa

SEQ ID NO: 4816 - DNA, 852 bp, Neisseria meningitidis
atgaacactttgaaatttaccaaaatgcacggtttgggcaacgattttatggtgattgacgcggtcagtcaggattttacccccgaggacgcgccgattgcggaatgggcggaccgcttccggggcgtgggcttcgaccagcttttggtggtcgggcgttcggaaaccgaaggcgtggatttccgttaccgtattttcaatgccgacggcagcgaggtcgggcaatgcggcaacggagcgcgttgttttgcccgttttgttgcagacaagggtttgaccgataagaaagaaatttgtgttgaaacggcaaatggcgttatttttccgaaattgtccgataacggtatggttacggtcaatatgggcaaaccgaagtttatgccgtctgaaataccgtttgtccccgaatcgggcgagggggatgatgcctgtatttacggggtgcatctcgaatccggcattcagcctgtcagctgcgtcaatatgggcaacccccatgcggtgattgtggtcgatgacgtggaatgcgcgccggtgcgcgaaaccggttcgcttatcgaaccgcacaggcagtttcccgaacgcgtcaatgtcggctttatgcaggttgtcggccgaaccgcgattcgtttgcgcgtgttcgagcgcggcgtgggcgaaacccaagcttgcggtacgggcgcgtgtgcggctgtggtggcgggtatccgtctggggctgttggatgaagggaaaacggtagaggtggttttgccgggcgggactttatatatcgaatgggcctgcggcggcgatgtgatgatgaccggccctgcggaagcggtgtttgaaggtgagttggcgtattcatga

SEQ ID NO: 4817 - DNA, 228 bp, Neisseria meningitidis
atggttttgggcgagtattatgctgtggctgggcatatcggttttgggggcaaagctgatgcccggcatatggggaatgacccgcgccgcgcccttgttcatcccccatttttacctgactttgggcagcatattttttttcatcgggcattggaaccggaaaacagatggaaacggatggcaggcagaccccgaacatccgctgctcgggctttttgccgtcagtaa

SEQ ID NO: 4818 - DNA, 459 bp, Neisseria meningitidis
atgtgcgttggtgcattattgcttttcgggaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggctcgcagctgcgactcggcgggttgacggcagcgttgatgcaggtctcggtactggtgctgctgctttcagaaattggaagataatacggtgcggccgtatcggaacaaaaagttataaagaaagaaattttggatattggttttttaggcggcataggtttaggataaagccatatccgaaatttgtttatgtttcggcgcaaatcccctgcaatcggacaggatgcctatggggattgcgccttactgtcgaaaccttattattcaggagcagaagatga

SEQ ID NO: 4819 - DNA, 933 bp, Neisseria meningitidis
atgaaaattgcaaacagcattaccgaactaatcggcaacacgcctttggtcaaactgaaccgtctgaccgaaggtttgaaggcagaggttgccgtgaaactggaatttttcaatccgggcagcagcgtcaaagaccgcattgccgaagcaatgattgagggtgccgaaaaagcgggcaaaatcaacaaaaacaccgtcattgtcgaagcaaccagcggcaatacgggtgtcggtttggcaatggtatgtgccgcacgcggctacaagctggcgattaccatgccggaaagcatgagtaaggagcgcaaaatgctgttgcgcgcgtttggtgcggagctgattctgacccctgccgccgaaggtatggcgggcgcgattgccaaagcgaaatccttggtggacgcgcatcccgacacttattttatgccgcgccagttcgacaatgaggcaaaccccgaagtccaccgcaaaacaaccgccgaggaaatttggcgggatacggacggcaaagtcgatgtcttcgttgccggcgtcggcacgggcggtacgattaccggcgtgggcgaagtgttgaaaaaatacaaacccgaagttaaagtggttgccgtcgagcctgaagcttcacccgtattgagcggcggcgaaaaaggcccgcacccgattcaaggcatcggcgcaggctttattccgaccgttttgaataccaaaatttacgacagcattaccaaagtgtcgaacgaagcggcttttgaaaccgcccgcgcaatagcggaaaaagaaggcattttggtgggtatttcttccggtgcggcggtttggagtgcgttgcagcttgccaaacagcctgaaaacgaaggcaagctgatagtcgtgctgctgccttcttatggcgaacgctatctctctacgccactttttgcagatttggcataa

SEQ ID NO: 4820 - DNA, 906 bp, Neisseria meningitidis
atggggaagggaggggatattgtggtcggtaacggcaaaaaatatgccgcaccattgctggtgctgggttgcgtggtgttcggtctgggcagtctgattgtcagatccgtccccgtcggttcgtatgcaatcgcattttggcggttgctgatttcggtgttcgtattttggtttttagcacggtttttcaggcaaaaattcccaaaaaacaggaaaaccgtccgatatgccctgacggcgggcgtgtttctcgctttcgatttggcgttgtggcacgaaagcatacacgcggtcgggccgggtatttccaccctgctcaacagcctgcaaatctttttcttgtcggcaatcggtgttttctttttcggcgagcgtttgagcgggctgaaaaaggcaggcttaatatcggcagttgccggcgtggcgatgattgccggtgcggaattcggctacaacggtaatgcggtttggggattcgccagcggtttggtatcgggactgatgctcgccctgtcgatggtgtttgtccgcaaaacccatgaaatcgagccggtggcgcttttcccttcaatgatgattttgagtttgggcggcgcggtatcgctggttgttccggcattgctgatggatggcggcgcgctttatccgacgacttggaaagatgcgggtttggtgcttgtgtacggcgtggtgatgcagtgcttcgcgtgggcgatggttgcctatgcgattccgctgctttcgctgtcgctgacggggctgctgcttttgtccgaaccggttgccgccctgttcatcgattatttcgggttgggcaaaccgattgaaggcgtgcagtgggcaggggtggcgctgacgctttcggcaatttacctcggttcgctgaaacggcagtcttcacattga

SEQ ID NO: 4821 - DNA, 1020 bp, Neisseria meningitidis
atgaacacaatgctaatgtcgggcgcggctgccgcgctgcttgccggcatcatcctttatttcaaaagcgacaagaagcggcaggaaaacggggaatggagttccggccttgaatacgcctatatcctgacagcggtcggcgtgtttgccgctttgtccctgtttatgagctttaccgccgttttcctgattttcgttgtattgtgcggtacggcttggggggtatataaataccgcctgaagactcatcccgaaatctcggaaagcagccacttcggcgattatttcggcagtttcttccctaccgttttggtattgttcctcatccggtcgtttatcgccgaaccgttccaaatcccgtccagctcgatgcgcccgggcctgatcaagggcgatttcattttggtcggcaaattttcctacggcctgcgcgtacccgttttaaacaatatatttattcctacaggcaaaatcgaacggggcgatgtcgttgtttttaattatcctctgcagccggagatgacctacatcaagcgtattgtcggcattccgggcgatgtggtcgaatatcgggataagattttgacggtaaatggcaaacccacttccgacattcctgacggcacataccgttatcccgacgacaccgacccttccgaaatccacaacacggatatgttccgcagcggtctagacggcaaatccttcaatattctgaaaaaagaaggacagcctgccgtttccctgcccgtattgggcaaatatacctccgatattatgtctgaaaacggatattccatagagcaaagcggtttggaacactgccaatatgccgacgacggcagcggtttcgtgtgcaaagttcccgaaggacgctatttcgctatgggcgacaaccgcgacaacagtgccgattcgcgctactggggatttgtggatgacaagctggttgtcggcaaggcaatgttcattttgatgaacttcggcgatttcggcaggtccggtacggcaatccgttag

SEQ ID NO: 4822 - DNA, 1794 bp, Neisseria meningitidis
atgaaaaatatccgaaatttctccatcattgcccacatcgaccacggcaaatcgacgcttgccgaccgcttcatccaatactgcggcggtttggatttgcgcgaaatgagtacgcaggtgctcgattccatggacatcgaaaaagagcgcggcattaccatcaaagcgcaaaccgccgcgctcaactataaagcacgcgacgggcaggtgtatcaactcaacctgattgacacgccgggacacgtcgacttctcttacgaagtttcccgttcgctgtcggcttgcgaaggcgcgcttttggtcgttgacgcgtcgcaaggcgtggaagcgcaaaccgtggcgaactgctacaccgcgattgatttgggcgtggaagtcgtgccggttttgaacaaaatcgacctgcccgccgccgaccccgaacgcgtggaacaggaaatcgaagacatcatcggcatcgatgccgtcggcgcggtgcaatgttccgccaaaagcggcatcggcgtggaagacgttttggaagaaatcgttgccaaaatccccgcaccgaccggcgacgaaaacgcgccgctgcaagcggttatcgtcgattcgtggtttgacaactatgtcggcgtggttatgctgattcgagtgaaaaacggcaccatcaaactgaaagacaaagtgcgctttatgagcaccaaggcggaaacgcaggtcgagcagctgggcgtattcacaccgaaatcagttcaaaaacaagaactaaaagccggcgaagtgggctttttgattaccggcgtaaaagaattgggacaggcgaaagtcggcgatacggttactttggttgccaaccctgccactgagccgctgcccggtttccaagaggtgcaaagccaggtattcgccggactttatcccgtagaaagccacgactacgaagctttgcgcgatgctttggaaaaattgcagcttaacgatgcttcgttgaaatttgagcctgaggtttcccaagcattgggtttcggcttccgttgcggcttcttgggtctgttgcacttggaaatcgtgcaggaacgcttggagcgcgagttcgatatggatttgattaccaccgcgccgacggtgatttatgaagtcgtgttgaaaagcggcgaaaaaatcgaagtcgaaaatccgtccaaactgcccgacatcggcagcatcgaaaccatactcgagccgattattaccgcgaccatccttgtgccgcaggaatacgtcggcaacgtcatgactttgtgtaaccaaaagcgcggcgtgcaggtcaatatgcagtacatgggccgccaagtgatgctgacttacgatttgcccatgaacgaagtggtgatggactttttcgacaaactcaaatccacttcgcgcggctatgcttcgttggattatcatttcaaagagttccaaccgtctgatttgattaagctggatattatggtcaacggcgaaaaagtcgatgccttaagcctgattgtgcaccgtcaaagcgcggttcaccgaggccgcgagctagcatcgaaaatgcgcgagctgattccgcgccaaatgttcgacattgccgtccaagccgccatcggcagccagattatcgcccgcgaaaacgtcaaagcactgcgtaaaaacgtcttggcgaaatgttacggcggcgatattacgcgtaagaaaaaactgcttgaaaaacaaaaggcaggtaaacgccgtatgaaacaagtgggcaatgtggaaattccgcaaagcgcgttcttggcgattttgcaggtgagcgacaaataa

SEQ ID NO: 4823 - DNA, 702 bp, Neisseria meningitidis
atgtctttgaaaacagtagccgttatcggcgcaatggaacaagaaatcgagcttttgcgcgagatgatggaaaatgtcaaagccgtctctttcggcagattttccgcctatgaaggcgaattggcgggaaaacgcatggtgcttgcattgagcggcatcggcaaggtcaacgcggcggttgcaacggcttggattatccgtgaattcgcagcggactgcgtcatcaacaccggcagcgcgggcggtttgggcaagggtttgaaagtcggcgacgtagtcatcggcacggaaaccgcacaccacgatgtcgacgtaaccgcattcggctatgcctggggacaagtgccgcaactgccggcaaggtttgcttcagacggcattttgattgaggcggcaaaacgggcggcgcggacgtttgaaggcgcggcggtagaacaagggctgattgtcagcggcgaccgctttgtccacagcagcgaaggcgtggcggaaatccgcaagcacttccccgaagtcaaagcagtggaaatggaagcggcggcaatcgcccaaacctgtcatcagttggaaacgcctttcgtcatcatccgcgcggtttccgattcggcagatgaaaaagcagacatcagctttgacgagttcttgaaaacggcggcggcaaattccgcaaaaatggtggcagaaatcgtcaaatctttataa

SEQ ID NO: 4824 - DNA, 1113 bp, Neisseria meningitidis
atgaccgcaaaggaagaactgttcgcatggctgcgccatatgaaccaaaacaaaggttccgacctgttcgtgacaacccatttcccgcccgcaatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagcctgccggacaccagccgcttccgcgtcaatgcgatgatacagcgcggcgcgacggcgttggtattccgtacgattaccagcaagattcccaagtttgaaagcctgaacctgccgccagtcttgaaggatgtcgcgctgaaaaaacgcgggctggttatttttgtcggcggcaccggctcgggtaaatcgacttcgcttgcctcgcttatcgactaccgcaatgaaaattcgttcggacacatcatcaccatcgaagacccgatcgagtttgtccacgaacacaaaaactgcatcatcacccagcgcgaggtcggcgtggatacggaaaactggatggcggcgttgaaaaacacgctgcgtcaggcgcctgatgtcatccttatcggcgaaatccgtgaccgcgaaacaatggactacgccattgcctttgccgaaacggggcatttgtgtatggcgacgctgcacgccaacagcaccaatcaggcactcgaccgcatcatcaactttttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgatcaacacctttaccaattgtatgaaaaaggcgatatttccctgcaagaagcattgaaaaatgccgattccgcacacgatttgcgtttggcggtacagttgcgcagccgccgcgcgcaaagttccagccccgatttggaactgctctga

SEQ ID NO: 4825 - DNA, 978 bp, Neisseria meningitidis
atgatttatccgtggcataatgagcaatggcggcagattgcggaacattgggagcgtcgtcccaatgcatggctgtttgccggcaaaaaagatacggggaaaactacatttgcccgctttgcggcgaaggcactgttgtgcgaaacccctgcaccgggctgcaaaccctgtggcgaatgtatgtcctgccatctgtttggacagggaagccatcccgatttttacgaaatcacccccttgtcggacgaacccgaaaacggacgcaaactgttgcagatcaaaatcgatgccgtcagggaaatcatcgataatgtgtacctgacttcggtacggggcggtttgcgcgtgattctgattcatcctgcggaaagtatgaatgtccaagccgccaacagtttgttgaaagtgttggaagaaccgccgccacaagtggtctttttgctggtcagccacgcggcggacaaggttttaccgaccattaaaagtcgctgccggaagatggttttgcccgctccttcccatgaagaggcattggcatatctgcgtgaaaggggtgtggcggaacctgaggaacgtctggctttccattccggagcgccgctgtttgatgaggcggacggtgtccgtgcgttgcggattaaactgttggatattttggcagaaccaaggttgttgaagattttggattacgccgcgcttttcgataaggaaaaacttccgctcgccgtatttgtcgggtggatgcagaaatggctggtcgatttgggattgtgcctgcaacacatgaaacccgtctattatcccgcttatgaagacaggctgcttcagacggtatccggtttccgtccgcgcaatgtatttgcggcggaggatatgctcaaacagcttgccccctacgggtttcatactttaaatgtcaaaatgcagatcgagcatctgctcatcaactatttggaattgaagaaagagaacgggtga

SEQ ID NO: 4826 - DNA, 351 bp, Neisseria meningitidis
atgtcagacggacaaaatattccggcaaaaatgatgtcgttgcagctgaaagacatgaatctgctgtacagctcctacatgccgtttttggaacacggcggtctgtttgtgcagaccaacgacgtattttccatcggggacgatattctgcttgccgtagaaatcctcaacttccccaaactgttcctgccgaccaaagtcgcctggatcaatcctgcgcgtacttcctccaaacccaaaggggtggggctggcattcacaaaacacgaaaactgcctgaaagtcaaagaccagatcgaagtcgaactgggcaacacaatcggcggcagcagacctacgtttaccatgtaa

SEQ ID NO: 4827 - DNA, 780 bp, Neisseria meningitidis
atgcatatcatcgattcgcactgccacctcaattttgaaggtttgaaagaacgcctgcccgaagttttgtccaacatggaagcaaacggcgtggggcaggcactcgccatcagcgtcagtagggaaagcttctccgaagtctttgccatcgccgaagcgcacgaacacatctattgcaccataggcgtacatcccgacagcaaggaagccgaagaattttccattgcggaaatggtcgaagccgccgcccatccgaaagtggtcggcatcggcgagacgggtttggattattactggtgcaaaggcgatttgtcctggcaacacaaacgctttgcagaccacatcgaagcagccaatcaaaccggactgcccgttatcgtccatacgcgtgatgcggcggcggacaccttgtctatcctgaaagaatgccgggttaattcgggcgttatccactgtttttccgaagacatcggttttgcccgtgcagcaatggatttggggctttatatttctttctcgggaatcgttacctttaaaaacgcacccttggttcaggaggcggcgaaatatgtgccggacgaccgcattttggtggaaaccgatgcgccgttcctcgcccccgttcccaaacgcggcaggcagaacgaaccggcttttgtgcgccataccgccgaacatatcgccaaattgcggaaccaaacattggaacaggttgcggcatatacgacggaaaacttttaccggctgtttaaaaaagtacccgatatgcggaccgtctga

SEQ ID NO: 4828 - DNA, 216 bp, Neisseria meningitidis
atgaaggcaattcatccgtatgcatgtccgcgctgctgccggctgcctgccaacacgtttcggacaggcatggcaaattccgcttccaaattctgcattgccaaaggcggcagacgggaagcaaaaaaagacgaaagcggcggcggatatgccctgtgccatttgccggacagcaggattgtcgaggagtgggaatatttccgttcacaatattga

SEQ ID NO: 4829 - DNA, 312 bp, Neisseria meningitidis
atggcttccatccacgaccaaattaaagaagtagtaacgacacaccgcgtcgtattgtttatgaaaggtacgaagcagtttccgcaatgcggtttctcttcccgcgccgtgcaaatcctgaacgcggcaggctgcaccgattacgttaccgtcaacgtattggaaaatcccgaagtgcgccaaggcattaaggaatacagcgactggccgaccatcccccaactttatgtgaacggcgagtttgtcggcggttcggacatcctgatggaaatgtatgaggcaggcgagctgcaagagctgctgaaagcctga

SEQ ID NO: 4830 - DNA, 627 bp, Neisseria meningitidis
atgaacgttaatgttatcaaccatccgctcgtccgccacaaattaaccctgatgagggaggcggattgcagcacctacaaattccggacgcttgccaccgagctggcgcgcctgatggcatacgaggcaagccgtgattttgaaatcgaaaaataccttatcgacggatggtgcggtcagattgaaggcgaccgcatcaagggcaaaacattgaccgtcgttcccatactgcgtgcaggtttgggtatgcttgacggtgtgctcgacctgattccgactgccaaaatcagtgtagtcggactgcagcgcgacgaagaaacgctgaagcctatttcctattttgagaaatttgtggacagtatggacgaacgtccggctttgattatcgatcctatgctggcgacaggcggttcgatggttgccaccatcgaccttttgaaagccaagggctgcaaaaatatcaaggcactggtgctggttgccgcgcccgagggtgtgaaggcggtcaacgacgcgcaccctgacgttacgatttacaccgccgcgctcgacagccacttgaacgagaacggctacatcatccccggcttgggcgatgcgggcgacaagattttcggcacgcgctaa

SEQ ID NO: 4831 - DNA, 321 bp, Neisseria meningitidis
atgaattttcaagactatctcgccacatttccttcaatcgaccatctgggcggtttggacgttcaggatgccgacggcaaaacggttcaccacattcctgccgttcagggtaagctcggttcgctcaagctgtacaatgctttggcggaacgttttgacggaaaattgggtaaagaagcggcagaacagggtttgatatggtttgccgaacacgttgccgacgcgcgtgcccatccgggcaagcatccgaacatcgatctgctggaaaatgtcgtgcaaagcggtgaaacctggttgctcaagccgctttccgcgcaataa

SEQ ID NO: 4832 - DNA, 420 bp, Neisseria meningitidis
atgaaaaaaatgttcctttctgccgtattgcttctgtcggctgccgcccaaaccgtgtgggcggatacggtgttttcctgtaaaacggacaacaacaaatacatagaagtccaaaaaatcaaccgcaatctttacgaatattcgttcggcagtgcggcaaaaaaagaaattgccatacgcaacagcaaagctgacctgttggggcgttccgacaggtggcaaggtatgggcagcggtcgttgggcaacgatgaaattccaaaacggcgaatttatgtacaccatatggacaggcttcgattccgtgactcatacggaaagcagcggtgtcgttgtggagcgtaggggcaaggaagtcgcacgggtcggctgtacgccgaaaaccgcgcaggcgaatttcaacgatgacgatttttcctag

SEQ ID NO: 4833 - DNA, 741 bp, Neisseria meningitidis
atgctgattgtccgtccgtcgggcagggccgcagaagatgtcgaaacttgcctgaatgccggttggcgcgcggaagtattgagtccggtcgaaatcgaagcagatgctgccggactggaacttttgtccgaacaatatgcccgtgcggatgccgtgttttgggtcagtccgaccgccgttgaaaccgccgtcccgtaccttaacctttcagacggcataaaggcgcagattgccgtagggcagggcagccgccgcgcattggaacgctgtttggtcagaacggtcatcgcgcctgatgacggcaacgacagcgaggcggttttgcgcctgccggtttggaacagtctgcccgaaggtgcgcgcgtattgtttgtgcgcggacacggcgggcgggattttttgatgaatgccttgcaggagaaaggttttcggacggaggtggcagaagtctatttcagacggcataaacctttgaactttcaaaatttccaaaccgaaaatattgccgccgcctatattacgtcgaccgagctggtgcgcttgctgttcgggcagcttccgccgcaattttcccgattcttcaaatccttgctatactttacccatcatccgcgcattgcggaggcattgaagcgcgaaggcgtgtgttcggtcgaaaccgtccctacgctggaagccgcgctttcccattcttccatttccgtttcagacggcatggtctttcccggaacctcaaattaa

SEQ ID NO: 4834 - DNA, 1275 bp, Neisseria meningitidis
atgccgtctgaaacctcttccccacgcaaagaaaacgaaacagaagtacacattcctgccgctccttttatcgtcaaacagtccggcagcaacgctttggcagtctgcgccctggtattggcggcattgggtttgggtacaagtggttttttgtttgtccaaggacagaatgtcttgaaaaaccaagagctggcattcaaccaaaaaatcgacaaagccgccttgggcgagtcggaaaacgccgccctgttgaaagacaacctcaaccggcaagccgccatacaatcagagctcgaccgtttggacggaaacgtcaaagcaaacggcgaacaaatcttggaaatgcaaaaatcctatcgcgagttgaccaaaggacgcgccgattggctggtggacgaaaccgagaccatactcaatctggcggcgcaacagctggtgttgactggcaatatccaaacggcagtcggcgtattggagcatatcgacagccgcctgtcccgtttcaatcaggcagagcttctgccgatcaagcaggcggtcagcagcgacttggcggaactgaaaaaccgtccctatgtcgatatttccggcacggcattgcgcctcgacaggctggaaaccgccgtatccggactgccgctgatgctcgacggcgtgctgaaaccgggcgtacaggtgaagaacgaagccgcttccgcttcatggtggcagaacgtatgggaaaaatccctcggcacattgaaggggctggtcgaaatccgacgtttggaaaacaacgatgccatgctgatttctcccgaacaggcatattttgtgcgtgaaaacctgcgcctccgccttttggatgcgcgcactgcattaatgcagcgcaacagcgaagtctatcagggcgatttgaacaatgccgaagccgccgtcagacagtatttcgatgccaagtctcccgccacgcagtcgtggctgaaagaactggcggaattgaaggcgttggatgtgcggatgactgcggatgacggtttgaaaaacagcctaaatgccgtccgcgcctatcgcgacggtacgcgcatgacggcggcggaaaatcaagaagcggaacaggcggcttccgaaccggcaaacgaaaaaacagcttccgaaccggctgccgcatcggatgtgaagaccatagaagcaccgtccctgccttcggaacgcaaaccggaacagcctgcaaaaaaacagaccgtaccggaaaaggcagggcgttcgccgtccgctaaaggagaacgcgcatga

SEQ ID NO: 4835 - DNA, 1224 bp, Neisseria meningitidis; identical to SEQ ID NO: 751

SEQ ID NO: 4836 - DNA, 441 bp, Neisseria meningitidis
atggggtcttcagattcctttaaggaaaagaaagaaatatttgaaattggaacgcctgcttatcgccaaaagttaattgatgtttggaaaaagagcattaatggaaacgaaaaatcttgggtgctctttgaaaatgggacttgcgtcattttacttgaaccggaaaaagatttggcgaaacaagctaaagagatgttaagcaaatggggcaaggttcaaataggaacaccatctgcagattttggcattatcactttagatagtggcgatggatatgccgtttcatgccatcatcccgaaatttttacgctaatcctaaaagaagaaggattggatgaagatttcaaaatcggtatcgaagggcgctctcatcgcgattgtgatgctgaagaacccaaagttatccatatcgaagataaacgcaccattgaaaccccatga

SEQ ID NO: 4837 - DNA, 1065 bp, Neisseria meningitidis
atgatctctttgaaaaacgacactttcctccgcgccctgctcaaacaacctgtcgaatacacgccgatttggatgatgcgccaggcggggcgttatctgcccgaatacaaagccacacgcgcgaaagcgggcagcttcctcgatttgtgcaaaaacaccgaattggcgaccgaagttaccatccaacctttggaacgtttcgatttggacgcggcgattttgttttccgacatcctgaccgtccctgacgcaatgggcttgggactgtattttgccgaaggcgaaggcccgaaattcaaacgcgccctgcaacacgaggccgacatcgccaagctgcacgttcccgatatggaaaaactgcaatacgttttcgacgcggtaacttccatccgtaaagcattggacggccgcgtaccgctcatcggcttctccggcagtccgttcacgctcgcctgttatatggtcgaaggcggcggcagcaaagaattccgcaccatcaaaaccatgatgtactcgcgccccgatttgctgcacaaaatcctcgataccaacgcccaagccgttaccgcctacctcaacgcccaaatcgacgcgggcgcgcaggcggtgcagattttcgacacttggggcggcgtgttgagcgatgcggcgtttaaagaattcagcctcaaatacatccgccagatcgtcgccggactcaaacgcgaaagcgaaggccgccgcgtgcctgttatcgtatttgccaaaggcggcgggctgtggctggaaagtatggcccaaatcggcgcagacgcattgggcttggactggacgtgtaacatcggcgaagcacgccgccgcgtcggcaagcaagtcgccctgcaaggcaacttcgacccgttcgccctcttcggtacgccggaatccatccgcaccgaggtcgcacgtatcctagccgactacggacacggcagcggccatgtcttcaacctcggacacggcatcaaccaacacgccgaccccgaacacgccaaaatcttagtcgataccgtacacgagctgtctcggcagtatcacggcgggtaa

SEQ ID NO: 4838 - DNA, 1380 bp, Neisseria meningitidis
atggcaaaaacgcttaaaaccctttaccaatgcaccgaatgcggcggcacttcgccgaaatggcagggcaaatgcccgcattgcggcgagtggaacacgcttcaggaaagccttgccgcgcccgagccgaaaaacgcccgtttccaatcttgggcggcggatacctcgaccgtccaatccctctccgccgttaccgccaccgaagtgccgcgcaatccgaccggtatgggcgaactcgaccgcgtattgggcggcggtttggtcgatggtgcggtcatcctgctcggcggcgaccccggcatcggcaaatccacgctgctgttgcaaaccatcgccaaaatggcgcaaagccgtaaagtgctatacgtttccggcgaagaatccgcccaacaagtcgccctgcgcgcgcagcgtttggaactgccgaccgacggcgtaaaccttcttgccgaaatccgcatggaagcgattcaggcggccttgaaacagcatcagcccgaagttgtcgtcatcgactctatccaaaccatgtattccgaccaaatcacgtccgcccccggctccgtgtcgcaggtgcgcgagtgtgccgcccaactgacgcgcatggcgaaacagatgggcatcgccatgatactggtcggacacgtgaccaaagacggcgcgattgccggcccgcgcgtgctggaacacatggttgataccgtgctgtatttcgagggcgaccaacattccaactaccgcatgatacgcgccatcaaaaaccgcttcggcgcggcaaacgaactgggcgtgttcgcgatgacggaaaacggtttgaaaggtgtgtccaacccgtccgccatcttcctcgccagctaccgcgacgatacgcccggctcgtgcgttttggttacacaggaaggcagccgcccgcttttggtcgaaattcaggcattggtcgatgacgcgcacggcttcacgcccaaacgcctcaccgtcggactggaacaaaaccgtcttgcgatgctgcttgccgtgttaaaccgccacggcggcatcgcctgtttcgatcaggatgtgttcctcaacgccgtcggcggcgtgaaaatcggcgaaccggcggcggatttggcggtcatcctcgcgatgctttccagcttccgcaaccgccctatgcctgaaaaaaccgtggttttcggcgaaatcggcttaagcggcgaagtccgccccgtcgcacgcgggcaagagcggctcaaagaagcggaaaaactcggcttcaaacgcgccatcgtccccaaagccaatatgccgcgcaacgccaaagagtttccgaacctgaaaatctacggcgtttcgagtttgcaggaagccatcgatatttgccgcgacagcagggaataa

SEQ ID NO: 4839 - DNA, 480 bp, Neisseria meningitidis; identical to SEQ ID NO: 357

SEQ ID NO: 4840 - DNA, 360 bp, Neisseria meningitidis; identical to SEQ ID NO: 3617

SEQ ID NO: 4841 - DNA, 3615 bp, Neisseria meningitidis
atgtctgcaagcatccaagcattcgacccgctaaccgtccccatttccggcaccaacctgattgaggcctctgccggcaccggcaaaacctacggcattgccgccctgtttacacgcctgatcgtattagaacaaaaaaacgtcgaacgcgtattggtcgtaaccttcaccaaagccgccaccgccgagctgaaaacacgcctgcgcgggcgtttggacgatgtgttacaagttttagaaagcaaaggaattgccaaacttggagacgacacgctttcagacggcattgccgcctactgcgccgaacaccacgaaggcgacaccttcctgcccgaactcttaaaacaggctttgcaaaaagagggccggacgcgtctgattgtccgcctcaaggccgccatcgggcaattcgacaacgccgccatctataccatccacggcttctgccagcgcatcctgcgcgactacgccttcctgtgccaagcaccgttcgatgtcgaaatgaccgaagaagacggcgaccgcctgcttatcccggcgcaagatttttggcgggaacgcgtcagcaatgatccggtgcttgccgcattggcgcttaaacgcaaagctgtgccgcaaaccgtccttgcccaaatttcgcgctatctttcccgcccgtacctgaatttccgccgtccgcaggcggatttgaaacaggcgcagcgcaacgccgaaacctcatggcaaaccatctgccgcctgctgccagaactggaagccggcttttggcgcattcatcccgacctcaacggcaacagttaccgcaaaaacagcttcggcaacctttttaaagaactggcacaaaaatccgccgccggacaactgccctttctggacaaagacacacacgacagactcttgaaacttgcatccgacaaactcgaagccggactgaaaaaaggcaaaacgcccgatgcggcagtatttgccgaattgcagaaactggcagacttcgggcgcgatttgaacgcactcgaagaagcggaagaagcaacaatgatccggctgcaactggatttaatcgaatacctcaaccgcagccttgccgagatgaaaaaatcgcgccgcgaacgcggtttcgacgacctgctgctcgatgtccacaccgcgctgaccgacaatccgcacgccgacactctcgcccgcgccgttgccgaaaactgggaaaccgcgctgatcgacgagttccaagacaccgacccgctgcaatacgaaatcttccaaaagattttcatcgcccaaaaccgaccgctgttcctcgtcggcgatcccaaacaggcgatttacagctttcgcggagcggacatttacgcctaccttcaggcggcggaagacgcgcggcaccgctacacgctcgccaccaactaccgcagccacgccgcgcttatcggcagcataggcgcgctgttccgcctcaaagaacgcccgttcgttttggaaaacatcggctattcggaagtcggtgcggcgcgtgccgaaagcaggctgtcccccgaacgtcctgccgtacaggttcgttggctgcacgaaaacgacaatgaaaaagccaacaaagacgttttgcgccgccgtgccgccgactattgcgccgacgaaatcgcccacgcgctcaacgaagccgccagaggccgtctgaatttcaaaggctgcccgttgcagtcgggcgatattgccgtgctggtacgcacgcacaacgaggcggtgatggtttccgccgccctgaaaaaacggcaggtgcaaagcgtcctgctttcgcgcgaatctgtgttcgcctcgcccgaagccgccgccctgtccgcactcatcggcttctggctcgaaccgcgccgcgccggaacgctgcgttttgtcctgacaagcagcatattcggttatgacgcgcagcaattgcacgacttcaaccaaaacgaaagcgagattttgcattgggcggaatctgcccgaaccgcactcgacaactggaataaatacggcattttcgccgctatgcagcaattttcccaaacacacggcatcgaaacgcgcctcttaagccggaacaacgggcgcagtctgaccaattatttccaactgctcgaactgcttgccgccgaagacgcgcaaaaccgcaaccccgccgcgctgcacaaatggctgggcgaccaaatcagccttgccgaaaacaacagcggcgacaaccgcgccatccgtctggaaagcgacgaagatttggtcaaaatcgttaccatgcacgcctcgaaaggtttgcagtatccgctggtgtactgcccgtttgcgtgggacgcgcaagataccggaccgtccgactggcaaatcctccaccaaggcgcaaaccgaaccgaactgttggcaaaggcgcaactgtcggaagacgaacagaaacaatacgccgatgaagaaatggcggaacgcctgcgcctgctttatgtcgcgctgacgcgtgccgaggaacagctcaacatctacgccgcgtactccaccaatactgccgacaaccccctcgcctacctgattgaaggctcgccccaagacagccgtgaaaccgtccgccgtgcctatgcgtgtgaaaaagacggcatcgcgatgctcaaacgcaactggcggcgcgtggcggacaacgccccttccggcacaaatttcgccttcaccgaaaatgcgccgccccctgccgcctatcgcagcaacgccggtcaaaccgccgaatttgccgcaaacagcattcccgaacgcggattccgatttgtccgccacactagctttaccgccttaagccgccatacccaaacgcccgacggcggcgaagaagatgcctgcccgtccttggatgccgccgaaacctcggtgccggcgatgccgtctgaaacgccgacggcttcagacggcatatcgatacacgattttccgaaaggcacgcaggcggggctgtgcctgcacgaaattcttgaagatttcaaattcggacaagcagccgccggacaggaaaccctcattgccgacaagctgaaaaaatacggttttgaagaaatatggctgcccgccgttgccgaaatggcggaagcctgccgcaaaacgccgctgacgggggcatacgacctgtccgacatctcacccgagtgccgctgtcccgaaatgggctttaccctccacaccgaagacttcagcctcaaacgcctgcgcgactggtttgcccgcgacgacatcaggctgcccgaagtctgccgtgccgctgccgaaacgctcgacttccacaccgtcaacggctttttaaacggctttgtcgatatggtctgccaagaccccgacggcaatatctgcgtcatcgactacaaatcaaaccacctcggtacggacgcatccgcctacacgcaacaggcaatggacgaagccgtcgcacaccaccactattaccttcaggcactgatttacgccgttgccgccgcacgctacttcaagctgcgcggacaaccgcccgccgccgtttccgtccgctacctgtttttgcgcggattggatggcaaaggcggcggcgtttggcgttgggacatagatgccgccgctttggaacagataaaataa

SEQ ID NO: 4842 - DNA, 909 bp, Neisseria meningitidis
atgaacacgccccaatccgccatcattcccgaccacgcccaagccggcatctttatcgaagccgacttcgccgccaatcgcctcaacgatattaaagccgcctgccgcgcttcgctcgacgcgttaactgccttgaaagcccgctttccggacgatattttgggtctgaccatcgccttcggcagcaaagcctgggcaacattcggacatacggacgaaggcagtgaaatcaaacccttctccgaaatgggcaacgggcttgcgccgtccacgcagcacgatatgtccatccacatccaatccttccgccaaaacgccgcctacgcgcttgcccaatccgttttgggcgcgttcggcgacagcatatgcgtcgcgtccgaagaacacggtttgcgcctgtatcaggatcgcgggctggacggtttcgtcgacggcacggaaaacccgcagggcgatgaaaatgtccgcgaagtcgccatcatccccgaaggaaaacccgatgcgggcggcagctatgtcctgctgcaaaaatacctgcacgatttgaaaaaatgggatgccgtccccgtcgccgaacaggaggcctcggtcggacgcggcaaggaaaccgacgacgaattcggccgcgatgtccgcctgcccgattcgcacctcggccgcgtcaacctgaaagaaaacggagtcggcctgaaaatcgtccgccgcagcctgcccttcggcaaaatcagcggcgaacacggtttgatgtttaccgcatactgccgcacgctgcacaatatcgaagcgcaattattgagtatgttcggcgatacggacggcaaaaccgacctgctgctccgacatctctccgccgccgtttcgggcggatactactacgcgccgtctgtcgaacgcctgcaaaacctctaa

SEQ ID NO: 4843 - DNA, 828 bp, Neisseria meningitidis
atgatgttgaaaaaattcgtactcggcggtattgccgcattggttttggcggcctgcggcggttcggaaggcggcagcggagcatcttccgcgcctgcacaatcggcagtttccggttctttaatcgagcgcatcaacaataaaggcacggttaccgtcggcacggaaggcacttacgcaccgtttacctaccacgacaaggacggcaaactgaccggttacgatgtggaagtaacccgcgccgtggcggaaaaactgggcgtgaaagtcgagtttaaagaaacgcaatgggattcgatgatggcgggtttgaaggcggggcgtttcgacgtggtggcaaaccaagtcggtctgaccagccccgaacgccaagcgacattcgacaaatccgatccttacagctggagcggtgccgtattggttgtccgtaacgacagcaacatcaaatctatagccgacatcaaaggcgtgaaaaccgcacaatccctgaccagcaactacggcgaaaaagccaaagctgcaggcgcagatttggtggctgttgacggtttggcgcaatcgctgaccctgattgaacaaaaacgtgccgatgcaaccctgaacgacgaattggcggttttggactatctgaagaaaaacccgaatgcgggcgtgaaaatcgtttggtccgcacctgccgatgaaaaagtcggttccggcctgattgtcaacaagggcaatgacgaagccgtggcgaaattcagtacggcaatcaacgagctgaaagccgacggtacgctgaaaaaactgggcgaacaattcttcggaaaagacatcagtgttcaataa

SEQ ID NO: 4844 - DNA, 663 bp, Neisseria meningitidis
atgattgtcagcgcgtttttgcctatggtcaaagccggcttcgcggtctctctgcctttggcggcagcttctttcgttatcggtatgatgattgcggtagccgtggctttggtgcggattatgcccgccggcggcatcgtgcggaaaatcctgctgaaattggtggaattttatatttccgtcattcgcggtacgccgctgttggttcagcttgtgattgtgttttacgggctgccttccgtcggcatctatatcgacccgattcctgccgccatcatcggcttttcgctcaatgtcggcgcatacgcttccgaaaccatacgcgcggcaattttgtccgtacctaaaggccaatgggaagcaggtttctccatcggcatgacctatatgcagacgttccgccgcattgtcgcgccgcaggcattccgcgttgccgtgccgcctttgagcaacgagtttatcggtttgtttaaaaacacctcgctcgcggcagtcgtgacggtaacggaattattccgcgtcgcgcaggaaacggcaaaccgcacttatgactttttgcccgtctatatcgaagccgctttggtttactggtgtttttgtaaagtgctgttcctgattcaggcgcgtttggaaaaacgtttcgaccgctacgtcgccaaataa

SEQ ID NO: 4845 - DNA, 756 bp, Neisseria meningitidis; identical to SEQ ID NO: 1435

SEQ ID NO: 4846 - DNA, 1383 bp, Neisseria meningitidis
atggcaagcatcgcccgcgacatcttcaaagcctacgacatccggggtattgtcggcaaaaccctgaccgacgaagccgcctaccttatcggcaaagccatcgccgccaaagccgccgaaaaaggcattacccgcatcgcgctcggacgcgacggacgcttgagcggtcccgaactgatggaacacatccggcgcggctttaccgacagcggcatcaatgtcctcaatgtcggtatggttgccactcctatgctctacttcgccgccgtcaacgaatgcggcggcagcggcgtgatgattaccggcagccacaatccgcccgattacaacggctttaaaatgatgctcggcggcgacacgcttgccggcgaagccatccaagaacttttgtccatcattgaaaaagacggttttgctgccgccggcaaacaaggcagcgtcaccgaaaaagacatctccggcgaatacctcaaacacattaccggacacatcaggctcaaacgcccgatgaacatcgccattgacgcgggcaacggcgtgggcggcgcgtttgccggcaaactctacaaaggcttgggcaacaaagtaaccgagcttttctgcgacgtggacggcactttccccaaccaccatcccgacccatccaaaccgaaaaacctgcaagatttgattgccgcgctgaaaaacggtgatgccgaaatcggcttggcgtttgacggcgatgccgaccgcttgggtgtggttaccaaagacggcaacattatttatcccgaccgccaactgatgctgttcgcccaagacgttttgaaccgcaatcccggcgcgaaagtcattttcgacgtgaagtccacccgcctgcttgcgccttggattaaagaacacggcggcaaagccataatggaaaaaaccggccacagctttatcaaatccgccatgaaagaaaccggcgcgccggttgccggcgaaatgagcggacacatcttcttcaaagaacgctggttcggcttcgacgacggtctgtacgccggcgcacgcctcttggaaatcctgtctgcctccgataatccgtccgaagtgttaaacaacctgccgcaaagcatttccacgcccgaactcaacatcgccctgcccgaaggcagcaacggccatcaggttatcgacgaactcgccgccaaagccgaatttgaaggcgcaaccgaaatcatcaccatcgacggtctgcgcgttgaatttcccgacggcttcggtctgatgcgtgcttccaataccacgccgattctggtgttgcgttttgaggcggatacgcaagaagccatcgagcggattcaaaaccaattcaaagccgtcatcgaaagcaatccgaatctaatctggcctctgtaa

SEQ ID NO: 4847 - DNA, 510 bp, Neisseria meningitidis
atgattatcctgcacaccaacaaaggcgacatcaaaatcgaactcgatttcgacaaagcccctgttaccgccaaaaacttcgagcaatacgtcaaagacggcttctacgacggcgtaatcttccaccgcgtcatcaaaggcttcatgattcaaggcggcggcatggatgaaaacatgaacgaaaaagaaacccgcgatccgattcaaaacgaagcgtccaacggcctgcccaacgataaatacaccatcgccatggcacgcacttccgacccccattccgccagcgcgcaattcttcatcaacactgccgacaacgctttcctgaacttccgttctaaagagctgtacggcaaaaccgtcgtccaagactggggctatgccgtattcggtaaagtcgttgacggttttgacgttgtcgatgccatcgaaggcgtttctaccaaacgtcatggttaccacgacgacgtaccgagcgaacctgtcgtcatcattaaagccgaagcggtataa

SEQ ID NO: 4848 - DNA, 1416 bp, Neisseria meningitidis
atgaacctgcatgcaaaggacaaaacccagcatcccgaaaacgtcgagctgctcagtgcgcagaagccgattaccgactttaagggcctgctgaccaccattatttccgccgtcgtctgtttcggcatttaccacatcctgccttacagccccgatgccaataaaggtatcgcgctgctgattttcgttgccgcactttggtttaccgaggccgtccacattaccgtaaccgcactgatggtgccgattctcgccgtcgtactcggtttccccgacatggacatcaaaaaggcgatggctgatttttccaacccgattatctacatttttttcggcggcttcgcgcttgccaccgccctgcatatgcagcggctggaccgtaaaatcgccgtcagcctgttgcgcctgtcgcgcggcaatatgaaagtggcggttttgatgttgttcctcgttaccgcctttctgtccatgtggatcagcaacaccgccaccgccgcgatgatgctgcctctagcaatgggtatgctgagccacctcgaccaggaaaaagaacacaaaacctacgtcttcctcctgctcggcatcgcctattgcgccagcatcggcggcttgggcacgctcgtcggctcgccgcccaacctgattgccgccaaagccctaaatctggacttcgtcggctggatgaagctcggcctgccgatgatgctgttgattctgcccttgatgctgctctccctgtacgtcatcctcaaacctaatttgaacgaacgcgtggaaatcaaagccgaatccatcccttggacgctgcaccgcgtgatcgcgctgttgattttccttgccacagccgccgcgtggatattcagctccaaaatcaaaaccgccttcggcatttccaatcccgacaccgttatcgccctgagtgccgccgtcgccgtcgtcgtcttcggcgtggcgcaatggaaggaagtcgcccgcaataccgactggggcgtgttgatgctcttcggcggcggcatcagcctgagcacgctgttgaaaacatccggcgcgtccgaagccttgggacagcaggttgccgccaccttttccggcgcgcccgcatttttggtgatactcatcgtcgccgccttcattatttttctgaccgagttcaccagcaacaccgcctccgccgcattgcttgtaccgattttctccggcatcgctatgcagatggggctgcccgaacaagtcttggtattcgtcatcggcatcggcgcatcttgtgccttcatgctgccggttgccacaccgcctaacgcgattgtgttcggcacgggcttaatcaagcaacgcgaaatgatgaatgtcggcatactgctgaacatcctctgcgtagtattggttgctctgtgggcttatgctgtactgatgtaa

SEQ ID NO: 4849 - DNA, 210 bp, Neisseria meningitidis
atgcacctcttcccgatatatcctatttttccccttacatatcaatcccatctcataaacaaaaccgacaaatcgtttacaatatatttacactacatcagattacaaatatactcgaaccagttgcagaagcggcgattccacaaaccgtttcggattgcacgacacaaaagaaaaaccgattttgttgccttaaaggagtattcatga

SEQ ID NO: 4850 - DNA, 363 bp, Neisseria meningitidis
atgaatctgccacgcaaccgctttatcctgctctcggcattgtggtttgcaggcagcatttactcactgcttttcaaagctgccgaaaccgcgccaccgccttttccgcattttgacaaagtggcgcacctcgccctgtttttcgcacaaatctggcttctgaccaaagcattcagaaccgacaaccgccccatcccctatcgcagcctgatggtctttgccctctgtttcgccctcttcagcgaatgcgcgcaggcatggtttaccgcaacgagaaccggcagtttgggcgatgtccttgccgacctgacgggcgcagcccttgccctctttaccgcgcgagctgcctgccgcccggactaa

SEQ ID NO: 4851 - DNA, 579 bp, Neisseria meningitidis
atgtcaaacacaatcaaaatggttgtcggcttgggcaacccgggcaaagaatacgaacagacacgccacaatgcgggtttttggttcctcgacgaactggcgtggaaatggaaggcttcatttaaagaagaaaaaaaattcttcggcgaagtcgcccgtgccgccctgcccgacggcgacgtttggctgctcaaacctgccacgttcatgaaccgttccggacaggcagttgccgcgcttgcacagttctacaaaatcaaacccgaagaaatcctcgtcgtccacgacgaactcgacattccctgcggacggatcaaattcaaactcggcggcggcaacggcggacacaacggcttgaaagacattcaggcaaaactcggcacggcagactattaccgcctgcgcctcggcatcggccacccgggcgaccgcaacctcgtcgtcggctatgtcctgaacaaacccagtacggaacaccgccgacagattgacgatgccgtcgccaaatccctgcaagccatacccgacatccttgccggcaaatgggaagaagcaacccgcttcctgcacagcaaatga

SEQ ID NO: 4852 - DNA, 279 bp, Neisseria meningitidis
atgcttgaaattgagattgtgtacgggctgcccgaccgacaggttttgaaaaccatgcagcttgccgagggaacaaccgtccgcgccgccgcactgcaaagcggtttggacggcatatttgaagatttaaacctgcattccgcgcctttgggcattttcggcaaagccgtcaaagacgacacgccgctgcgcgacggcgaccgcatcgaagtgtaccgcccgctgttgatcgaccccaaagaagcgcgccgcaaacgcgttcaaaatcaagaagaataa

SEQ ID NO: 4853 - DNA, 438 bp, Neisseria meningitidis
atgcccgtgaaaaaagttgaaaaaaacatcttggtgctgcacggcgcggacaaaatgttcgagctggtcgacaaggttgaagactatccgcactttctgccgtggtacagcaagaccgaagtcatcgggcgtagcggcaacgaactgaaggcgcggctgtttatggattatatgcacgttcgccaatcgtttgccacgcacaaccgcaacattccgggcagggaaatccgtatggaactgctcgagggtccgttcaaaaccttacgtggaacgtggaaatttatcgatttgggcgacgatatgtgcaaaatcgaattcaatttggaatacgatttttccaatgccgttttgtccgccttaatttcccccgtcttcaaccacctttccaccacgctggtcgaagcgttcgtcaaagaggcagaccgccgttatgcttga

SEQ ID NO: 4854 - DNA, 1968 bp, Neisseria meningitidis
gtggggaacacctttaaatcaatccttgtctgggtcgccttgggtatcggcctgatggctgcgttcaacgctttagacggtaaaaaagaagacaacgggcaaatcgaatactctcagttcatccaacaggtcaacaacggcgaagtatccggcgtcaacatcgaaggatccgtcgtcagcggctacctgattaagggcgagcgcaccgacaaaagcactttcttcaccaacgcgcctttggacgacaacctaattaaaacactgctcgacaaaaacgtccgcgtaaaagtaacgccggaagaaaaaccgagcgcgctggctgccctgttttacagcctgctgcccgtcctgctgctgattggcgcatggttctacttcatgcgtatgcagacgggcggcggcggaaaaggcggcgcattctcattcggtaaaagccgcgcccgcctgctggacaaagatgccaacaaagtgacctttgccgatgtcgccggctgcgacgaagccaaagaagaagtacaggaaatcgtcgattacctcaaagcgccgaaccgctatcaaagcctgggcgggcgcgtgccgcgcggcatcctgctggcgggcagcccgggtacgggtaagacgcttttggcgaaagcgattgcaggcgaagccggcgtgccgttcttcagcatttcaggttccgactttgtcgaaatgttcgtcggtgtcggtgcgagccgcgtccgcgatatgttcgagcaggcgaagaaaaacgccccctgcatcatctttatcgacgagattgacgcagtcggccgccaacgcggcgcaggtttgggcggcggcaatgatgagcgcgagcaaacattaaaccaattgttggttgaaatggacggttttgagagcaatcagactgtaattgtgattgcggcaaccaaccgccccgacgtactcgatcctgcgctgcaacgccccggccgtttcgaccgccaagtggttgtccccctgccggacatccgagggcgcgaacagattttgaacgtccattctaaaaaagtgcctttggacgaatctgtggatttattgtccctcgcgcgcggcacgccgggtttttccggcgcggatttggcgaacttggtcaacgaagccgccctgtttgccggccgccgcaataaagtcaaagtcgatcagagcgattttgaagacgccaaagacaaaatctatatgggtccggaacgccgcagtatggtgatgcacgaagacgaaaaacgtgcgacggcgtatcacgaatccggacacgcgattgttgccgaaagcctgccctttaccgaccccgtccacaaagtaaccattatgccgcgcggacgtgcgctgggtctgacttggcagcttccggagcgcgaccgcatcagtatgtataaagatcagatgttgagccagctctccatcctgttcggcggacggattgccgaagacatcttcgtcggacgcatctccaccggcgcatcaaacgactttgaacgcgcaacccaaatggcgcgcgaaatggtaacgcgctacggcatgagcgacaaaatgggcgtgatggtttatgcggaaaacgaaggcgaagtcttcttgggacgcagcgtaacccgttcgcaaaacatttccgagaaaacccagcaggacatcgacgcggaaatccgccggattttggacgagcaatatcaggttgcctacaaaatcctcgatgaaaaccgcgacaagatggaaacgatgtgcaaagccctgatggaatgggaaaccatcgaccgcgatcaggtactggaaatcatggcgggcaaacaacccagcccgcccaaagattacagccacaacctgcgcgagaatgcggacgcggcggaagataacgcgccgcacgctccgactcgggaagaaaccgaagcacctgccccggcagacaccgcttcgacagagtccgagcagcagcctgaaaacaaggcttaa

SEQ ID NO: 4855 - DNA, 621 bp, Neisseria meningitidis
atggctgtacgttccaaatcctcaaaagcgtggctgcacgaacacgtcaacgaccactacgtccatatggcgcaaaaagacggctaccgcgcccgtgccgcatacaaacttttggaaatcaacgaaaaagacaaattaatcaaacccggcacggtacttgccgacttgggcagcgcgccgggaagctggtcgcaggttgccgccaagctgacgggtacttccggagcagttttcgccttggacatcctgcctatggaagccatagggggcgtctccttcattcagggcgacttccgcgagaacgacgtactggcacaattcgaaaccttgttggacaaccgcccgctcgaccttgtaatttgcgatatggcgcccaatatgtcgggaaacgccgtaagcgatcaggcacgcagcttttatctgtgcgaactggctttagacttcgcctcgcaacacctgaaaaccggcggcagctttttggtcaaagtctttcagggtgcaggctatcaggaatacatggcagccatgcgcgaaattttcggcacggtgcagacgcgcaaacccgaagcctcgcgcaatcgctccagtgagatttatttattgggcaaaaataaacgctga

SEQ ID NO: 4856 - DNA, 285 bp, Neisseria meningitidis
atgacggataccaaattgaacaccaaagaaattttggaactgaaagcgcgcgcgcaccatctccatcctgttgtgatggtcggtcagcagggtctgacggacgcggtcatcaaggaaaccgatgcggcattgacggcgcatgagctgattaaagtgcgcgtattcggcgacgaccgtgccgaacgtatcgaaatctgcactgccttatgtgaggcggttgatgcgcaactggttcagcatatcggaaaacttttggtattgtggcgtaagaatatcgaagcctga

SEQ ID NO: 4857 - DNA, 1002 bp, Neisseria meningitidis
atgcagtttccttaccgcaatgttccggcttcgcgtatgcgccgtatgcgcagggacgatttttcacgccgcctgatgcgcgaacacacgctgaccgccgatgatttgatttatccggtgttcgtattggaggggtcggcgcgcgaggaggatgtgccttctatgccgggtgtgaagcgtcaaagtttggacaggctgctgtttacggcggaagaggcggtaaagctcggtattccgatgttggcactgttccccgtggttacggcaaacaaaaccgagcgtgcgcaggaggcgtacaatcccgaaggactcgtgccgtcaactgtccgcgccttgcgcgagaggtttcccgaactgggcattatgacggatgtcgcgctcgatccttatacggttcacggtcaggacgggctgacggacgaaaacggttatgtgatgaacgatgaaaccgtagaggttttggtcaagcaggctttgtgccacgctgaagcgggcgcgcaggtggttgccccttccgatatgatggacgggcgtatcggtgcgattcgcgaggcgttggaggatgccgggcatatccatacgcggattatggcgtattccgccaaatatgcttctgcattttacggccctttccgtgatgcggtaggcagttcgggcaatttgggcaaggcagataaaaagacctaccagatggatccggcaaataccgatgaggcgttgcacgaagtggcgttggacattcaggaaggtgcggatatggtaatggtcaagcccggtttgccgtatttggacgttgtccgccgcgtaaaggacgagttcggtgtgccgacttatgcctatcaggtttcgggagaatacgcgatgttgcaggcagcgattgccaacggctggctggacggcggcaaagtggttttggaaagcctgctggcattcaaacgtgcgggtgcggacgggattttgacctattacgctattgaggcggcaaagatgttgaagcgttga

SEQ ID NO: 4858 - DNA, 1158 bp, Neisseria meningitidis
atgaaattcgccacgaaagccattcattccagctacgattgcgacgaacacaaccgcgcgctgatgccgccgatttatcaaaacagtatgtttgcgttgcacgagattggcgaaaatgtgccttaccgttattcgcgcctgagcaacccgacccgtcagattttagaagacaccgttgccgatttggaacacggtgcggcaggttttgcgttttccagcggtatggcgggaattgatgccgtatggcgcactttcctgcgcccgggcgataccattgtcgccgtcgccgatatttacggcggcgcttatgatttattggtcgatgtttatcaaaaatggggggtgaacgttgtttttgccgatttaggcaatccggataatttggacgaactgcttaaagcgcacaaggtcaaactggtttggctggaaacgccgtccaatccacttttacgcttggtagacatcaaagtccttgccgcaaaagccaaagcagccggtgcgctggtcggtatcgacaacacttttgccacgccgtatctgcaacagccgttggatatgggttgcgattttgtattccattccgctaccaaatatttgtgcggccattccgacgtgttgatgggcatcgtcgttgccaaaaccaaagaactggcgcagcctttgcacgatatgatggtgcataccggcgcggttgccggcccgctggactgctggctggtgttgcgcggcatcaaaacactggctctgcgcatgaacgcccattgccaaaacgcactcgaaatcgcgcgccgtttggaagcccatcctgccattgaaaaagtgttccatcccggcctgccgtctcacgaacattacgaactggcgaaaacacaaatgcccaaaggcatcggcggcgtggttacggtttatctcaaaaacgacacgcgtgaagcggcaaacagcgtgattaaaaacatgaaactggtcaaaatggcttccagcctcggcggtgtggaaagtttggtcaaccattgctattcccagtcccacagcggcgtaccgcatgatgtgaaaatggaaatgggcatcaaagtcggtctgctgcgtttctccatcggcatcgaagacgcggacgatatttggaacgatatttccgccgcactcgatacaactttgtaa

SEQ ID NO: 4859 - DNA, 774 bp, Neisseria meningitidis
atgaacactattgcagacgtgcaatccagccgagatttgcgcaatctgccgatcaatcaggtcggtatcaaagacctgcgctttccgattaccctgcaaactgcagaaggcatccagtccaccattgcccgtctgaccatgacggtttacctgcctgctgagcagaaggggacgcatatgtcgcgttttgtcgcattgatggagcaacatgccgaagccttggattttgcacaattgcgcaagctgactaccgaaatggtcgcgcttttagattcccgcgccggcaaaatcagcgtttctttcccatttttccgcaagaaaaccgccccggtttccggtattcggtccttactggattatgatgtctgtctcacgggcgaaatcaaagacggggcatacggccacagtatgaaggtcatgattcccgtaacctcgctttgcccgtgttccaaagaaatttcccaatacggcgcgcacaaccagcgttcgcacgttaccgtcagcctgactgccgatgccgaagtcggtatcgaggaagtcatcgattatgtggaggcgcaggcgagctgccaactctacggcctgctcaaacgccccgatgaaaaatacgttaccgaaaaagcctacgaaaacccgaaattcgtggaagatatggtgcgcgatgtcgctacttcgctgattgccgacaaacgcatcaagagtttcgtcgtcgagagcgagaatttcgagtctatccacaaccattcggcttatgcctatatcgcctacccgtag

SEQ ID NO: 4860 - DNA, 666 bp, Neisseria meningitidis
atgacagtattaagcaaagagcaggttctatccgcatttaaaaaccgtaaatcatgccggcattacgatgcggcacgcaaaatcagtgccgaggattttcagtttattttagaactcgggcgtttgtcgcccagttcggtcggttcggagccttggcagtttattgtggttcaaaaccctgaaatccgacaggcaatcaagccgttttcttggggtatggcggatgctttggataccgccagtcatttggtggtgtttttggcgaagaaaaatgcccgctccgacagcccgtttatgttggaaagcctcaaacggcgcggcgttaccgaaccggatgccgtagcaaaatctttggcaaggtatcaggcgtttcaagctgacgacatcaagattttggacgattctcgcgccttgtttgactggtgttgccgtcagacctatatcgcgttagccaacatgatgacgggtgcggcgatggcaggtatcgattcctgcccggtggaaggtttcaactatgccgagatggagcgcatattgtccgggcagtttggtttgttcgatgcggcagaatggggcgtgtccgtcgccgcgacattcggctaccgcgttcaggaaatcgccacgaaagcgcgtaggcccttggaagaaaccgttatttgggcataa

SEQ ID NO: 4861 - DNA, 966 bp, Neisseria meningitidis
atgagccacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 4862 - DNA, 759 bp, Neisseria meningitidis
atgaatcccaaaatttcctccgaccatacagaagatgccgtgcgcctctccaaacgcatggcgcaactggggctttgttcacgccgcgaagccgacggctatatcgaacagggttgggtaacggtcaacggcaaaaccgccgtactcggtcagaaagtttcaccggcagaccgtatcgaactgaacaagaaagcccacgaacagcaggcggcacgcattaccatcctgttgaacaaacccgtcggctatgtcagcgcacaagcggaaaaaggctataaatccgccgccgaactgattacccctgaaaatcactgggaaggcgataccggccgcatccgtttcgatccgaaacacaaaatcggcctcgcccccgccggcaggctggacatcgactcggtcggattgctggtattgactcaggacggccgtatcgccaagcagcttatcggcgaaaacagcggcagtgaaaaagaatatttggtgcgcgtgcgcggcaaattggacgaaaaaggacttgccttactgaatcacggattgagtttggacggcgagaaactgcgtcccgcccaagtagaatggcaaaacgaagaccaactgcgcttcgtgttgaaacagggtaaaaagcggcaaatccgccgtatgtgcgaactggtcggactgcgcgtcgtcgggctgaaacgcatccgcatgggcaaggtcaaactcggcaggctgccgcccggcaaatggcgttatctcgctcccggcgaatcgttttaa

SEQ ID NO: 4863 - DNA, 891 bp, Neisseria meningitidis
atgaacagcccttttcacaacatcggcatcgtaacccgccccaacacgcccgacatccaagacaccgcacacacgctgattacctttttgaagcagcacggctttaccgtctatctcgacgaagtcggcataaaggaaggctgcatctatacccaagacaccgtcggctgccatatcgtcaacaagaccgaactggggcaatactgcgacctggtcgccgttttaggcggagacggcacctttctctccgtcgcccgcgaaatcgccctgcgcgccgttccgattatcggcatcaaccaagggcatttgggcttcctgacccaaattccccgcgaatatatgacggacaagctattgcccgttttagaagggaaataccttgccgaagagcgcatcctgattgaggccgcactcatccgcgaaggcaaaaccgccgaacgcgccatcgccctcaacgatgccgtcctctcccgtggcggtgccggacagatgattgagtttgaagtcttcgtcaatcgggaattcgtctatacccagcgttcggacgggctgattgtctccacccccaccggatcgaccgcctattcgcttgccgccggcggccccatcatgcaggcaggattacacgccttcacgctcgtccccatctgcccacaatccatgaccaaccgccccatcgccattccagacacgtccgaaatcgaaatcctcgttacccaaggcggcgacgcgcgcgtccatttcgacggtcaaacccatatcgacgtgcaaaacctcgaccgcatcaccatccgccgctaccgaaatcccttacgcattttgcacccgaccgactaccaatatttcaaaaccctgcgccaaaaactgcactggggcgagcaattagtctaa

SEQ ID NO: 4864 - DNA, 567 bp, Neisseria meningitidis; identical to SEQ ID NO: 2909

SEQ ID NO: 4865 - DNA, 798 bp, Neisseria meningitidis
atgcgcgcagtccccccgccccatatctccatcacaggcctaggttacctcggcctgccgctggcacaaaagttttaccaacacggcagccgcgttgccgccgtcaaacgcagcctgacttcggacgatatcaatctgcccatacacctcgataccatcgacctcaatcaagacagcgcgtttcaaagcgcgaaccttgcccgagatacaagcttttggcggcaccatgccaacaaacccgtttggttctgcctcttgccgccatcatcgctgacacattacgccgataccgtcaaacaatgggcagaacttgcccgggcgtgcaacgtgcaacacctgattttcacaagcagtaccagcgtttacggcgatacagcgcgcgaatgcgacgaaatcgccctacccgatccgcaaaccgagtccgcccgccaaatcctcgccgccgaacaacacctgctcgacagcggcgttccgaacatcgacatcctgcggctgggcgggctttattgcgccgaacgccatcccgtcggccgccttgttcaaaagcaaaacatcccgggcggcaaccgccccatcaacatcgtccaccgtaatatcgccgtcgaaagcctgtttcagacggcatttaaccccggcggcaggcggctgaaaaacattatcgaaccgcgccacccgacacgacgcgaattctatacggaagaagccgccaaactcggcttgcccgcgccggattttgcacccgacgacagcgtgggcaaaatcatccgtaccgtttgcgataacggcttaagcctgtaa

SEQ ID NO: 4866 - DNA, 651 bp, Neisseria meningitidis
atgcccgtgacccgccccgccaaaatcaatacttacacacgcatcatcgacgccagccttgcgcttttcaacgaggaaggcgagcgcaacatcagcaccaaccatattgccgcccacttgggcatcagtccgggcaacctctattaccacttccgcaacaaagacgaaatcatcgtccaactgttcaaacgttacagcgaagccctgctggcatacctgaatgaagccgtgttgccgtctgatgtggaagactccatcaattatatggccggtatttatgatgtgatgtgggaataccgcttcctattcagcgacgtgaacaccctgcttgcacgcagtgccgaattgttgggcgaacacaataccttcacccaagccaaagtctccccgctcttggtcaacctgctcacccaactcaacggtctgaacatcatccaagccgaccaaaccgccatgaacgatctcgccgtcaatatgtggatggtcacgaaatactggttcgacttcgacagctccctgcgcggccgcaccaagctgaccgaagactccaaagcacgcggcatccgccgcaccttaagcctccttcgtccttatcttttgcccgaacaccgcaagaaatacgaccggaaaatcggcaacggcaacccgtaa

SEQ ID NO: 4867 - DNA, 1041 bp, Neisseria meningitidis
atgcaacccatccgataccgaaccgaccttaccccctacaacaccttcggtcttcgcgcccaagcccgggcctttatcgcgctcgaacatgccgacgagttgcgcgacatcgtccgactgctggagttcgaccgcgatactgttttatggctgggcggcggcagcaacatccttttgatgcaggattacgccggactggtcgtacacatggaaaacaaaggcatacgcgagattgcgcgttcagacggcatggttctgattgaagcgcaggcgggcgaaatttggcacgattttgtcctgcacaccgttgcgctgggtttgagcggtttggaaaacctgagcctgattccgggtacggtcggcgcatcgcccgtgcagaacatcggcgcatacggcgtggaggcgaaagacgtgattcacagcgtgcgctgctttgatttggatacggagacctttgtcgagcttgccaatgccgactgccgcttcgcctaccgcgaaagcctgttcaagcaggagggtaaagggcgttatgtgattgtttcggtcgtatttgcattaaaaacgcattttgtgccgactttgggttacggcgatttggcggccgccgttgccgaactgagcgcgggcagggtcccgacggcgaaagatgtttccgatgcagtgtgtgcaatccgcaacagtaaacttcctaatcctaacgtgcttggcaatgtcggcagtttctttaaaaaccccgtcgtcagcgcagaaaaagccgccaccttgttgcagcggcatcctgatatgccgcgctatccgcagcccgacggttcggtcaaactcgccgccggctggctgatcgaccaatgccgtctgaaaggcttccaaatcggcggcgcggcggtacatgacaggcaggctttggtcttagtgaacaaaaacaacgcctcggcaaacgatgtccggcagttggcgcaacacatcaaatttacagtatttgctcggtttcaggtagaattgcacgccgaacctaattggctgcctgcttcgttcagcctgtaa

SEQ ID NO: 4868 - DNA, 1380 bp, Neisseria meningitidis; identical to SEQ ID NO: 2903

SEQ ID NO: 4869 - DNA, 189 bp, Neisseria meningitidis
atgagaaataatggtgcacattatatcgtaaaaaaatgccgtgccgtcagacggcggatacagggtataaaagtatattcagattgtgtgtattttatggtaaagtttggttttaacgacttgacggcattgagccgtcggacaggggctgttcggattctgaatcggaaagaagcaccgccgttttga

SEQ ID NO: 4870 - DNA, 1152 bp, Neisseria meningitidis
atgcagacatggcagcttccggaacatatcgccgacgtactgcccacgaacgcgcggcagcttgaaagcgcgagggagcagttgttggcactgttccgcgtacacggttatgaactggtacagcctccgctgatggagtacgcacattccctgctgacgcatatcgatgcggggctttccctgaaaaccattttggtaacggacaggctcagcggcaggcagttgggcatacgcgccgacatcacgccgcaggtggcgcgtatcgatgcccatcttttatccgccaaccaagggattaaccggttgtgttatgccggtccggtgttgcacgcgcagcccgacggtctgctgaatatgcgcgaacccttgcaggcaggggcagaaatgtacggttttgctgacatccgtggcgacatcgagctgatagacctgatgctgaaaagcatgaaaattgccgatatgggcaaagtgctgctttcgctggggcatatcggcatatttcgcgccttgtccgatgcggcacatttggatgcggggcagtccgcaacgctgcttgccttgatgcaggataaagataccggggcggtcgaagcgcaggtcaaggcttggaagctggacggcatgtgggcaaaagcattctcgctgttgccgcgcctgtacggcgggcgtgaagtgttgtccgacgcgcgcggacggttgccggatttgtcggcggtcggcggcgcgttgggcgaattgcaggcggtgtgcgacgcattccccgattgtgaaatccatatcgacttgtccgagctgcgtgtcgacaattaccacacgggcttgctgtatgccgcctatgccgccgatttccacgacgcggtcgcgcgcggcgggcgttatgacggattgggcggatatttcggtagggcgcgcccggcaacgggattcagtttcgacttgcgcagctttatcgggcgtttgcccgccatcgaacggcagcccgccgtgttggtcgatgcggaagatgccgaagcggcgcacgaagcggtcgaagccttgcgtgaacaagggcagtgtgtcgtaatcgattacggtatcggacacaatgtttcggaagagcttgcaggccgtctgaaaaagacggacggcgtttggcaggtcgtgaaacgctaa

SEQ ID NO: 4871 - DNA, 1305 bp, Neisseria meningitidis
atggctatggctaaaaatgttgtagtaatcggcgcacagtggggcgacgagggtaaaggtaaaatcgttgactggctggcggaagaagccggcggcgtggtgcgcttccaaggcggccacaatgcgggccataccttggttgtcggcggcaaaaaaaccattttgcgcctgattccgagcggcatcctgcatgaaagtttggactgcttcatcggttcgggcgttgtcgtctcccccgaagccctgttgggcgaaatcgacgagttgaacgcggcaggcgtgaaaaacgtcgaaggccgtctgaaaatcgcgccgacctgcccgctgatcctgccttaccacatcgcgctcgaccaagcccgcgaagcatcgcgcggcaaaggcaaaatcggcacgaccggccgcggcatcggccctgcctacgaagacaaagtggcacgccgcgccattcgcgccgccgatttgctgcatcctgaaaaactgcgtgaaaaactggatgccgtccttgcctattacaatgtccaactgcaacatctgcacaatgccgagccggttaaagcggaagacgtgatggcggttatcgaaaaagtcgcgccgcgcattgcgccgatgattaccgacgtgtcccgcgtgttgaacgagaaaaacaaaaacggcgaaaaactgctgtttgaaggcgcgcaaggtgcgttgttggacatcgactacggcacttatcccttcgttacctcgtccaactgtctggcgggcgcagcttcggcaggcgcgggcgtaggtcctcaaatgctggattatgttttgggcatcgtcaaagcctataccacgcgcgtcggttcgggcccgttcccgaccgaattgttcgacgaagtaggcgtaggtttggcagaacgcggacacgaattcggttcggtaaccggacgcgcacgccgctgcggctggtttgatgccgccgccctgaaacgctccatccaaatcaacggcatttccggtatgtgtattactaaactcgatgtaatggacggcgttgaaaccatcaatatctgcgtcggctatgaattgcccgacggcggcaaaaccgacatcctgccttgcggttccgatgcggtggaaacctgcaagccgatttacgaaaccatgcccggctggcgcgaatccactttcggcgtgaaggactacggcgcattgcccgaaaacgccaaagcatatttgaaacggattgaagaagtctgcggcgcgccggtcgccatcgtctccaccggccccgaccgagaagaaacgattgtgctgcatcatccgttcgcataa

SEQ ID NO: 4872 - DNA, 315 bp, Neisseria meningitidis
atgtgtgtactattgcataggcggttaagccatgcaggagatgaaagtgtatatgtcgcgcaaagcccattagccgcaagcgaggggcggggtgcgcgagagagaggggggcaggtgctaagtcattggttatctccttactatctatctaactacgggtgcattatgcgcctatgcctgttttttgtcaaacactatacagttaaaatgtgtaaatatttagtaaggacatatacccttttctttacatttagctccatcggataccagtgcgttcagagaaaatttgaaaatttctatattttggttgtataa

SEQ ID NO: 4873 - DNA, 384 bp, Neisseria meningitidis
atgccaaaatcactctcgctacaagatgttcagttaaggttttccagtaaatttcctgataagacggttttgaagttcactaaaaactacgaaccggtaacaatccaatgccctttgcatgggtcggttgtttacgggaatctacaagctgccatgaaatcctcaacaggatgtcctgaatgtactcgaaatcccgaaaagccctctccaaacgccgttgccattaggttggaggacacagagacaggggaaatctacgagtttgcaagtacactggctgccagtaaatttatcggttgctccaacagcactttagctgtacgtttaagcggacgcactccgtttgaccgattgattaggtatcgttataggttggtaaagtaa

SEQ ID NO: 4874 - DNA, 411 bp, Neisseria meningitidis
atggcacttacatttactcaagcagtttctaagctaacctctaaatttccacatttgaatcttgtggagttcaatggcgttcgttacccgacggtaatcgtctgtcctatacacgggagggttacttgctctacattcaaaagtatgttggactctaaaagtgggtgtccaaaatgtgcatcttatggtgtcaattcccacaaaattccagaagatacaatagataaattatctaaaaatacagtattggaggatactgtaactggcgaaacacttacattcccctcaagagcatctgctgcaaggtcattgggtataaacccagcagctatcactgaccgtataaaaggtcgggttcacacagagactttacttgcagggaggtataaggttcacatctgcactaaatga

SEQ ID NO: 4875 - DNA, 393 bp, Neisseria meningitidis
atggccaaatctttcaaccaagcagcttctgaacttactgatatattccctaatatctctctaaccggctttgacggtgtgaattacccagtaaccgttaattgtcctatgcacgggaacgttcgttattcgacatttaatgcccttataaagtcaaagtacgggtgtcctgagtgtgctaagatgtcaaaaacccaaacacctccaaatgtagggaagcccctcctcatcctcgacacaacgaccaacgaaacactcacgttcccaagcgttactgccgcaggtgctgctttaggtgtacatttccaacaaatcaatcacaggctcaagggtcgaacgtcgcccgacaaccttatttcaaacaggtacaaagtgcttgggtacgataggtaa

SEQ ID NO: 4876 - DNA, 393 bp, Neisseria meningitidis
atgggtaagcgaatgactttcgataccgccaaatcacgctttcaagagaaatttccacatttagaattgttggagttcagtggcatttataaaccttccagtgttagatgtcctacgcacggggttgtccaacttttgtattacgacacagctataaagtcaaagtatgggtgtccggagtgcgggaaacttaaaatgaaggaaaatacgcctccccaaaaccaaaaacctgtctccatcctcgacaccgccacaggcgaaacactcacgttccccagcgtacaagctgccgccaaagccctaaacaccccctacggctctatacgaaccaagctcgacggacgttcaaatcccgacaaccttgtctgtaacaggtataaggttctgctataa

SEQ ID NO: 4877 - DNA, 561 bp, Neisseria meningitidis; identical to SEQ ID NO: 3573

SEQ ID NO: 4878 - DNA, 1044 bp, Neisseria meningitidis
ttgaaatgtgtttattggaatcaaacagatggtttacgattctacacggcttggcacaatagttcaaaaaccaactgcacaaactgccatttgcaagcaaatgttttgcatacctttgccgagtctgatattcacaagccggcaactttttgggacaatcccccaaaatttcaaaacatcacaccctaccaaaaaggaacatccgtgaaacgaatttttctgtttttggctaccaatatcgctgttttggtcgtaatcaacattgttttggcggttttgggcatcaacagccggggcggcacgggcagcctgttggcgtattccgccgtcgtcggcttcactggttcgattatttcgctgctgatgtccaaatttatcgccaaacaatcggtcggcgcggaagttatcgacacgccgcgcaccgaagaagaagcctggcttttgaacactgtcgaagcccaagcgcggcaatggaacctgaaaacgcccgaagtcgccatctaccactcccccgaacccaatgcctttgccacgggcgcatcgagaaacagctccctgatcgccgtcagcaccggtttgctcgaccatatgacgcgtgacgaagtggaagccgtattggcgcacgaaatggcacacgtcggcaacggcgatatggttacgctgacgctgattcaaggcgtggtcaatacctttgtcgtgttcctgtcgcgcattattgccaacctgattgcccgaaacaacgacggcagccagtcccagggaacttatttcctggtcagcatggtattccaaatcctgttcggcttccttgccagcttaattgtcatgtggttcagccgacaacgcgaataccgcgccgatgcgggcgcggcaaaactggtcggcgcgccgaaaatgatttccgccctgcaaaggctcaaaggcaacccggtcgatttgcccgaagaaatgaacgcaatgggcatcgccggagatacgcgcgactccctgctcagcacccacccttcgctggacaaccgtatcgcccgcctcaaatcgctttaa

SEQ ID NO: 4879 - DNA, 648 bp, Neisseria meningitidis
atgaaagcattacttttaggcgcgccgggcgcgggcaaaggcactcaggcgcaattcatcaccgcagcgttcggcattccgcaaatctctaccggcgacatgctccgtgccgcgattaaggcaggcacgcccttgggtttggaagcgaaaaaaatcattgacgaaggcggcttggtgcgcgacgacatcattatcggcatggtcaaagaacgcatcgcgcaagacgactgcaaaaacggtttcttgtttgacggtttcccgcgcacattggcacaagccgaagcgatggttgaagcaggcgtggatttggatgcagtcgttgaaatcgatgtgcctgacagcgtgattgtcgaccgcatgagcggccgccgcgtgcatttggcttccggccgtacttaccacgttacctacaacccgcccaaagttgaaggcaaagacgacgtaaccggcgaagatttgattcagcgcgacgacgacaaagaagaaaccgtgaaaaaacgccttgccgtttaccacgagcaaaccgaagttttggtcgatttttacagcaaactggaaggcgaacacgcgcctaaatacatcaaagttgacggcacccaagcagtagaagccgtgaaagccgaagtattgggcgcattgggcaaataa

SEQ ID NO: 4880 - DNA, 741 bp, Neisseria meningitidis
atgaatcctttaatctccgacttccaaactccgcaacaacgcacccccgttatcgtcgcccttgatttttccaacgaaaaagacacgctcggattcgtccgcaaccttgacccgacattgtgtcaaatcaaaatcggcaaagagctgtttaccgcgacgggacgcaatttggcagaaagcttaatcaatcaaggtttcaaacttttcctcgatttgaaataccacgatattccccacaccgtcgcgcaagcctgcaaagtcgctgccgatatgggcgtttggatggtcgatatgcacgcatcgggcggccgccgtatgatggaagccgcagcagaagccgttgccggatacggcacgaagccgctcttaatcggcgtaaccgtgttgaccagcatggaacaaagtgatttggcggaaatcggtttgaacaccgcccctgaagaacaagtcatccgcttggcaaaactggcgcaaagttcgggcttggacggcgtggtctgttccgcccaagaagccgcgccgctgcgccgcgaattgggacaggattttgtcttggtcacgcccggcatccgcttggacgttgccggcaataatgatgaccagcgccgcatcatgacaccggccgaagccttggctgccggttcgacttatttggtaatgggtcgtcctgtaacccaagctgccgatccggtagccgtattgcgcgaagtgaaccgcgtggcaaaccttgaagcaaactga

SEQ ID NO: 4881 - DNA, 972 bp, Neisseria meningitidis
atgtccgccaagttccaacaagaaaccctcaaatcccgtttcgcgcaagccaaagtcctggttgtcggcgacgtgatgctcgaccgctattggttcggcgatgtgtcccgtatttcgcccgaagcccccgtgccggtggcgaaaatcggacgaatcgaccaacgcgcgggcggagcggcaaatgtcgcgcgcaacatcgcttcgttgggcggcagggcagggctgttgtccgtaaccggcaacgacgaagccgccgacgcgctcgatgcgctgatggtgcaggacggcgtcgcctcctatctgatgcgcgacaaacaaatcgccaccaccgtcaaactgcgcgtcgtcgcccgcaaccagcagcttatccgtcttgattttgaagaacatcccaactgcgaagtgttggaacaaatcaagcagaaataccgcgaaatcttgcccgaatacgacgcaatcattttttcagactacggcaaaggcggcctgtcgcatatctccgatatgatcgattgggcgaaacacgccggcaaaaccgtcttaatcgaccccaaaggcgacgattacgaaaaatatgtcggtgcaactctgattacgcctaaccgcgccgaattgaaagaagtggtcggcagttggaaaaacgaaagcgagctgaccgaaaaagcgcaaaacctgcgccgccacctcgacctgaccgccgttttactgacccgaagcgaagaaggcatgaccttgttcagcgaaggcgaaccgatttaccagcccacccgcgcccaagaagtttacgacgtatccggtgcgggcgacaccgtcattgccggaatgggcttgggtttggcggcaggctgcaccatgcccgaagccatgtaccttgccaatactgcggccggggttgtcgtggcgaaactcggtacggcggtttgctcgtttgccgaattgatcaaggcattgtcagggcaatcaacaatgtag

SEQ ID NO: 4882 - DNA, 1236 bp, Neisseria meningitidis
atgactatttcgacaatggcacagacacacgatactcgattacaaaaaactttgctctttcccagtcaacaaggttggaaatctaaaacttttcttaaacctgattcacatattagattagcaaccgtattcagcgggattggtgcggttgaacaggcattccaccgattaaatttaaaccataccattgttttttcaggagatattgatccatacgttaaaaaaagttatcttggaaactataaattaaatgaagatttttggcataacgacattactcaatttgatgcgagaaagtttagaaatcaagttgatattttagttggaggcagtccttgccaagcattttccatggttggcaaacgtgcaggattagaagatacacgaggaacattattctatgaatttgctcgcgttgtggatgaagtccaaccaaagatatttatttatgaaaatgtaaagggcttgcttaatcatgataatggaaaaacttggaaagttgtaaaaagtgttttttattcacttggttatgacttatatttccaaataatgaatagtaaggattatgggattcctcaacatcgtgagcgtatttttgttgttggctttcatacccctcctataaatggttttcagtttcctgaaaagattgaattagaacatactatgcaagattttttggaggactatactgatagcaaatattttttacgtgaaaagggtgcgaaatttgttaccagttctaaaaatagacaaaaacgttatacacagattaatggagaaattgccttatgccaaaaagcaaatcaacaatttaattggcatggtgattttatttttcaggcagcccgcgaatctgaatttgatgactttatttttgatgtaaataacgttgaggaaaaatattatctttctgaaaaaatcaaaaattatgttttggcaggaggaacaaaaaattttaaaaccagtacggaaactgatttgcctgtagctcgcccattattgcaaactatgcataaaatgcatcgtgccggggttgataattatgttactcataatcgtggacgtattcgtaaattaacacctagggaatgtttgcggctaatgggttttagagatgattttaaaattttagttagtgatactcaaatgtatcgccaagcgggaaacagtattgttgttgatgtattaatcgctatattaaaacaaatggatattacgctttatggagagtaa

SEQ ID NO: 4883 - DNA, 1120 bp, Neisseria meningitidis
atgccggattttcaaagaattactattgaaaacatagagtattttattgtcgatagtattcaaaatttacgtgcggaagatagttttattcacaggaataacaagttatctgtttttggtggtaatggggaagcacgcaaatatgtaggtagttatattgatgatagtggtcgaaaactaagtacattttttgagtatgaaaattgggggattactgagacaaaaaatggaaggagggtagaatatcctttcattcagaaaaattgttttttttataagaaaaatttacagcgttatttggttgatgcaaaagttgaatatcacaaacaagaacagaaatatcatcatgatatttcaaggttttatgatgattacgttttaagtattaataatctgcctacagaaaatattttcttttcaatccatgatgtatcagaccatttggaaaattctaaaggttaccgtaggggttatatccgttcggaggatgatatatggtcaatttggcgtaagattgtattgcccaaaattagttatttatcaattcttaaactattgcctgtcaaagatatagaagattcagaaccattattttatttccgaatatttttggattatcaatttcgctctatcgtgcacccgcaactcttatcaagagaaaaattagaaataccggcttcagaatttaatcaattcgtagagcaagaaatcattaaacagaaaagtagaaaagggcagcagaaatatcgcaaggatgttataaatcatatgtcgcaatgtccatttacattaattacagatgagattttgttaagggctagtcatattaaaccttatatggtttgtattactgagaaaaatgagaaagaggcattagattatttaaatgggttagctttaacgccgacttatgattggttgttcgatcaaggttatattactttcttggatgatggtcgtttgatttgcggtactcgactaagccgttacacatgggaaaaacttaatatcaatccaaatgcaaaaaattaagatgagaatatatcccgaaggaagagaaaaatatttggaatatcatcgcaaatttgtgtttcaggacaatatcgatgatttcttgtaa

SEQ ID NO: 4884 - DNA, 1005 bp, Neisseria meningitidis
atgaccatcatcgtaacaggcgcggccggctttatcggcagcaacatcgtcaaagcacttaatcaacgcggtattactgacattgttgccgtcgataatttgagcaaaggcgaaaaattcaaaaaccttgccgagtgcgaaatcgcccattatctcgacaaacacgaattcatccgccaagtgagggaacacattttaccttatcaaaacatcgaagccgttttccatcaaggcgcgtgttccgatacgatgaaccacgacggtttgtatatgatggacaacaactaccagtacacgctggatttgctggactggtgtcaggacgaacgcatccccttcctttatgcctccagtgcggcggtttacggcaaaggagaaatcttccgcgaagagcgcgaactcgaaaaaccgctcaacgtgtacggctactccaaattcctgttcgaccaagtattgcgtcgccgcatgaaagaaggtctcaccgcccaagtcgtcggcttccgctacttcaatgtttacggacaacacgaacaacacaaaggccgcatggcatccgtcgccttccaccacttccaccaataccgcgaacacggttacgtcaacctgttcggcagtaacgacggctacggcaacggcgaacaaacccgcgacttcgtcagcgtcgaagacgttgccaaagtcaacctctacttcttcgaccatcccgaactttccggcatctacaacctcggtaccggccgcagccaacagttcaacgaactcgccgccgccaccgtcaacgcatgccgcgccgccgaaggcaaacctgaaatgagcttgaaagagttggtagaagaagaacttatccgctacattcccttccccgacgcgctcaaaggcaaataccaaagcttcacccaagccgacatcaccaaattgcgcgaagccggatataaggaagaatttttcgatgtcaaatcaggcgtcgaccgctacgtcaaatggatgctggaaaatttggcttaa

SEQ ID NO: 4885 - DNA, 1545 bp, Neisseria meningitidis; identical to SEQ ID NO: 2891

SEQ ID NO: 4886 - DNA, 1011 bp, Neisseria meningitidis
atgagcatcatcctatacaccgccaacgacggcactgcccaatttgccttgcaggaatttggcggacagctttggctgacgcaggcggacatggcagaactgtaccaaaccaccaaacaaaatatcagcaaacacattaaaaccattcttgcagagcaagaattggaagagaaggcaactgtcaacttccagttgacagttcaaaatgaaaacgggcgcaaggtaaaccgcaaaatcgcccattattccctgcccatgattattgccgtcggctaccgcgtccgttccgcgcggggcatccaattccgccaatgggcaaccgaacggctggacgaatatctgaccaaaggctttgccatagacgacgaacgcctgaaaggcacaggcggcggcgactattggaaagaactgctcaaccgcattcgcgacatccgcagcagcgaaaaagccctataccggcaagtgcttgatttatatgccaccagccaagactacaaccccaaaagcagcgaaagccaaaccttttttgccgccgttcaaaacaaactgcactatgccgccagccggcaaaccgcagctgagctgatatacagccgtgccgacagcagcaaagactttatggggctgaccacctttcaaggcgcaatccccacgctgaatgaagccaaaatcgccaaaaactatctgaccgaagacgaactgttccgcctgaaccgtctggtttccgccttcttcgacctagcggaaatcaaagcgcaggagcaaagccccatgtatatgcgcgactggatagccgaattggacaaattttccgggctgtacggacaaggcacattacagggtgcaggcagcatcagccgcaaacaggcagagcagaaagccgaacgcgaataccgcgcctatgaagcgcgcatcctgtcgccggtggagcaagcctatctggaaagcgttaaagcgttggaaaaaacagccgtgcaacagatcaaacagaaaaaagaccgcacaaaataa

SEQ ID NO: 4887 - DNA, 1174 bp, Neisseria meningitidis
atggatatgcaaaacaaagcgaaaaaattgattgagatgattcagacggcaccggtggagtggaagccgttgggggaagtggcgaaagtattaagaggaaaacgtttgacaaagaaagagctaattgaaggtgggaaatatccggtttttcatggcggattgattcctcttggttggtttgaccagtttaatcgtagagctaatcaaacgatgattattaatacgggaagtattggtgaagttatatggagtggcgtagatttctggtcatctgatggtacttttgtgattcaaacaccaaactatcttgatgataagtttatattctactttttaaaaacaagagaaggatatataaaatcccaaaagagagttggtggagttcctactattgatagattagtagttgaaaatatttcgatccccatcccacccctggaaacccaacaaaaaattgtaaaaatacttgacaaattcacagagctgtaagctacgctggaagctacgctggaagcggaattaaccctgcgcaaacgccaataccggtattaccgcgactttcttttagattttaacaatcaaatcgggggggatagctgatggctataaaggccgtctgaaagatgtggtttggaagacgttgggggaggtatttaatatttttgctggaggcgacgtaccaaaagacgctttctctgaagtggaaacggaagaattttgtatccccattttatctaatggtataggaagtaaggcactatatggctggactaatgttgctaaaatcaatcaacctagcttaactatatcagctagaggaactataggttgggctagctttcagaataaaccttttttcccaatagtacgcctgttagtgttaacaccaaaaattgaattaaacctaaaatatgcctactactttatgaaaagtattgaatcaaattataaagttcctgaaagcggtattccacagctaacgaaaccaatgataaaagatatttcaatccccatccctccactccccgaacaggaaaaaatcgtcgccatcctcgacaaattcgacaccctgacccactccatcagcgagggcctaccgtacgaaattgccctgcgccggaaacaatacgaatattaccgcgggcagttgttgagcttcccaaaggctgcctga

SEQ ID NO: 4888 - DNA, 1143 bp, Neisseria meningitidis
atgggaaaaagtttaaccgaaattgctgaggaactaaaaggaaacgataaaaaagtccagctaatctatgcttttaacggaacagggaaaacacgtttgtccagagagtttaagaatttaattgctccaaccagttcagaagagccagacggagagccaacaagaagaaaatttctctactataatgcatttactgaggatttattcttttgggacaatgatttgttagcgaacgaagctccaagattaaaaattcaaaagaatagttttaccgactggttgcttagggataatggactggatggagctgttattaaaaactttcaatattatacagatgataagttgactcctgattttaatgatgatttttcagaaattgcattttattttgctcgtggtaatgatgagcagattgaaaatatcaaaatttccaaaggtgaagaaagtaattttatttggagcattttctatgtattaatcagacaagtcatcgctgaattgaatattccagaagatagcgaagaaggacgttccacagatcagtttgacgatttggaatatatttttattgatgaccctgtcagctctttggatgaaaatcatctgattcagcaagcggttgatttggctgatttgataaagcttagcaaaccgaggttaaagtttatcattactacacataatgttttattttacaacgttctatacaatgaactaaaaaaattagaaaaggaaaagaaaagttatcttctgttaaaaaatgaagatggtagttttgatattcttgaaaaacaaggtgattccaataaaagtttttcatatcaccttcacttaaaaggagttattgaaaaagctatcgagaatcagcaggtagaacggtttcattttatgttgctgagaaacctgtatgaaaaaacagctaattttttaggctataagcaaaggtctgatattttgcccgaagacagcagacgaaactattttcaacgtattattaactttacaagtcattctacattatctaatgaggcatttgccgagccaacaccacaagaacaagaaactgtcaaattgcttttgcaacacttgctggataactataatttttttcaagatgatgaacaaagagataagccatga

SEQ ID NO: 4889 - DNA, 387 bp, Neisseria meningitidis
atgaacctcgaaaccaaacccatcgctgaaacgccgaatttcatcgtgctcgaccaatatgaaaaaatcgaacagtcgggcagctaccaatcggaaaaccggttggaagcggagttaatcgccgatttgcagaatcagggttacgaataccgcaaggatttgaacagccaaagcaggctgctggaaaacctgcgcgcgcagttgcagcggctgaacgatgtggcgttttcagacggcgaatgggcgcggtttttgacggaatatctggacaggccgtctgaaaacattaccgataaaacccgcaaaatccacgacgaccatatttacgatttcgcttttgatgacggtccttggattcggatttcaagtgcaacactagtgtattag

SEQ ID NO: 4890 - DNA, 966 bp, Neisseria meningitidis
atgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 4891 - DNA, 2766 bp, Neisseria meningitidis
atgcgaatccgccgtcgtctgaaaaacatttatctgctggacaagaaaaaccttgcccgcaaccatgtgcaggttatcaaccagtttgagcagacgggcacgcatgcaaaccgctatgacgttaccgtgttggtaaacggcctgccgctggtgcagattgaattgaaaaagcgcggtgtggcggtgcgcgaggcattcaatcaggtgcaccgttacagcaaagagagcttcaacagcgaaaattcgctgttcaaattcctgcaaatcttcgtgatttccaacggcacggacacgcgctatttcgccaacaccaccaagcgcgacaaaaacagcttcgatttcacgatgaattgggcgcggtcggacaatcatccgattaaggatttgaaagactttaccgccacgttcctgcagaaaagcgtattgctgggcgttttgctgcattacagcgtgttcgatgcgaatgatacgctgctgattatgcggccgtatcagattgccgccgccgaacgcattttgtggaaaatcaacagctcggcgcaggcgaagaattggagcaaaccggaaagcggcggctatgtctggcacaccacgggcagcggcaaaacgctgaccagctttaaggcggcgcgtctggcgacggaatcggcatttatcgacaaggttttcttcgtggtggacaggaaggatttggactatcagacgatgaaggaataccaacgtttttcgcccgacagcgtgaacggttcggaaagcacggcaggcttgaaacgcaatttggaaaaagacgacaacaaaatcatcgttaccaccatccaaaagctgaacaacctgatgaagggcgaagataatctgccggtttaccatcagcgagttgtctttattttcgacgaatgccaccgctcgcaattcggcgaagcgcaaaaaaacctgaaaaagaaatttaaaaaattctgccagttcggctttaccggcacgccgatttttcccgaaaacgctttgggcgcggaaaccacggcgggcgtgttcgggcgggagctgcattcttatgtgattaccgatgccatccgcgatgaaaaagtattgaaattcaaagtggattacaacgacgtgcgcccgcagttcaaagccgtggaagcggaacaggacgagaagaaactgagtgccgccgaaaaccacaaagccctgctgcaccctgaacgcatccgcgaaatcacgcaatatatcctgaatcagttcaggcagaaaacgcaccggctgaatgcgggtggcaaaggctttaacgcgatgtttgccgtcagcagcgtggatgcggcgaagtgctattacgaagcgttcaaaacacaacaggcaggcagcttgcacccgctgaaagtggccaccattttttcctttgcggccaacgaagagcaaaacgccgtcggtgaaattgtcgatgagacttttgaaccggaagcgatggacagcagcgcaaaagaatttttgcaggctgccatcaacgattacaacgcctgtttcaaaaccaatttcggcacggacagcaaagcctttcaaaactactaccgagatttggcaaaacgggtgaaaaatcaggaaatagatttgctgattgtggtcggcatgtttttgacgggttttgacgcgccgacgctgaacacgttgttcgtcgataaaaacctgcgctatcacggcctgatgcaggcgttttcgcgcaccaaccgcatttacgatgccaccaaaaccttcggcaatattgtctgcttccgcgatttggagcaggcaaccattgatgcgattaccttgtttggcgacaaaaacaccaaaaacgtggtgctggaaaaaagttacgaagaatacatgaacggctataccgacagccagaccggcgaagcacggcgcggttatctggatgtggcaaaagaattgcgcgagcgtttccccgatcccgacaaaatcgaaacggaaaaagacaaaaaagattttgccaaactcttcggcgaatacctgcgggcggaaaacgtattgcagaactacgatgaatttgccgcgctgcgcgagttgcagagtgtggacgcggcggacgaagatgcgatgaaggcgtttcaagaaaaatactacctgagcgatgaagacgtgcaggaaatgcggcaagtgccgatgccgtctgaaagggcggtgcaggactaccgttccgcctacaatgacatccgcgactggctgcgccgccaaaaagcaggcgaacagaaagagcaatcaaaaatcgactgggacgatgtggtttttgaggtggatttgctcaaatcacaggaaatcaatctggattacatcctgcaactggttttcgaacaccacaaaaaaatcaaaggcaaagcggagctggtggaagaaatccgccgcatcatccgcgccagcatcggccaccgcgccaaagagggtctgattgtggatttcatcaacgatacggatttggacaaagtacccgacgttcccgccatactggaaaccttctacacctacgcgcaagaggtgatgcggcacgaagcggcaggattgattgccgccgaaggcctgaacgaaaccgccgccaaacgctatttaatcagctcgctcaaacgcggctatgccagcgaaaacggcacggaactgaccgaaaccctgccgaaaatgagtccgctcaacccgcaatatctgacgaagaaacaaagtgtttttcaaaagattgcggcgtttgtggagaagtttgccggaatagggaccgatatttga

SEQ ID NO: 4892 - DNA, 2310 bp, Neisseria meningitidis
atgcttgcacccgaattggaacagattttgcagcagctttaccgcgaggcgcgtaaggctcattatgaatttatcagcctcgagcatctgcttttggtactcatcgaagaagatgcctccgtccacaacgtcctcaagctctgcggcgcggatttgaaagtggtgtccgaacagctcgccgccagcgttgccgaaaacacccccctgattcccgaacaccttttagacacggtcgaaacccggcccacgctcggcttccaacgcgtgatgcaacgggcgatggtgcatacccagtctgccggaaaagccgcagtcgaaccgttggacgttttggtcgcgctgatgagcgaaaccgacagccacaccgtctatttcctcaagctgcaatcggttacgcgttttgaagttttgcgctgtattgcccacggctctcccgatgaagatgaagatgaagatgaagatgaagacgatggcaactattcttcagacggcatggacgacgataatggaaaccgcaccaaaccgggcaaaaaccctttatcggcgtacaccgtcaacctcaacgccgaagtcaaagccggccgtatcgaccctttgattggtcgcaaacacgaaatggaacggctggtgcaaatcctatgccgccgccgcaaaaacaatccgcttttggtcggcgaagcgggcgtgggcaaaaccgcgctggcggaaggtttggcacatcaaatcgtcaacggcggcattccagacgcgcttaaagatgccgaagtgtacgcgctggatatgggctcgctgttggcgggcacgaaataccgcggcgactttgaagcgcgggtcaaatccgtcttgaaacagctcgaaaaaatcccgcacgccattttgtttatcgacgaaatccacaccatcatcggcgcgggcagcaccagcggcggcaccatggacgcgtccaacctgctcaaacccgcgctggcaaaaggttcgctgcgctgcatcggcgcgaccacctacgacgaataccgcaccattttcgacaaagaccatgccttaagccgccgcttccaaaaaatcgacgtggtcgaacccaccgtttccgaaaccgttcaaatcctgcgcggcttgaaaccgatgtttgaagccttccaccaagtccgctacactcaaggcgcactcgaagccgccgccgaactctccgcacgctacatcaacgagcgtttcctgcccgacaaagccatcgacgtgatggacgaagcaggcgcggagcaacggattctgcccaaatccaaacagaaaaaagtcatcggcaaagcgcaaatcgaaaccgtcatcgccaaagtcgcgcggattccagaaaaaaccgtgtcgcacgacgacaaacaggtgctgcaattcctcggccgcgatttgaaaaacatggtttacggtcaggaaaacgccatcgacgcgttggttgctgccgtcaaaatgtcgcgttccggccttgccctgcccgacaaaccgataggcagtttcctcttctccggtccgactggcgtcggcaaaaccgaagtcgccaaacagcttgcctactcgatgggcgtaccgctgcaacgctttgatatgtccgaatatatggaacgccacgccgtatcgcgcctcatcggcgcaccaccgggctacgtcggctttgaacaaggcggccttttgaccgaagccatcaacaaacagccgcattgcgtattgctcttggacgaaatcgaaaaagcccaccccgacattttcaacgtcctcctgcaagtcatggacgcaggcaaactgaccgacaacaacggcaagagtgccgatttccgcaacgtcatcctaattatgaccactaacgcaggtgcggagagtctcagccgacccagcctcggctttaccgccaaacgcgagcgcggcgacgaaatgcaggctatcaacaagctcttcacgcccgagttccgcaaccgcttggatgcgattatcccgtttgcgcccttatccgaacccgtcatcaccaaagtcgtggacaaattcctgctccagctcgaacaccggctcctcgacaaaaaagtcgaagccgaattcacgtcggcattgcacaaatatctggcggaaaaaggttttgacccgcaaatgggcgcgcgcccgatgcaccgcctgattcaggaaaaaatccgcaaaccgctcgccgacgaactcctgttcggcaaactatccgacggcggcttcgtacggatagactgggatgcggcaaaagaagaagccgtgttgaagtttaagaaaagcaaggtcaaaataaaaaccgcctccgcataa

SEQ ID NO: 4893 - DNA, 303 bp, Neisseria meningitidis
atgaccgcgcaacaccaatccgacacgctcttgcaccgtctgaacaccctgccgccgaaacgttacggcgttttcctattgaacgacgattacaccacgatggaatttgtcgtcgaaatcctgaccgaaatctttatgctcggacaagaacaggcggtagcggtaatgctcttggttcatcacgaaggcaaaggcctgtgcggcacttacacgcgcgatattgcccaaaccaaacaacaacaagtcatgcagcgggcaaaagccgaagggcatccgctgcaatgtattgtcgaggagatttaa

SEQ ID NO: 4894 - DNA, 204 bp, Neisseria meningitidis
atggcaaccggtatcgtaaaatggtttaacgacgctaaaggttttggtttcatcacgcctgatgaaggcggcgaagatttgttcgctcacttctcagcaatcaatatggaaggtttcaaaaccctgaaagaaggccaacgcgtctctttcgacgtaaccaccggccctaaaggcaaacaggccgccaacattcaggctgcttaa

SEQ ID NO: 4895 - DNA, 1332 bp, Neisseria meningitidis
atgctgttcaaccacaccgcttccgaactcctcgacctctgccgccgcacgctcgacttggcaaaagcgacgggcgcaaccgccgccgaagccgatttcagcgaatcattgggacaaagcgtcagcgtgcggctgggcgaaatcgaacaaatcgagttccagcaggacaagtcgctggacattaccgtttacgtcggcaaacgcaaaggccgcgccagtactgccgacttctccgaaaaagccctgcaagacaccgtcaaagccgccatcgacatcgcccgccacaccgccgaagacggttgcgccggacttgccgatgcctgtctgatggcaaaacacatcggcgaccccgacctttaccacgaatgggatttggatacggaagccgccgtcggcttggcaaaacaatgcgaacaagccgccctgaacgaggatgagcgcatcgaaaactccgaaggcgcggcggtgcaaaccggccattaccaatacgtttacggcaacacccacggttttgccgcacaccggcaaggcacgcaccacagcatttcctgcagcgtcgttgccgccgacgaaaacggcatgcagcgcgactactggtacgattccgcctgccgccatccggatatggacagccccgaaaccatcggtcaaaccgccgcccgccgcactttgcgccgactcggcagccgcagcatcccgacaggcagctaccccgtcctcttcgataccaccgtttcgggcggtcttatcggacacctcgtcggcgcactctccggcggcgcgctctaccgccaaagcagtttcctgatcgacagcatcggcaaaaaagtcctgcccgatttcctcaacctgcgcgaagaaccgcacatcccccgctctttccgcagcagctattttgatgcggaaggcgttgccaccgcaccgcgcttcgtgattcaaaacggcattgtcgaaggctatttcctcagcagttacagcgcgcgcaaactcggtatgcagaccacgggcaacgccggcggcgcgcacaacctgtatttgaaccatacgcacgaaacgcaatccgacctgctgaaagaaatggggacgggattgttggtaaccgaactgatgggacagggcgcgaacaccattaccggtgactactcgcgcggcgcggcgggtttttgggtggaaaacggcgtgattgcctaccccgtccacgagattaccgtagccggacgcttgcaggatatgtaccgcgacattgtcggcgtggcggatgacgctttgcggcgttcgtccaacaaaatcggctcgattctgattgcggggatgacggttgccggaagctga

SEQ ID NO: 4896 - DNA, 537 bp, Neisseria meningitidis
atgcgctattggaaaaattcgagaatcaagatgtttgaacaagaagacgaatggatcagcaaaacccaaatgaaaaagcagatgaacgatttgcaggatttgggtatggcgttgaccaagctctcaaacgatacgctgaaaaaaatcggtttggatgcggatttgtacgaggcggtaaccgcctataaaaaaatcacatccaacggcgcgctcaaacgccaggcacaatttatcggcaggctgatgcgcgataccgatcccgcgcccatcgaggcgtttcttgccaagctgcgcggcgacgatgcggcgcacaacgcctttttgcaacgcgtggaacaggcgcgcgtacggctgttggcagacgacggcgcgttgacgcagtttatgtcggattttccgcatgcggacgcgggcaagctgaggacactcatccgcaataccaaaaaagagcaggagcaaaacaaaccaccaaaaaatttccgcgccctgtttcaagagttgaaaaccgtgatggaaaacggggacgcggaaatttag

SEQ ID NO: 4897 - DNA, 717 bp, Neisseria meningitidis; identical to SEQ ID NO: 157

SEQ ID NO: 4898 - DNA, 1701 bp, Neisseria meningitidis
atgtcagtcaaaatccaaacccgatccgtcaataccgacgtttttaatcatttgctcaccgccggtgccgatcctttaatcgcccagctttgtgcttcgcgcggtgtgcaaagtcctgccgaattggacgacaaactcgcttccctcctgccttatcaatcgttgacgaattgcgaagccgccgcccgccgtttggcggatgcggttgggcgcaaggaaaaaatcctgattgttgccgactatgatgccgacggtgcgacggcgtgtgccgtcggtatgagcggtttggcggcgatgggggcgaaagtggatttccttgtgcccaaccgctttgaacacggctacggcttaacgcccgaacttgccgaaatcgctgccgcgcagggcgtggatttgctgattacggtggataacggtatcgccagcatcgcaggcgtggcgagggcgcaggctctgggtttggatgtcatcgttactgaccaccacttgccggccgagaccgtgcccgactgcatcatcgtcaatccgaaccaaaaaggctgcggttttccaagcaaaagcttggcgggcgtgggcgtgattttttatgtattgatggcgttgcgtgccgaattgcgccgccgcaattatttttcagacggcatcaaagagccgaatttgggcgaacttttggatttggtcgcactcggcacggttgccgatgtcgtccctctcgaccacaacaaccgcatcctcgtgtcgcaaggtttgaaacggatgcgctccggcaaaatgcgccccggtatccgcgccttgtttgaagtggcgcggcgcgattggcgcaaggcgcagccgtttgatatgggttttgcgttgggcccgcgcatcaacgccgccggacggctggacgatatgtcggtcggcatcgcctgcctgttggcgcgagatgattccgaagctcaggaactggcggctcagttaaacaacctcaatatcgagcgccgcgaaatcgagcagtctatgctgcaagacgcactgaatgatttccccgaaaccctgccttcaggtcagatgactttggtggcgtatcgcgacgacttccatcaaggtgtggtcggcattgtcgccagccgcctcaaagaccgtttttatcgtccgaccatcgtgtttgcgcctgccgacaacggcgaagtacgcggttcgggacgttccattcccaatttgcacctgcgcgatgctttggacttggtgtccaaacgccatcccgatttgattttgaaattcggcggacacgcgatggcggcgggtttgagcatacttgaacacaacattcccgcgtttcagacgacctttgaagaagccgtgcgcgaaatggtgtgcgaagacgatttgtcgcaaaccttcatcaccgacggcagcctgcccgcctgcgacatcacgttggaacaggcgcaaaaccttgcccgtcacgtttgggggcagggcttcgcgccgccgagctttaccgacgagttccacgtcgtccgccagcaacctttgggcgcggagggcaaacacaaaaaagtctggctgcaaaaagacggctgcgaatttgaagcgatgttttggcgttgcagcgaagacattcccgaatacatccgcacggtttaccgccccgttgccaacgaatggcgcaacaatctcgaattgcagctgtatatcgattactgggaagccgcgtag

SEQ ID NO: 4899 - DNA, 1362 bp, Neisseria meningitidis
atgctgaaaaaatggttgaataagatgctgccttccggtcggagcagtaaaaaagcggaaagtaaaacggtcattcctgccgaaagacacaacatccgtgccgaaatgttgagctttgccgccgaaaacgtcatacgccgcctgaaagggacggggtttcaggcttatgtggtcggcggcgcggtcagggacctgctgctcggcatcgaacccaaagatttcgatgtcgcaaccgatgccacgcccgaacaggtgcacaaactcttccgccgcagccgcatcatcggcaggcgttttcagattgtccatgtgatgaacggtgcagagactatcgaagtaacgacgtttcgcggcggtgcgaaagtacatcagaatgcacgcggcaggattatgaaagacaatacctatggcagcatcgaagaagatgcgatgcggcgcgattttacctgcaatgccttgtattacgatcctgaaaaagaagagattttggatttccacaacgggattgccgatgttgccgcccacaggctggttatgattggcgatgccgccgaacgctatcaggaagaccctgtcaggattttgcgcgccatccgcctgtcgggcaaattgggctttgagctgtcggaagaaaccgccgcaccgattgccgaatcgatatgccgtctgaagcacgaaccggtagcgaggctgttcgacgaaattatgaaattgctgttttcagggcacgctcgcgagtgtctaaaacgtttgaacggatttgacataccggacgacatccatctgctgctcaatgccttgcgcgtttcagacggcatcgccggaaaaatgacggtgcttgccctgaaaaataccgatgagcggctgcgtgccgacaaatcggtttcggtcggttttgtattggcggctctgatgtggcccgagttggaacgccattggaaaagcaatctgcaacagggtttgaaacccgcgcccgccctgtccgatgcaatcaatacgatgcgcgaaaccgtcgaacgcggttggggcgtgccgcaacgcttttccgccacgatgcgcgaaatttggatgttccagccgcagtttgaaaaccgcaaaggcgcaaggccgcacaaactgtttgcacaggcgcgtttccgtgccgcctatgatttcctgctcttgcgcgccgaaaccggcaatgcggaccgcgcccttgccgagtggtggacggcgtttcagacggcatcgacggaacagcggtcggagatgaccaaaaacgaagccgccgcccgacacgaaaaaaacgaaggacaggcgaaaaaacgccgccgtcgcaggcgcaaacccaagccgaaggttgtgggaacggattgggaataa

SEQ ID NO: 4900 - DNA, 324 bp, Neisseria meningitidis
atgaaaaaatgtattttgggcattttgaccgcgtgtgccgccatgcctgcatttgccgacagaatcggcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcgaagatgaggcaatccgatgcagaaaattcgattga

SEQ ID NO: 4901 - DNA, 954 bp, Neisseria meningitidis
atgacacataccgtccacctgcatttagaagaaaccgacaacttggcgttgcagcgtctgtgcggttcttttgacaacaaccttgatttacttgccaaagcactcgatatccacatcagccgccgttttgaacatttcactttcaacggcgcatttgcacacgccggcaaacgcgcactgctcaaactcttggaaacggcgcagacgcgcgacctaaacgacggcgacatcaggcttgccgccgtcgaagcccaaaccgaagatgccggtcatcaagaaaaaaaccatgaccacgcctattatttccgcaccaagcgcggcagcatcggcggcagaacgccacggcaaaacggctatatccgcgccctgctcaaccacgacatcgtattcggtctcgggccggcaggtacgggcaaaacctatctcgccgttgccgccgccgtcgatgcgatggaaaaacaccaagtcgaacgcatcattttagtgcgcccagccgtcgaagccggcgagaaactgggcttcctgcccggagacctgacccagaaagtcgatccctaccttcgtccgctttatgatgccctctatgacctgatgggctttgaccgtgtaaccaagctgattgaaaaaggcctgattgaaatcgccccgctcgcctatatgcgcggcaggacgctcaacggcgcatacatcatcctcgacgaagcgcaaaacaccacgcccgaacaaatgaaaatgttcctgacccgcatcggcttcggcgcgaaagccgtcattaccggcgacaccagccaaatcgacctgcccaaaaacatcaaatcgggattaaaagatgcgcgtgagaaactgcacaacgtggaagggctgtatttccacacctttaccggcgaagacgttgtccggcatcctttggtgcaaaaaatcgtcgaagcctacgaatcggcagaacacgactga

SEQ ID NO: 4902 - DNA, 1035 bp, Neisseria meningitidis
atggcacggcatgtatttcttcccccgctttccgttcatcgacatcgaccgcatccgctgggtgtgtgcgggtttgaaagctttcaaacactacatccgcgaaaacgggctgcccgacctgattcacgcccactgtatgaactatgccggcatacttgccttcaagatttcccaaaaatacggcatcccctatgtcgtcacggaacacagcagcaccattacgcgcggtttggtgcgcccgcaccaatggcagcctatgaaaaatgcggcggcacacgccgccgcacgtctcgccgtcagccgccatttcgcacacgtcctgcaacacaaatacggctgcgaatggcagtacctcccccaacatactgggcggaatattcaaccgaccgtttgaacaaagagaaaaaaaacaacaaaccgcatttcgtgttctgcaccgtctcgcaccttcgccgtctcaaaggacacgatgtcctactcactgcctttgcccgggcgttggcacaatgcccgcaactgcgcctgaacatcggcggcagcggacaggaagaacagcggctgaaacagcaggcggcagacttgggcattacccatgccgttacatttttgggcgcattgcagcccgaagcagtcttggatttgatgaggaacagcgacgcattcgtccttgccagccgcacagaaaccttcggcgtagtctatatcgaagcactgtcccaaggattgcccgtcattgcaacacgctgcggcggtgcggaatctattgtttcagacggcaacggatatttggttcctgttgacgacgacgatgcccttgccgacgcactcatcaaaatgtgtgaacaccactctgatttcgaacctgcccgacttagagaaaactgtctgaacgaatttggcgaaaatgccgttataggcaggttgatcggcattttccgacaggcaatcgcagaatacggtaagaaaataccggtgaaatatagtggattaacaaaaatcaggacaaggcgacgaagccgcagacagtacaaatag

SEQ ID NO: 4903 - DNA, 174 bp, Neisseria meningitidis
atgcccgaacccttgcacgtcctcgtcatcccctcatggtatccgcaatccgaacaggatgtggacgggatttttttcaaaatcaggcactggcattgcagaggaaaggcatcaaaaccgccgtgcttgcaccgatgttccgctacttgcggaaagaaacagcaagcatcctga

SEQ ID NO: 4904 - DNA, 705 bp, Neisseria meningitidis
atgttgcgtcttgttttggcggcttcgctgtcggcggtatcttttccggcagcggctgaagcattgaattacaatattgtcgaattttccgaatcggcgggtgtcgaggtggctcaggatacaatgtccgcacgtttccaagtgacggcggaaggacgggacaaaaatgccgtcaatgctgagtttgttaaaaaattcaacaagttcatcagaaaatcgaaaaatggtagctttaaaaccgaattggtatcgcgcagtgcgatgccgcgctatcaatataccaacggcagacgcattcaaacaggctgggaggagcgtgcggaatttaaggtcgaaggtagagattttgatgagttaaaccgttttattgccgatattcaagcagatgccgcgttggaatatacggatttccatgtgtcgcgcgaacgccgcaacgaggtcatcgatcaggtcagcaaggatgccgttttgcgtttcaaggcgcgtgccgaaaagttggcgggcgttttgggtgcgtccggttataaaatcgtcaaattgaatttgggacacatcggcagccatatcgcgggagggggagctgctcaggcaaaaatgcttcgtgccatgccgatggcggcaagcgtcaatatggagggtgcggattccgccgcgcctggtgtggaggaaatcagcatcagcgtcaatgggacggttcagttctga

SEQ ID NO: 4905 - DNA, 567 bp, Neisseria meningitidis
atgagcatcaagtccgacaaatggatacgccgaatgagcgaagaattcggcatgatcgaccctttcgagccgaaccaaatcaaagaagccgacggcaaacgcatcatctcctacggtacgtccagctacggctacgacatccgctgcgcaaacgaatttaaaatcttcaccaacatcaacagcaccatcgtcgatcccaaaaacttcgacccgaaaaacttcgttaccgttgaagacgactgctgcatcatcccgcccaattccttcgcactggcgcgcacggtcgaatatttccgcatcccgcgcaacgtcctgaccgtctgcttgggcaaatccacctacgcccgctgcggcattatcgtcaacgttaccccgttcgaaccggaatgggaaggctacgttaccctcgaattttccaacaccacccccctgcccgccaaaatctacgcaggcgaaggcgtggcgcaagtcctcttcttcgagagcgacgaaatctgcgaaacctcatacaaagaccgcaacggcaaatatatggggcaaaccggcgttaccctgcccaaagcctga

SEQ ID NO: 4906 - DNA, 417 bp, Neisseria meningitidis; identical to SEQ ID NO: 2805

SEQ ID NO: 4907 - DNA, 900 bp, Neisseria meningitidis
atgtggttcaagcagattagtttttatccgctcaacaaagaaaagctgcctgaggcagacgtacttgccgacaaacttgctgaagctgaatttacccattgccaaggcttagactggttcagcgaaggctttaccgcaccggtttcattctcccctgaactcgttttccctgccgactttaccttgcgcgtcgccctgaaaaaagaagaaaaagtcctgcctgccggcgtcatccgcgatattttggaagagaaggtagcggaaatccaaaacaatgaagcccgcaatgtcggccgtaaagaaaaacaagagcttaaagagcaaattacagacgacctgctgccccgagcgtttacccgcagcagccgtacagaagcggtgtttaacacccgccacggctacctgctcgtcaataacgcggcttccgccaaagcagaaaacatcctgaccaagctgcgcgaagctttgggcggtttggaagcctcgctgccgaataccaagcaatcgccctcttccttgatgaccggctggctgttgcaagggcattgcgaaggcggttttgaattagacagcgattgcgaactcaaaggtacgggcgatattgttcccgtcgtcaaagtatccaaacaagatttaaccgccgacgaagtggttcaacacgtcaaaaacggtaaaaccgttacccaactgggcttggtgtggcgcgaacaaattgcctttatcctcactcaagacttcacactcaagcgcatccaatacctcgacgtattgcaggaagaagccgaaagcaacggcgacgatgccgccggccttgccttcgcctcgcaaattctgatggcggaatccgtcagcaccatgttggaagaactggtttcctatttgggcggctggcaagattga

SEQ ID NO: 4908 - DNA, 1458 bp, Neisseria meningitidis
atgaaaccaaccatcgcgcttgttggtcgccccaacgtcggcaaatctactttattcaaccgtttgacgcgcaccaaagacgcgctcgtgcatgacctgcccggtctgacgcgcgaccgccattacggacacggcaaagtcggcagcaaaccttatttggtcatcgataccggcggtttcgagccggttgtggacagcggcattttgcacgaaatggcaaaacaaaccttacaggctgtcgatgaagctgatgcagttgtgtttttggtggacggccgtaccggtttaacaccgcaagacaagattattgccgaccgtttgcgccaaagtccgcgccctgtttatttggccgtgaataaaggcgaggggggcaatagggctgtacttgccgccgagttctacgaacttgctttgggcgacccttatgttatttcaggtgcacacggcgatggtgtgtattatctgattgaagatattttggaaaaattccccgagccggaagccgaagaagccgatgcaagacatcctgtttttgccgttatcggtcgtccaaacgtcggcaaatctacgctggttaacgccattctcggcgaagagcgcgtcatcaccttcgatatggcaggtacgacgcgcgacagtatccatatcgatttcgagcgcgaaggcaaaccgtttaccatcatcgataccgcaggtgtgcgccgtcgcggcaaagtggatgaagcagtggaaaaattctccgttatcaaagcgatgcaggcggttgaagcggcaaacgtcgctgttttggtattggacgcgcagcaggacatcgccgaccaagatgcgacgattgcaggtttcgctttggaggcaggccgtgctttggtggtggcggtcaataaatgggacggcatcagcgaagaacgtcgcgagcaagtgaaacgcgatatcaaccgcaaactgtatttcctcgattttgccaagttccactttatttccgcattgaaagagcgcggtatagacggtttgtttgacagcattcaggctgcctacaacgcggcgatgattaagatgccgacgccgaaaatcacgcgcgtattacaaagcgcgatcgagcgtcagcaaccgccgcgtgccggcttggtgcgtccgaaaatgcgttatgcccaccaaggcggcatgaaccctcccgtaattgtggtacacggcaattcgctgcacgcgatttccgacagctatacgcgctatctgacccaaacgttccgcaaagccttcaatctgcaaggcacgccgctcagaattcaatacaatgtttcggaaaacccgtatgaaaatgcggaagacaaaccgaagaaaaaaccgctgcgccgcgtcagcctgagcaaccgtattgagaaacgcgaaggccgaaaggaagagaaaaaccgcttcaagaagaaaaccaaagtcagtgtgaaaaaacaattcagcaaataa

SEQ ID NO: 4909 - DNA, 630 bp, Neisseria meningitidis; identical to SEQ ID NO: 2793

SEQ ID NO: 4910 - DNA, 1296 bp, Neisseria meningitidis
atggcacaaaaaatccaatccgtcaaaggcatgaacgaccttctgcctgtcaagcaaaaagatttcaaactgacggctgcgttttggcaggcgtttgaagatacggtcggccgctggacacgcgcttacggttatcagcaaatccgtacgccgattgtcgagcaaaccggtttgtttgtccgctccatcggcgaggaaaccgatgtggtcggcaaggaaatgtacaccttctccgattcaaacgattctttgagtttgagcttgcgtcctgaaggtacggcttcctgcctgcgtgcggtggtcgaacacaaccttctgtacaatagcccgcaaaagctgtggtatatggggccgatgttccgccgcgagcgtccgcaaaaaggccgttatcgtcagttccatcaggtcggtatcgaggctttgggttttgaagggccggatattgatgcggaaatcatcgcgatgtctgccgacttatgggaaaaattgggtatccgcgaatacctgactttggaaatcaacagcttgggcaaccgtgaggaacgcgcggcacaccgtgcggcattggttgaatatctgacccgttatgaagataaattggatgaagacagcaaacgccgtctgaaaaccaatcctttgcgcgttttggatacgaaaaacccagatttgcaggaaatctgcaacgcggcgccgcgtttggtggattacttgggcgaggattcgcaaaaccactatgtacgcttcaaggcgatgttggatggtttgggtatccaatatattgaaaatccgcgcttggttcgcggtttggattattacaatcagacggtttttgagtggacgaccgacaaactcggcgcgcaggcgactgtgtgcggcggcggccgttacgatggcttgattgaagaactcggcggcaaacctgcgccgtctatcggctttgcaatgggtatcgagcggctgctgcttttggtgagcgaatacggctctctggaagtgaacgctgcgcctgatgtctatgcaatgcaccaaggcgaaggggcggacttgcaggtgatgaaatacgcacaagccttgcgcgcgcaaggtttcaatgtaatgcagcattccggctatcaaagcctgaaagcgcaaatgaaaaaagccgacaacagcggcgcacgctttgccctgattgtcgcgcaagacgaactggcgaacggtacggttacgctcaaagacatgaacggcgcacacggtcagcaaactgtcgccgccgaggatttaacccctactttacaacaatggaagaacgcataa

SEQ ID NO: 4911 - DNA, 657 bp, Neisseria meningitidis; identical to SEQ ID NO: 3893

SEQ ID NO: 4912 - DNA, 468 bp, Neisseria meningitidis
atgcaaatagataatatatccgatgaacaggttgtgattgtcagaatgtcttgttatcttaagaaagatgaaatttttaagaatatagaaagatatggatatcagtcatcagatattaagaaaattagtcctccttttccattaaatattttacctgttcccaaaccttattatttttatctttatgatacccatttgaatcaaatttatgatttggcttggtcatgtaatgattttttaatgtttgaaatatttattttggatagggaaagcatcaaatatatagataaagataaactttttaaatctagagaaacactatattcgaattttaaatctattaaaaatcaatgcaaaaattattttttttgcggttttgattttgatgccccttactttaaaagcggtgtgagtcaggtggcagattataattttgttcctgatgcattttctttattctttatttaa

SEQ ID NO: 4913 - DNA, 177 bp, Neisseria meningitidis
atgggggaatacctggaatttgaagaaagcggtacgaaaattaccgttgaaatcggcagcgcgtggcattttaatgaaactataagaaatattaatacacatttaagaggtacgaaacttccaggttctaactggagagttcaagataaggggcattttcatctttggaaaagataa

SEQ ID NO: 4914 - DNA, 201 bp, Neisseria meningitidis
atgcaattgatatgtgccgattggacaggtataggaaattttatgaaaaccttcgaaaaaacatggtctgcacaatatcgggatatggaaatttcagtacggaatttttggaatttggagcggacaggggcggaagtctatatcaacggaaggcgggtttatcataacgaagccgaaatggcgtctgcttctttgcgttag

SEQ ID NO: 4915 - DNA, 378 bp, Neisseria meningitidis
atgtctttcggctatttgattgcaacatcgcaaccttgcgaattgttgacaaaatctcgaggtgaaactttttctttaattatggataagatggatttatggatttatttcagattttgtgaaggaaatatttatacaataaggaagaatgaaactgaatcttgtcttacagaaagaggaggcgaatggttgaaacatatttatgaatttaatcggggaagttttattttttcttatgtgcttctaaaaaagagagaaagcgaagagaattttacagaaattgttttaaaatcaataaaaaataataaaattttgacagttaaggtacggtcaggcttgcattttgacttaagaaatatttatcgtattgagatgtaa

SEQ ID NO: 4916 - DNA, 258 bp, Neisseria meningitidis
atggatgatgtttaccgtgcttttgattcggttggaaatattctgaatttccgtatagtagaaaaagagcaaaaagggttttgggtaagtaccaaaatcaaaacagttgtatttgattcggcagatatgtcttctgatgatctttttctgaaatgcttacagtcttcatataaggcttattttgaaactgaacctgccggtttagataaacggcagctgatgaaaacgttaattcaaaaatgcggattcagttgttga

SEQ ID NO: 4917 - DNA, 546 bp, Neisseria meningitidis; identical to SEQ ID NO: 175

SEQ ID NO: 4918 - DNA, 120 bp, Neisseria meningitidis
atgacaatattcaaattgctggatttgcaatctgatttacctattgaaattgggtgtgcaacatacgttctaagcagggctttgattttccaaccttgtaatccaaaggagttattatga

SEQ ID NO: 4919 - DNA, 273 bp, Neisseria meningitidis
gtgtttgctgttattttcttttcgacattgggctgtattttagcatggataagagatattcctaaaataaaatcaaaaaaaattttggcaagatccttatatattataggaataataaatgtaataatcagctatgtattaattaaaaatatattggtttctgtttcggatggaggtggaataaaatatgttgcaatatatttatcaaatctttttttttggacagtattgatgtatgttcttgtgaaaagattatctaaaaagccaagctga

SEQ ID NO: 4920 - DNA, 291 bp, Neisseria meningitidis
atggatgatctaatactatattttttatcaggtatattcggaaatcaagttgctgaatatattataaaaaacaaccgtgagataaaagttccctttattgtgctttacgcaatattttttacgttgatttatactgtggctttgttgtttctcagtctaatctattgggtcaatggtgcggagattgcatggaaggggataggtattttcagtatgtcggtcagtttttgtatagtcttctgtctttatttgattgacaaggcaggaagatgtaaggataagaaacaatag

SEQ ID NO: 4921 - DNA, 474 bp, Neisseria meningitidis
atgaaaaaacaaattaccgcagccgtaatgatgctgtctatgattgcccccgcaatggcaaacggattggacaatcaggcatttgaaaaatacgtattccacacgcaggcagatgcgccgatgcagttggcggagctttctcaaaaggagatgaaggagactgagggggcgtttcttcctattgtggcaggtgctttgatgggaggggcaattagtgcttgggctaatcacggcatttctaaaattaaaacagggcaatttgcttcaacaagaagtaccttggctgcaaccgctggtggtatgataggcggcggatatagcagtgcgatgttgcgcggtgcagggattactactagtgtttttgcccgttctgcttggaaagggggaaatgctattcctaatgcagttattcgtgcaaatggtgcagcattaaatcagtcttctagcgccgcaatgggaaaacatagaagataa

SEQ ID NO: 4922 - DNA, 870 bp, Neisseria meningitidis; identical to SEQ ID NO: 2799

SEQ ID NO: 4923 - DNA, 924 bp, Neisseria meningitidis
atgaaaaaacgcaataatcctcttccgctgttgaacggtgtcaaacccagttatttggtgctgccgcatgaaaagcagttttacgggctgccgctgctgcattttctgtgcatccgctttccttttgtgggcgcggacgattggcgcaggcggttgaacagcggttttgtggtcggttcggatggtgcggcgttggacgaacattctttgttcgagccgggtaaggtggtgttttattaccgtgaaaccagccgtgagagcgagccgcgtattccgtttgaagaaaagattttgcatattgatgagcatttgattgtggtggacaaaccgcattttctgcccgtcatccccagcggcaggtttttgcgggaaaccctgctcacgcgcctgcgtttgcggcctgaattgcagcatttgaatgttgaggacattacgccgctgcaccgcttggacaaggatacggcaggcgtgatgctgctgtcgcacaatcctgccacgcgcggagcctatcagacgatgtttcaaaacaaaacggtatggaaaacgtatgaggcgcttgcgccgacaaggacggatttgccgtatccgctcgatgtggtttcgcgtttggtgaggggtgagaaattttttacgacgcaagaggcggaaggcgaaccaaacgcacatacgacggtcgaactgattgaaaacaggggggaattcagcctttaccgccttacgccgcatacgggcaagaaacaccagttgcgcgtgcatatgatgggtttgggtatgccgctgttgaatgacgcgctctatcccgtgccgtctgaagcgggcagcgaggattatcggaaacctttgaagctattggcaaaaaagattgcgtttgcagatcctttgtcgggtcgggaaagggtgttttgcagcggattttgcctataa

SEQ ID NO: 4924 - DNA, 642 bp, Neisseria meningitidis
atgctgaaacccgaaaccatacacatatccggtcctgccggcattttagaaaccatccatatcccgtccgaacaagtaccggcacgcggtgttgccgtcatcaatcatcccaaccccctccagggcggaacaaacaccaacaaagtcatccaaactgccgccaaagccttaagcaaactcggcttccactgctacctgcccaaccttcgcggcgtaggcggcagcggaggcacacatgattacggacgcggcgaaacgcaagactgcctcgccgtcatcgattatgcccgcgcccaacaccccgaagcccccgaatttgccttatccggcttctccttcggcggttatgtcgccacatttgccgcacaagcgcgcacacccgatttattgctgctcatcggcgcggcagtctgccactataccgaccgtccggaaccgtccgccgttcccaacgttgccaaaacgctgatgatacacggcgcggaagacgaagtcgtcgaaatcgggaaagcactgaaatgggcggaaccgcaagatttgcccgtcattaccatcgccggttccacgcatttctttcacggcaaactcatcgtcctgcgcgacaccatcctccgcttcgcgcccgtatgcctgaacggataa

SEQ ID NO: 4925 - DNA, 792 bp, Neisseria meningitidis
atggcaagacatccctaccgccgcctgcgtcctgcaaaatccggctttcccgaagtcggcatttccgaagaaggcaatatccgttcgcttcacttgggcagcgacaccgttcaaagctcgatgaacctcgaccacccgtccgagctggtgctctcttacagccgcgcgatgatgggctggctgctgtttaccgacgctcttccgcaacatatcacccaaatcggcttgggcggcggctcgtttgcacgctggatagatacctacctgcccgacacgcgccaaaccgccgtggacatcaatccgcaggtcatcgccattgcccgcaacctgttcgagttgcctttcgagggcgagaaatttgaaattattgaagcagacggtgcagaatatatcaaagtcttccgccacaacaccgatgtgattttggtggacgggttcgacggcgaacaaatcatcgatgcgctggttgaagaaccgttcttccgagactgccgcaacgcactctcttcagacggcatattcgtaaccaactggtggagcggcgacaaacgctaccaacgcttcatcgaacggttgttgagcgtttttgaagggcgcgtcttggaacttcctgccgaaagccacggcaatgtcgcggtaatggccttccaaagcagccccaaagagcaaaacatagacaaactcaaaaaacgtgccgacaaactgagcaacgcatacggattggacttccaccgtatgcttgccggcctgaaagcgtccaaccccaacaacggcaagcatttccacctttaa

SEQ ID NO: 4926 - DNA, 792 bp, Neisseria meningitidis
atgattactgtgaacacactgcaaaaaatgaaggcggcgggcgaaaaaatcgctatgctgaccgcttacgaatccagttttgccgcgctgatggacgatgccggcgtggaaatgctgctggtcggcgattctttggggatggcggttcaggggcggaaatcgacgctgcccgtcagcctgcgcgatatgtgttatcacaccgaatgtgtagcacgcggtgcaaaaaatgcgatgattgtcagcgatttgccgtttggtgcatatcagcagagtaaggagcaggcgtttgccgccgccgccgaactgatggctgccggcgcgcatatggttaaactcgaaggcggcgtgtggatggcggaaacgactgaatttttgcaaatgcgcggtattccggtttgtgcgcacatcggtctgaccccgcaatccgtgtttgccttcggcggatataaagttcaggggcgcggcggcaaggcgcaggcgttgcttaacgatgccaaggcgcatgacgatgcgggggcggcggtcgtgctgatggagtgcgtactggcggaactggcaaaaaaggtaactgaaactgtttcctgtccgaccatcggcatcggcgcgggtgcggattgcgacgggcaggttttggtgatgcacgatatgctcggcattttcccgggtaagacggcgaaattcgtcaaaaactttatgcaggggcatgatagtgttcaagcggcggttcgggcgtatgttgccgaagtcaaagccaaaaccttccctgctgcggaacatatttttgcagattga

SEQ ID NO: 4927 - DNA, 837 bp, Neisseria meningitidis
atgcaaatcatacataccattcgagaactgcgcgcgtggcgtaaaaatgcgggaaaggtggcatttgtgccgaccatgggcaatctgcatgaaggacatcttgcgcttgtgcgtgaggcgaaaaaacgcgcggacagtgtcgtggtcagcattttcgtcaatcgcctgcaattcggtcagggcgaggatttcgacaaatatccgcgcactttgcaacaggatgcggacaaacttgccgccgaaggcattgccgttgttttcgcgcccgatgagaaagaactctatccgaacgtggaacagcgttacaacgtcgaaccgcccaatctgcaaaatgagttgtgcggcaaattccgcccggggcattttcgcggtgtggcaacggttgtttctaaattgttccacatcgtttccccggacattgcctgttttggtaagaaggattaccagcagcttgccgtgattaaaggttttgtcgaagatttgaattttgatgttgaaatagtgcctgttgatacagggcgcgcggaagacgggttggcactgtcgagccgcaaccagtatttgagtgcggcggaacgcgacgaagcaccgcgcctgtaccgcgaattaaaggctgttgccgaatccttggtgcagggcagtttggattatgcaggtttggaaaaacgtgccgtccaatccctgacagaatacggctgggtggtcgattatgtcgaaatccgccgcgccgatacgctcgaagtggcgcgggcgggagataagaaactggtggtcttggccgccgcctgtctggggacgacgcgcctgattgacaatttggaaataaaactcccttaa

SEQ ID NO: 4928 - DNA, 1845 bp, Neisseria meningitidis; identical to SEQ ID NO: 41

SEQ ID NO: 4929 - DNA, 582 bp, Neisseria meningitidis; identical to SEQ ID NO: 3819

SEQ ID NO: 4930 - DNA, 846 bp, Neisseria meningitidis
atgaatattgcggacggacggcaggcgttttccgcacctgcaaaactgaatctcgatttgaggattaccggcaggcgggaagacggttatcacaatatcgaaagcatattctgcctgatagatttgcaggataccgtatatttgaaaccgagggacgacggcaaaatcatcctgcacaatccggttgatggcatgccgcaggaagtagatttgagctaccgtgccgcatcgttgctgcaaaaatatgcgcgcaaccccgccggcgtggaaatatggctggacaaaaaaatcccgacaggggcgggtttgggcggcggaagctcggatgcggcaaccgttttgctggtgttgaaccgttggtggcagtgcggtctgacgcagcggcagctcattgattcgggcgcggctctgggggcggacgtaccgttttttattttcggcaaaaatgcgtttgcgcggggtataggcgacaggctggacgaaatggatattccgaaacagtggtatgtcatcgtcaaaccgcccgtccacgtttccactgcaaaaattttcacacacgaaagcttgacacgaaattccgcctcaagcataatgccgactttccaaaatctgcaaccgtttagaaatgatatgcaggcagttgtatttaaagaataccctgaagtttggaaagcctattccgagttgtcccgatatggatttgccttaatgacaggttccggtgcgtgtgtattcacggcgtgtcaagataggaatagcgcatacaatatataccgacaagtttcagatttgtacgaggcatatttggcagagggtctttcaaaacatcctttgttgtccgtataa

SEQ ID NO: 4931 - DNA, 984 bp, Neisseria meningitidis
atggctgcgtacgacagtttgatggtatttacaggcaatgccaatcccgaattggcacaacgtgttgtcaggcatttggacatttctttgggcaatgcttccgtatccaagttttcagacggcgaagttgccgtcgaactgttggaaaacgtacgcgggcgcgatgttttcatccttcagccgacctgtgcgccgaccaatgacaacctgatggaaatcctgacgatggcggatgcactgaagcgtgcttcggcaggtcgtattaccacagccattccgtatttcggctatgcgcgccaagaccgccgtccgcgttccgtccgcgttccgatttctgccaaactggtggcaaatatgctgtattcggcagggatcgaccgtgttttgactgtcgatttgcatgccgaccagattcaaggtttcttcgatattccggtggacaatatttatgccaccccgattctgttgaacgacatcaaacaacagcggattgaaaatctgaccgtcgtcagcccggacatcggcggtgtcgtccgcgcccgcgccgtggcaaaatccctgaatgccgacttggcaatcatcgacaaacgccgcccgaaagccaatgtggcggaagtcatgaacatcatcggcgatattcaaggtagaacctgtctgattgtggacgatatgattgacactgcaaatacgctgtgcaaagccgccgtcgccctgaaagagcggggggctgaacgtgttctagcctatgccagccacgccgtattctccggagaggcggtcagccgtatcgcctcatccgaaatcgaccaggtggtcgtaaccgataccattcctttgtctgaagcggctaaaaactgcgaccgtatccgtcaggtaacgattgccggtctgttggccgaaaccgtccgccgcattagcaatgaagaatccgtctcatatcttttcaatgaagaagtgatgacaggcagcatgttgctgccataa

SEQ ID NO: 4932 - DNA, 573 bp, Neisseria meningitidis
atgacttatgaaattcaagcctctgttcgtgaagcacaaggcactggtgcgagccgccgcctgcgtcgcgaaggccaaatccccggcattctgtacggtgaaggtcaagagcctgttgcaatcgctgtggatcacaaaaccgtattctacgcattggaaaaagaatctttccatactgcgttgattaagttgtctctgaacggtgaaaccaaagacgttatcgtccgtgatttccaaatgcacccgttccgccgcgaagttcaacacatcgacttccaagctgtgaaagccgatcaacttgtacgcatccgtgttcccctgcacatcgttaacgctgaaaattcccaagcggtcaaactgcaaggcggccgcgtatctctgttaaacacttctgttgaagtagttgctttgcctgccaacatccctgctttcttggatttggattgtgctgaagtggttgccggcgacattctgcacttgtcagacatcaaactgcctgaaggtgtagaaagcgtttccctgaaacgtaacgaaaatctggctgttgctaccgttaccggtaagaaacgctaa

SEQ ID NO: 4933 - DNA, 1170 bp, Neisseria meningitidis; identical to SEQ ID NO: 2609

SEQ ID NO: 4934 - DNA, 1527 bp, Neisseria meningitidis
atgaacacgccccttccttattccgattacctcatccgcatcctgacggcatctgtctatgatgtggcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcatgctcaaggcgtggcattgtccgcacagcgtttgggctgccgtgccgttatcgttatgccggagactacgccgaaaatcaaagtggatgcggttaaaagccatggcggcgaggtggttttgcggggcgtttcatacaacgatgcctacgattatgcgatggagttggcggaaaaagaagggttaacctatatcgcgccgtttgatgatcctgatgtgattgcgggacaggggacggtggggatggaaattgtcagccagcatcccgatccaatccgcgccgtattcgtaccgataggcggtggcggtttggcggcgggcgtggcggcatttatcaagcaggtccgtcccgaaatcaaagttatcggcgttcagaccaacgattcctgctgtatgaagcagtcggtcgaagcgggtgaaatcgtccatttgaaagatgtcgggctgttttcagacggcactgcggtcaaagtcgtcggaaacgaaaccttccgcctctgcaaagaacttttggatgaaatcattacagtcgataccgatgcggtttgcggcgcggtcaaggatattttcgatgacacgcgcagcattaccgagccggcgggcgcgttggcgttggcgggtctgaaagcctatatcgcccgagaaggcgcggaaaaccaaaccctgattgccgttaccagcggtgcgaatatgaattttcaccgtttgcgccacgtttcggaacggagcgaattgggcgagggcaacgaaggtatttttgccgttaccatccctgaagaacgcggcagcttccttaagtttgtcaatatattgggaaataggaatattaccgagttcaactaccgctacggagacgatgaaaaagcgcatatctttgtcggacttcaagcggcaggcccgcaggatttggcggttatcggcagccggttggatgaggcgggattgcccaatgtcgatttgaccaacaatgagattgccaaaatccatatccgctatatggtcggagggcggacggacaaagtagaaaacgagcgtttggtcagttttgagtttccggagcgtccgggggcattggcacgctttttgaaccatatgcagggagggtggaatattacgcttttccattaccgcaaccacggtgcggattacgggcggattttggtcggtatcgatgtgccgccgcacgatgccgccgcatttgacggtttcttggaaagtctgggatacagctatcacgaggaaacgcaaaatgccgcgtacaagctgtttcttgcctga

SEQ ID NO: 4935 - DNA, 1074 bp, Neisseria meningitidis
atgagtatcaccatccaaaacttaaacaaacacttcggcaattttcacgcgctgaaaaacatcaacctcaacgtccccaccggcaaactcgtttccctgctcggcccgtccggctgcggcaaaaccacacttttacgcattatcgccggactggaaaacgccgacggcggcaatatcctgtttgacgggcaagacgtaaccgccaaacatgtgcgcgagcgcaaagtcggcttcgtgttccaacactacgcccttttccgccatatgaacgtgtttgacaacgtcgctttcggtttgaccgtattgcccaagtccgaacgcccgtccaaaggacaaatccgcgccaaagtcgaagaattactcaagctcgtgcagctctctcatttggcaaaatcctatccgcaccaactctccggcgggcaacgccagcgcatcgccctcgcccgcgcgcttgcggtcgaacccaaactcttgcttttggacgaacccttcggcgcgttggatgccaaagtacgcaaagaattacgcacctggctgcgcgacatccatcacaacctgggtgtaaccagcattctggttacgcacgaccaagaagaagccctcgaagtttccgacgaaatcgtcgtgatgaaccacggcaaaatcgaacaaaccggcagcgccgaagctatttaccgcaaacccgaaaatgccttcgttaccgagttcctcggcgaaaccgacgcttttgaaggacgcatcgaaaaaggcttctggcattacaacggcttcgcgtggaaattggacgcgcaatacaaatggcaggaacaaaccgccaccggctatatccgcccgcacgaatggcagatcgccgccgaacacgaaacaccgatgatttgtgccgaaatcgaaaaaatccacgccgtcggcgcattgacgcatattctggtaaaacacgacaaacaggacgtacatatcacgctggcaggcagcgatgccgcgcgttacccaatcgccgaaggcaaagaattgaagctgattccgaaacaggtttatgtcttctctcaaaacgaactgattgaatattcgatttaa

SEQ ID NO: 4936 - DNA, 861 bp, Neisseria meningitidis
atgaaaccctattccgccaatcccaacctgaccgaaccgcgccggctgcgcgtgttgctgattgccgccgcgctgggctttctgctgctgatgctggtcgtgccgctcgtcgccgtgttttacgaagccttaaaaggcggttgggatttgtacctgaaatccttaaacgatcccgaagcgtggtctgccatcaaattgacgctgattaccgcgctgattgtcgttcccgtcaatgccgtattgggtgtggcgatggcgtggctgctgacccgttttgattttcgcggcaagcagttgctgaccaccctgctcgatttgccgttttccgtatcgcccgtggtggccggtttgatgttcgtcttattgttcggcgcgcatacggcattgggtggctggctcgaagcgcaaggcatacagattatcttcgccatccccggtattgttttggcgacgctgttcgttaccttcccctttgtcgcacgcgaaatcatcccgctgatgcaggcacagggcgacagcgaagaacaggcggcattgatactcggcgcaagcggctggcagatgttttggcgcgttaccctgcccaacatcaaatgggcgttactctacggcatcatcctcaccaacgcccgcgcgatgggcgagttcggcgcggtcagcgtggtatcgggacacatacgcggcgaaaccaacaccgtcccgcttttggtcgaaatcttctacaacgaatacaacttcaccggcgcattcgccctctccggcgtattggcacttttggcactggcgacgctggcggtgcagaacatcattaccaaattacaagacaaaaaactcgccgccgccgaaaggaatgcaatatga

SEQ ID NO: 4937 - DNA, 837 bp, Neisseria meningitidis
atgttagcgctcaaaacgcccggcgtactgcccggcttcaaactcagccttggtctgaccgtattgtgcctgtcgctgcttgtggtcttgccgtttgcgatgatggcggcgaaggcggcggaaatcggctggggcggcttttggaacacgattgccgagccgaacgtgttggcggcggtatggctgagcttgcggatgtcgttttatgcgatgctgaccaatgtcgtgttcggcacgctggtggcgtgggtattggtgcgttatgaattcccgggcaagggtctggcgaacgcgctggtcgatttgccgtttgcgctgccgacggcggttacgggtatcgcgttggcaaccctgtatgcgcccaacggttggataggccgttttttcgagcctttgggcatcaaaatcgcgtttacacccgtcggcatttggattgcgctggtcgtcgtcagcctgccctttatcgtccgcgccgtgcagccggtattggaagaattgtcgggcgaatatgaggaagcggcggcaactttgggcgcaagccgttggactacgtttcgccgtgtcctcttgcctgaaatcacaccggcactcttgaccggcgcgggaatgatgtttgcgcgggcaacgggggaatacggttcggtgatttttatcgcgggcaacattccgatggtttctgaaatcctgccgctgattattacgggcaagctggaacagttcgacgtgcagggcgcgtcggcggtggcgttgtttatgctgctggtttcgtttgtgattctgtttgcgctgaacgtgatgcagtgggcgttgggcaggcgttcgggcgcgaagggttga

SEQ ID NO: 4938 - DNA, 333 bp, Neisseria meningitidis
atgcagattttatcttttcaaccggacattgcggaacgtatgctggaaggtacggaaggcgagtcggtcaacgaaaacgcacaattcgtccgtacggacaacggctattggattgcgtggcatgaaggcgtagcggcactgcttgcgcccgatatgccgccgggcattccctgtttttgggtggaaggcgcggaaagccttgaagagttgtgcgtcatggtggaacgcggcgagtttgacgaagtggaagagtttgacggcgatgacgacgaatggctcgaaacggcacagggttgcgggcaccacggcgacgcttgcgcctgcggacattaa

SEQ ID NO: 4939 - DNA, 510 bp, Neisseria meningitidis
atgacaatgattttaagcattttaagcctgttttttatcatcagactgttatttttagccgtctctattaaacatgaaaaagccttgattgccaaaggggcgaaacaatacggaaaaaccaattccacgctgcttgcggcagttcatacgctttattatttggcgtgttttgtttgggtatggctttctgacactgcttttaatggcatatccttgattggtacgctgacggtgatggcttcgtttgtgatattgtcattgattattaagcagttgggggagatttggacggttaaaatctatattttaccaaatcatcaaattaatcgttcgtggttgtttaaaacattccgccaccccaattattttttaaacatcatacccgaactgattggcatcgccttattatgtcaagcgtggtatgttttattgattggcctgcccatttatttgctggtcttatttaagcgtatccgacaagaagaacaggcgatggcaacacttttttaa

SEQ ID NO: 4940 - DNA, 588 bp, Neisseria meningitidis
atggaacataagctgccgcaactgccttatgaactggacgcattgtccccgcatctgagcaaagagactttggagttccactacggcaaacaccatcaaacctacatcaccaacctgaacaatcaaatcaaaggcaccgaatttgaaaacctgcctttggaagagattgtgaaaaaatcttcaggcggcgtgttcaacaacgcggcacaaacttggaaccacaccttctactggctgggtttcacgtccaaaggtcaaggcaaacctgccggcgaactggccgccgccatcgacgcgaaatggggcagcttcgagaaattccaagaagcgttcaatgcctgcgcggccggtactttcggctccggttgggcgtggctggtaaaaacccctgccggcggattggatttggtttctacttccaacgccgctacgccgctgaccactgaaaacacgccgctgctgacctgcgacgtgtgggaacacgcctattacatcgactaccgcaacagccgtcccaactacctgaaaggtttttgggaaatcgtcaactgggacgaagtcgccaaacgttttgccgccttgtcctga

SEQ ID NO: 4941 - DNA, 1407 bp, Neisseria meningitidis
atgaacgattacgcagccatgccgtctgaagaccgtgaggtcggcgcattgtctctgcccccacactcaatggaggcggaacaatccgttttgggtgggttgatgctggaaaatccggcatgggacaggattgccgatgtggtttccggtgaagacttctaccggcatgaacaccgcctgattttccgatccattgccaaattgattaatgagagccgtcccgccgatgtgattacggttcaggaagatttgcagcggaacgaagaattggaagcggcaggcggattcgaatatctgattacgctggcgcaaaacaccccgtctgccgccaacatccgccgctacgccgaaatcgtgcgcgagcgttccattatgcgccaactcgccgaagtggggacggaaatcgcccgcagcgcatacaatccgcaaggcagggacgcggggcagcttttggacgaggcggaaaacaaagtattccaaatcgccgaaagcaccgccaaatccaagcagggctttttggagatgcccgatttgctgaaagaagtcgtacagcgcatcgatatgctctactcgcgcgacaatcccgatgaagttaccggcgtgccgacggggttcatcgacctcgacaaaaaaacctcgggtctgcaacccggcgacctgattatcgttgccggtcgtccgtctatgggtaagaccgccttttctatcaatatcgccgaacacgttgccgtagaaggcaggctgcccgttgctgttttctcgatggaaatgggcggggcgcaactggtcatgcgtatgctcggctcggtcggacggttggatcaaagcgttttgaaaaccggcaggctcgaagacgaacactggggtcgcctgaacgaagcagtcgtcaaactctccgacgcgcccgtgtacatcgacgagaccccgggtctgaccgcgctcgaactgcgcgcccgtgcccgccgtctcgcccgtcaatttaacaataagcttggattgattgtcatcgactacctgcaactgatggcaggatccggccgttccgacaaccgagcttcggagctgggagagatttcacgttcgctcaaagcgttggcgaaagaattgcaagtccccatcatcgccctgtcgcaattgagccgcacggtcgaatcgcgtaccgacaaacgccccatgatgtccgaccttcgcgagtccggcgcaatcgagcaggatgccgacctgattatgttcatgtaccgcgacgaatactacaaccaggactcacccatgaaaggccttgccgaatgtatcatcggcaaacaccgcaacggtcccgtcggtaaaatcttcctcacatggacgggacaattcaccaaattcgacaatgctgcctatattcccgaggaggcaaagatagaggattaa

SEQ ID NO: 4942 - DNA, 669 bp, Neisseria meningitidis
atgtgtacacgaaaacaacaaggtttcacgctaacagagctgctcatcgtgatggtcattgcagccattatggcgatgatagccctccccaatatgagccaatggattgcatcccgccgcattgccagtcacgcggagcggattgccaaccttttgcgtttctccaggggcgaagccgtccggctcaatctccctgtctatatctgtcctgttcaagttaaaaaagacggtacgcccaacaataaatgtgactccggcaagaaggggcagggaatgttggctttcggcgacaaaaacggcaataagggatatgacaatgatacggaggatgttcttctccgcagtgtggtattgaatgatgatatcaatgataagcggattaattatgccttcaaccatatcgctttcggtcagactcagccgaccaccgaccgtgtagtttggacattcaatcaaaacgggacgttcggttatacgaaagaccagcatcttacaaaacaatccagctttttttattctgacggttatatccaaatcgtgttgacagatgcgaaggcggtttctgccgatgaaaagaaattccgttcggcggtggttttgattaacagcagcggcagggtcgaagtttgccctaggggtgatcggcgtactatgtgccagtataaataa

SEQ ID NO: 4943 - DNA, 615 bp, Neisseria meningitidis
atgaatatgaagaataatgattgcttccgcctgaaagattcccagtccggtatggcgctgatagaagtcttggttgctatgctcgttctgaccatcggtattttggcactattgtctgtacagttgcggacagtcgcttccgtcagggaggcggagacacaaaccatcgtcagccaaatcacgcaaaacctgatggagggaatgttgatgaatccgaccattgattcggacagcaacaagaaaaactataatctttacatgggaaaccatacactatcagctgtggatggcgattttgcgattgatgccatgaaaactaaggggcaattggcagaggcacaattgaagagatttagttatgagctgaaaaatgccttgccggatgcggcagccatccattacgccgtctgcaaggattcgtcgggtaacgcgccgacattgtccggcaatgctttttcttcaaattgcgacaataaggcaaacggggatactttaattaaagtattgtgggtaaatgattcggcaggggattcggatatttcccgtacgaatcttgaggtgagcggcgacaatatcgtatatacttatcaggcaagggtcggaggtcgggaatga

SEQ ID NO: 4944 - DNA, 942 bp, Neisseria meningitidis; identical to SEQ ID NO: 1937

SEQ ID NO: 4945 - DNA, 594 bp, Neisseria meningitidis; identical to SEQ ID NO: 1947

SEQ ID NO: 4946 - DNA, 489 bp, Neisseria meningitidis; identical to SEQ ID NO: 339

SEQ ID NO: 4947 - DNA, 240 bp, Neisseria meningitidis
atgacggattttaggttggggtcatttattggaaaaagcagaaaccgctccgccgtcattcccacgaaagtgggaatccagttttttgagtttcagtcattcccgataaattgccttagcattgaatgtctagattcccgcctgcgcgggaatgacgaacctatccgtacggaaacctgcaccgcgtcattcccacgaaagtgggaatccagttttttgagtttcagtcattttcaataa

SEQ ID NO: 4948 - DNA, 423 bp, Neisseria meningitidis
atgctgattgggctgctgccttgggcattaatactcggtatgcagggcggacaaaaaggcatgagctggctggaaatgttgttgatgaccagtatgaacttcgccggcggctccgagtttgccacggtcaacctgtgggcggaacctctgccgatactgcttatcgccaccgtaacctttatgattaattctcggcatatcctgatgggggcggcgcttgccccgcacctgaaaggaataccgctgaaaaaagccgtgcccgcactgttttttatgtgtgatgaaagctgggcgatggcattctccgaaatccaaaaacggaaagcagccggtttgcccgcattcaatatgcctttttatagtggattaacaaaaaccagtacagcgttgcctcgccttagctcaaagaaaacgattctctaa

SEQ ID NO: 4949 - DNA, 453 bp, Neisseria meningitidis
atgaatattgaagtagaaatgaaagtattggacgaacggatggcggatgttgtccctgtctatgcaacggagggttctgcaggtttagatttgcgcgcctgtttggatgaggaagtcgttttgcagccgggtgaaacgtttcttgtgccgacgggtttggcaatttatttggcgaatcccgcatatgccgccgttttgctgccccgttccggcttggggcataaacacggcattgttttgggcaatttggtcggtttgattgactccgattatcaaggggaattgaaggtgtcgttatggaacagaagcagcgaaccgtttactgtcaaaccgtttgagcgtatcgcgcagatggttgtcgtgccaatcgtgcaggcgggcttcaaacgtgtcgaggagtttgtcggaagcagccggggtgagggcggcttcggcagtacgggttctcactaa

SEQ ID NO: 4950 - DNA, 1188 bp, Neisseria meningitidis
atgaataccttactcaaccaactcaaaccatatccctttgcccgactgcgtgaagcgatgcagggcatttccgcgcccgaaggtctggaagccgtccccctgcacattggcgaaccgaaacatccgacaccgaaagtcattacggatgcgctgaccgcctcattgcacgagttggaaaaatatccgctgacggccggtctgcctgaactgcgtcaggcgtgtgcaaactggttaaaacgccgttacgatggcttgacagtggatgcggataatgaaattctgccggttttaggcagtagggaggcgttgttttcttttgttcaaaccgtgttgaaccctgtttcagacggcatcaaacccgcaattgtcagcccgaatcccttttatcagatttacgaaggtgcgacacttttgggcggcggtgaaatccattttgccaattgccccgcgccgtctttcaaccccgattggcgcagtatttccgaagaggtttggaaacgcaccaaactggtgttcgtctgctcgcccaacaaccccagcggcagcgtgctggatttggacggctggaaagaagtttttgatttacaggataaatatggtttcattattgcctcggatgaatgctattccgaaatctatttcgacggcaacaaacctttgggctgcctgcaagccgctgcacagttgggtcgaagcaggcaaaaactgcttatgttcaccagtttgtccaagcgttccaacgttccgggcctgcgttccggttttgtcgccggcgatgccgaactgcttaaaaactttctgctttacagaacctatcacggcagtgcaatgagtattcccgtgcagcgcgcaagcattgccgcttgggatgatgaacagcacgttatcgacaaccgccgtatgtatcaggaaaaatttgagcgcgttattcccattttgcaacaggtatttgacgttaaattaccggatgcctcgttttacatctggttgaaagtccctgatggcgacgatttggcacttgcacgcaatttatggcaaaaagcggctatccaagtattgcccggacgttttttggcgcgggataccgaacagggcaatcccggggaaggttatgtgcgtatcgctttggttgccgatgtcgcaacttgtgtcaaagctgcggaaaccattgtttccctatatcggtaa

SEQ ID NO: 4951 - DNA, 780 bp, Neisseria meningitidis
atgttttttgtcctttcccctgcgaagaaccttaatgaaaaagaccctgcccctgtcagcgagtttacccaacccgacctgctggcagagtccgacattctaatgcagcagttgcgcgagcttgcgccgcaacagattgccgaactgatgcacgtttccgacaaaattgccctcttaaacgcgcagcgcaatgcagaatggaacacgccgtttacgccggaaaacgccaaacaggcggtctttatgttcaacggcgatgtttacgaaggtatggatgcaaacacattggatattggacagatacgctatctgcaaaaccatgtccgcctgctgtccggtctgtacggtcttcttcgcccgttagacctgatacagccctatcgtttggaaatggggacggcatttgccaatttgcgcggcaagaatttgtatgagttttggggcgacatcattaccaaccttttaaatgatacgcttgcccaagcaggcagcaatacgcttgtcaaccttgcctcacaggaatatttcaagtccgtcaacacgaaaaaacttcgggcgcggctgattaccccaatatttaaagacgaaaaaaacggtaaatataaaatcatcagtttctatgccaagcgcgcgcgtggattaatggtgcgctatgcggcagaacatcatattaccgaccctgaaatgctgaaaaattttaattacgaaggctacgcattcaatgacgcggcttcaaatgaaagcgaatgggtttttatgcgttcggaacaaataaagtga

SEQ ID NO: 4952 - DNA, 1073 bp, Neisseria meningitidis
atggcgaaaatcattacgccgctgtcggcaaatcaggttaaaaatgcgaagccgcgcgataagctgtataagttgtcagacggggcgggctggctttgtgggtctacccgacgggcgggcggagttggaagctgtcgtttgtgcaggatggaaggcagcagacaatttcgctggggcggtatcctgatttttcgctggccgatgcgcgggaatggcgggaggaggtgcgccgaaaacgggcgcacggggaaaatgtcgtcaataagaaggtgcgggcggattttgcttttgagaaggtggcgcgtgattggtttgtgcgttggtcgaaggggcggtctgaaaagtatgccggacaggttatgcggaattttgagcggtgggtttttccggctatcggcaatcttgatattcgtcaaatcaggacggcggatgtggtcggctgtctgcgtgtgatggaggcgcgcggtatcgttgatacgttgcgcaaaacgaaaaacagtctgaagatggtgtttgcgtttgcggtcggttcgggaatgatggaaatcaaccctgtcgcgcaaatcggttcgggtgtgtttgaacgggcgaaaacggggaatatggcagcgttgagtccgtctgaattgccgcgcctgattgattttttggagcagcgcaatgaatttgcggtttatgcgggcagggtgcgtatccatcctgtaacgcggctttgtatctattggctgctgttgacaatgacgcggattcaggaggcggcgttgatggagtggtcggagttggacggggaggtttggcgtatccccgccgaacggaaaaaggagcggcgggggcatgatgtgccgctgtcgcgggcgatgcagtgggtgttggatcaggcgcgggcgttgaatgtgaacgggcggtttgtgtttgaaagtgtgaattttcaagggcatatcaataaggaaagtccgcgcgtggcgatgcagcgggcggggctggatacgacggcgcacggtttgcgctcgcttgcgcgtacttatttgcgcgaggttctgaaggtggatagtattatgcggaaacgcaaataa

SEQ ID NO: 4953 - DNA, 381 bp, Neisseria meningitidis
atgcctttaaaattccaaccaagggaacgttcggttatcatgtgcgactttcgcggttatgaagaaccggaaatggtcaagaaacgccctgtcgtcgtcatagcgcgaaacaggcacaacggcaaactggtaacggtcgtacccttaagcagcacagaacctgtccctttggcggactaccaccacaaaatgagtggaaaccccttaccggacaagccgcacatccaatgttgggcaaaatgcgacatgacggcaacagtcggattggcacgattagaccgatacaaacccaaagggcgcgaccgctgcattccaataatcagtgaagaggattttcaggcgattaaaacagccgttgccaaggcattcaaactgtactag

SEQ ID NO: 4954 - DNA, 189 bp, Neisseria meningitidis
atgggcagccgcgcacgggcgacaggcgatgacaagccgtccgtgcgtgtgatggggcgcggaatgcgccccttgtcgtatctgcaaacgcctacaaatccccaatcagcctttcaatcaaggctgttttggacaaacccgcctttgccgcctcctgttccagtttggctatcgttgtgtccgccttaa

SEQ ID NO: 4955 - DNA, 357 bp, Neisseria meningitidis
atggccgaacgtaacaatgccgcccttcaagaagccataaccatagtaaacgggctggcaaaaacagacggatgcatactcgccacctatacatcggataccccggacaagaagaaagaccgtgaagccatactgacagttttaaaccagcgcgaatttgtctgtgcgggcgtattaggcggagcactgcacgagaaaatgtataaagatttcgaatactccatgctgttacgtgactgggacaacctaagcagctttatttttgaaatacgccgtatcaggagcgcaccgacggcctttcaagaatttgaagccgtagcccgaaaatggaagaaaaagcctctgaaaaccaaatag

SEQ ID NO: 4956 - DNA, 918 bp, Neisseria meningitidis
atgaacgtatctgttctcaattttggtaacacccctgtatctttccgtcaagacggttttttaaatgcaaccgccattgcatctcactttggcaagttacctaaagactacctaaaaagtgaacaaactcaacaatatatctctgcacttgctgagaatttaagcgttaggagaaaaatcctaacggaagcaaatcaaatagttatcgtgaagcgtggtggcagtgagcaaggcacatggctgcatcccaaactcgctattcactttgcccgttggcttaatccgaaatttgcggtttggtgcgatgagcagattgaaattttacttaacggcaaaatttcagacggcataaaaacagttacccccaaacccacccgcgcccttccggacggcttgaccggcgaacaaatcgaagccgtcaaaaaactgcacaacgccctgaccaaatccgcacccaaagaagcgcaggcgcgtatcgccattaccctttggtctgccgtcaaaagcaagttcggatgcagctacaaagaagtacctgccgaacagttccccgaagttttaagcgtgatgggccgcgtggcagttgaaaacggcgtgctgtacggcgaagtcctcgaccgcgaaccattgcccgcaccgcaacctgccctgcccatcagcggcaacgccctgtacgacctcgccgttgccgtcagatacggcgcgtgggccatccaaatgggcagagacgtttccctgccgctgaagcagctcggctgcaaacaggcggtaacgatgtggacggtctgggcggaaacacgcagccgcctcaaagccgccgcaaacgccctcgaagccttaaacgcacacgccgacgcggaacacgcggcaaaaatccgcccgatgctgcccgaaatccgcaacctgtcgtcggtttga

SEQ ID NO: 4957 - DNA, 285 bp, Neisseria meningitidis
atggcttttcatcacggccgccgatgccgtattacgccgcttccagaaaccgagtcattacaggagagtaaaaaaatgaacatcaacgaactgggcgcaaggatagaccgcccgaccatccgcgaactgattgcctacgcaacctgccgcaaccgccccatttcaaactcgacactgctgcgtatggaaaaagacggacggataccgtgccgtctgaaaaccccactcacatcccccgtatgggacacccgcgaagttttggaagccctggggttacagcaataa

SEQ ID NO: 4958 - DNA, 192 bp, Neisseria meningitidis
atgaacacgaatcaagatacgattccatttggcggcaaccttgtgatttgctgttcgacgggaaacggcggggacgggcggttttcttgtctgattaccgatcagataccggatttaaatcttgtcagaagcgggcaggcgttcccgatgttcatttatgagtacgaaactagagaaaaaaggaaagcctga

SEQ ID NO: 4959 - DNA, 294 bp, Neisseria meningitidis
atgaactttcaggaagaaaacgagaacatcaagaatgacatagagattaatctcttgcattccgctgaagccgacagcgtggaggcaatgatggacttggcggtttacgggctggcggcgatggttgccaaacacaacaaaacgcgcggcgagcagcttgtgttacaggcgattgccggtcatatgcggaagcttttggccgcgcttcccgaaaccgagtcattggtgcagaccgggaaggtttaccgccgacttgaagatttgatttttaaaacgtatttgccggagcagtaa

SEQ ID NO: 4960 - DNA, 261 bp, Neisseria meningitidis; identical to SEQ ID NO: 925

SEQ ID NO: 4961 - DNA, 216 bp, Neisseria meningitidis
atgaccatcacagaagaatactccatcgacatccgagtaacctcagaacaggggaaaaacgactacggctaccccaccgaacgctacggatgcgacatcatcaacacagacggggagctacttgtcggcatagagccagagtacaaaaccccctttgccgccgtcagaaaggcgctcatctgtctgacaaaagacaacctcaaaaacgctgcctga

SEQ ID NO: 4962 - DNA, 855 bp, Neisseria meningitidis
atggaaacccaagaaaacatgattaaaaccgccttacaagcagctcaaaaacctttttttgagtttgcaccgaacaatactccgcttgtattcacaccagaccaagacggtggctggagatacaaatcacaccccgaattgatgcaaaacccgtaccgcaagtgcggcaaattcctcatgcacgataccgccagtcttattaagtttgtacaaaaacacaaacaggacggcacacaaatctacattgatgccgatttcaaatcagggcgtattgatgtcaccgccgtcatcaatggccatacgcaacaagctccgggctggctcgatttttatgccgtatacaccccgcaacacactacatcggcatccaactggctgaacaacaatgcgcaccgcatgaatcagatggagttttcccatttcctgaccaacaatgcccgcaacatcgtatccaaaaatcccggtaacgaaaattccgtttacccgaccgccgccgaagtattggatttcgcgctcaatctcgagtacaccgaaaaaaccaccttcaaacaaggctatcgtgaacaggacggcagaatcaactttaccttccaatccgaagactcagggcaaacagagaaaaacctcaaaatgtttgaacgtttcggcatcgagttcaccccgcatcaaggcggtgcatcctactttgttgaagccctgttgaaattccgcatcgacaaaaacagcggcgcactcgtcctgtggtacgaattgcagcaaatcgatgctgtaatcgaacaagcggcaaaagacatttccgaagccgtacaaaaagccttccctgaaatcgacatctatttcggcgtaatcgcctaa

SEQ ID NO: 4963 - DNA, 360 bp, Neisseria meningitidis
atggaaacccaagaaaagaaatttgttcctgcctccaagcaaataccgaccgtaaatagcggctggttagaccgtgaattaggcgaagccatgagtgaagcggtgcgtgcctgccttgctcacggtaaacagtcagaaattactgtcaagctcaaaatccaaccccaaaacatccaaagcggaacggtaaaaatcagccacgatgtagcaaccaaactgcccaaagaaaaacgcgaaggcggcatcgtctttgctacacctgacggcaacatccaagccgacgatccggcacaaggaaaattgaaactcaaacaagtttccaatacgtcaagcacgttgaaaatggtcagatccaactaa

SEQ ID NO: 4964 - DNA, 201 bp, Neisseria meningitidis
atggaaaccatcaccatccctaaagaaaatttcgacgctttgctaaatctcgcaagaaccgccgtcgccctgaacgaaaattttattccaaaaataaattacggagcatccaccataccagcagccggctttgccgcacttaacgagtttggaatagcccgctccaccgtggaatctttggaaattctcaaaattaaataa

SEQ ID NO: 4965 - DNA, 525 bp, Neisseria meningitidis
atgttgctattacgacgagataatattgatagggctttcaagattgtcaaaaataggcgttttgattccccttggtggcctggtgagtacgatgccggtatgaatttccttggcgtacaaggagagttgaaggttcacgagctgcatcacagaacagcaaccctgtgctttgagtggcttggcgaagtatctgcgccgcgcagaaaagagaactacaaagacctcaagccaaatgtattgtatgactttgatggttccggtaagcattttgccaaccctgacgcaaggtatctattgcccgtcggttcaagcggcttaatcttaaaacatatccaaatcgatgacgaagacactctgttgcggctatggtgcgcacgaaatatcccaatgccacaccggctatctaaaatcccgatgcttcggcagtattatctaagcaaggcatggcacgaaatttatgctatcaaccaacacctaaggaaaacgaagctgatagttgatgtggcatacgaccccacagattaa

SEQ ID NO: 4966 - DNA, 717 bp, Neisseria meningitidis
atgacaatgcacgagacaactgacagactttttgagatagccaaagagcagggagttttaaagccggctgacatagcagagcgtctgaatatcagccaacaggctttgaaaaactgggaaagtcgtggcatagcggcaaaggcgctgcctgaagtagcaaaagcattcggtgtatctgaaacatggctgagaacaggtgaaggcagccgaaccgcgcccgtccttattgaccccgacctaccccacgaagtcaaagacatccaccgcccgatgacgtggagcagcaacgacccgctgcccgacgatgattatgttttcgtcccctacctcaaagagagctgcttcaaaggcggagtaggcacgtatgaaatccccgattacaacggctaccgcctgccgttcggcaaatccacgcttaaacgcaaaggcatcaatcccgacaacgtgttttgctgcaccctgaccggcgacagtatggaggaaaaaatcgcagaagacgcggcaattgccgtagatacgggcgaaaccgccatacgcgacggcaaaatctacgccttcgcccaggacggtatgttccgcgtgaagtacctgatacggcagcctggcaacagcgttctgatacgcagccacaacagcggtttctatggcgacgaaaacgcccccttggacagcctgaccgttatcggcagggtattttggtggagcgtgctggattga

SEQ ID NO: 4967 - DNA, 966 bp, Neisseria meningitidis
atgagccacacgcaactgacccaaggcgaacgataccacatccaatacctgtcccgccactgcaccgtcaccgaaatcgccaaacagcttaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacccccttatccgccgcaaactcagtcccgaacaagtatgcgcctacctgcgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttaggacattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 4968 - DNA, 627 bp, Neisseria meningitidis
atgggtacacatcggtttccgacgcaacagcccgcaacgcaaccagatactgaccgcaaccaagaaaaacggcaaaaccgtgtatctgcccgggctgcatccttgaggtcgtctgaaatggatattttattgaaatactggaagccggtaggtgtattgctgctaatcgtcctgatttttaccgcatggcatttcgaccgtgccgaaaaataccgcatgggacgggaggctgctgctgccgaaatctcgaatcgtctgaaagacggctatatcgagcaggcaaagcaggcgcgttctgccgagcagaaggccgctgccgcgtttgccgaacgacaaaccaaattagaagaggaaaaacaaaatgctgaaaaaactgttgccgctatgcgtcttgagcttaaccgcctgcgccactacgccgccgcccaaaatcgcaacagaaacctgcccgcaaccgctaccgccgccaccgcatctgatggcgcgtcagattcccaaggctggctattattcggacagtgcgctgaaaaatatgcaggactggcagaaacagccgacggacatgcagccgatttaagggaatggcaggcatatggtcatgcagtaagcagtcagcgtgccgaataa

SEQ ID NO: 4969 - DNA, 348 bp, Neisseria meningitidis
atgtatattcccgacaaaggcgatattttccatttgaatttcgacccttccagcggcaaggaaatcaagggcgggcggtttgcgctggctctgtctccaaaagcattcaaccgcgcaacgggattggtttttgcctgccccatttcacaggggaatgcagcagctgcacgaagcagcggcatgatttcaaccttactcggtgcaggaacggaaacgcagggcaatgtccactgccaccagctcaaatctctagactggcaaatccgcaaggcttcttttaaagaaactgtacccgattatgtattggacgatgtgctggcgcgcatcggcgccgtcttattcgattaa

SEQ ID NO: 4970 - DNA, 237 bp, Neisseria meningitidis
atgttgcgtgtccaaaaatgggggaactcggcggccgtccgactgcctgccgacatgctgaaacaattggattttaaaatcggcgacgctttggtagcggaagtacataacggcgaactccgtgtgcgtgctgcccgacgtttccgcttggcagacttgcttgccgaaatggaagaaaccccgccgcgcgtagaaggctgggaaatcttggatgatgccggcaacgaggtcgtctga

SEQ ID NO: 4971 - DNA, 492 bp, Neisseria meningitidis; identical to SEQ ID NO: 3531

SEQ ID NO: 4972 - DNA, 141 bp, Neisseria meningitidis
atgagggttttaatggctggtaaggtgcggaaacaaataaaacaaggaggttggttgtcagtaattgccctaacctccttgtttgtatctgtattcactttattttacatattcaggcacagcgtacagtttaacctatga

SEQ ID NO: 4973 - DNA, 369 bp, Neisseria meningitidis
atgatagacggcgaactggtcgcgcttatccatcaaaccgtattggcggatgaagcgggtttgaaagggcgggcggatatggcgcgcttggacggcgcattgtcgcggattgccaactggcggcagtatgaaaaccttgaggacatctacgaaatcgccgccctctatgcacaagccatagccaaagcccacgcctttcccgacggcaacaagcgcaccgcgcttttaacaatgttgacctatctggatttgcagggcatcagcattgccgccgaccaagggcttgacgacttgattgtcagtttggcggcgggagaaaccgacttcaaacagctcgccgaaaccctgcgccggctggataaggaatag

SEQ ID NO: 4974 - DNA, 132 bp, Neisseria meningitidis
atgcaaaaccaaaatacacgccccgtcaaaatcgagcttaaaggcgaagcaggcaaacgcgtactgcttgccgccgcccgccgcattgccaaaacccatcaaaaagccgtcaaggcacttgccgacaaatga

SEQ ID NO: 4975 - DNA, 960 bp, Neisseria meningitidis
atgagcaccttctttcaacaaaccgcccaagccatgattgccaaacacatcgaccgcttcccgctattgaagttggaccaggtgattgattggcagccgatcgaacaatacctgaaccgtcaaaaaacccgttacctccgagaccaccgcggtcgtcccgcctgtcccctgttgtccatgttcaaagccgtcctgctcggacaatggcacaacctctccgatcccgaactcgaacacagcctcatcacccgcatcgacttcaacctgttttgccgttttgacgaactgagcatccccgattacagcaccttatgccgctaccgcaaccggctggcgcaagacgacaccctgtccgaactgttggaactgattaaccgccaactgaccgaaaaaggcttaaaagtagagaaagcatccgccgccgtcgttgacgccaccattattcagaccgtcggcagcaaacagcgccaggccatagaagtcgatgaagagggacaagtcagcggtcaaaccacactgagtaaggacaaaaatgcccgttggacaaagaaaaacagcctctacaaactcggttacaaacaacatacacgtaccgatgcggaaggctatatcgagaaactgcacattactcccgccaatgcccatgagtgcaaacacctgtcgccgttgttggaagggttacccgaaggtacgaccatctatgccgacaaaggctacgacagtgcggaaaaccggcaacatctggaagaacatcagttgcaggacggcattatgcgcaaagcctgccgcaaccgtccgctgacggaaacgcaaaccaaacgcaaccggtatttatctaagacccgttatgtggtcgaacaaagcttcggtacgctgcaccgtaaattccgctacgcccgggcggcctatttcggactgatttgcgcccgctgccgcctaaaaggcagcccggatgcctga

SEQ ID NO: 4976 - DNA, 2226 bp, Neisseria meningitidis
atgactcaaaaatccaccattgtttatacccataccgacgaagcacccgcgctggcgacccaatcgctgctgccgattgtgcaggcttttgcccgccacgccgatattgatgtcaaaaccagcgacatttctctctccggccgtattttggcggcgtttcccgaatacctgaccgaagcgcaacgcgtacctgatgcgcttgccgaattgggcgaactggtgaaacaacccgatgcaaacgtaatcaaactgccgaacatcagcgcgtccgtaccgcaactgactgccgcgattaaagaattgcaatctaaaggctttgccgttcccgactatcccgccgacccgcaaaccgatgaagaaaaagccgtacgcgaacgctacgaccgcatcaaaggcagcgcggtaaaccctgtcctgcgtgaaggcaactccgaccgtcgcgcccctaaagcagtgaaaaactttgcgaaaaaaaatccgcacagcatgggcgcatggaccaaagactccaaaacccacgttgccaccatgcaaagcggcgacttttttcataacgaacaatctgttatcgtacctgaagcgacttccgtatccatcgtattcaccgacaaacaaggcaacaaaaaagagctgcgcgagcccgtcgccctgaaagccggcgaaatcatcgacgcgaccgtgatgagtaaaaaagccctgctcgccttccttgccgaacaagtaaaagatgcgaaagcaaaaggcgtgttgttctcgctgcacatgaaagccactatgatgaaagtgtccgacccgattatcttcggacacgccgtcaaagtattcttcgcgcctgtttttgaaaaattcggcgacaaactggctgctgccggcgtcaacgttaacaacggcttcggcaacctgcttgccaatctggacaaactggatgcggacacccgcaccgccgtcgaagccgaaatcgccgccgtttacgctgccaaccccgatttggcgatggttgattccgacaaaggcatcaccaacctgcacgttcccagcgatgtcatcgtcgatgcctctatgcctgcgatgattcgcaattccggccgtatgtgggacaaaaacggcaaagcgcaagacaccaaagccgtgattcccgacagcagctatgccggcgtttaccaagcaaccatcgacttctgccgcgaacacggcgcatttgacccgacaaccatgggtactgtgcccaacgtcggactgatggcgcaagcggcggaagaatacggctcgcacaacaaaacctttgaaatcgaagccgacggccaagtccaagtcattgatgcggcaggaaaagtcctaatgcagcacgacgttgaagccggcgacatctggcgtatgtgccaaaccaaagacgctccggttaaagactgggtacaacttgccgtcaaccgcgcccgtctgagcaacacgcctgccgtgttctggctcgacgaaaaccgtccgcacgacaagagcctgctcgccaaggttaaagcctaccttgccgaactggataccaatggcctcgacatccgcgtcctcgctcctgaagaagccgccaagttcagcttgggtcgtctgaaaaacggcgaagacaccatctccgtaaccggtaatgtcttgcgcgactacctgaccgacttgttcccaattttggaactcggcacaagcgcgaaaatgctgtctatcgttccattgatgaacggcggcggtatgtttgaaaccggcgcgggcggttctgcaccgaaacatgttcaacaattcctcgaagaaaaccatttgcgctgggactcgctgggcgaattcctcgcactcgccgtatcgtttgaacatttggcgcaaaaaaccggcaatgccaaagcccaagtcctcgccgacactttggatgcagccaccgaaaaactgctgttgaacgacaaatcgcctaaacgtaaagccggcgaactcgacaaccgcggcagccatttctacctcaccctctactgggcgcaagaattggcggcgcaagacaaagatgccgaactgaaagccgcatttacgccattggcagccgctttgaccgccgacgaagcgaaaatcgttgccgagctttccgccgtacaaggcaaagcggccgacatcggcggctactacgccgccaatcctgaaaaagccgcacaagtgatgcgtccgagcgtaacctttaatcaggcactaaacgccttataa

SEQ ID NO: 4977 - DNA, 201 bp, Neisseria meningitidis
atgccgccgcacatcaggcacagcacctccgaccgccgccaaacgcgggaaaaccatttcccccttcctttcacgccgccgcgttcaaacacgccaagatcgaacaaagcgcgaacaaagccgccaaaatatgccataatagccacgcacattccccgcgcaatgtgttccaaaagaaaaaaccaacctacaagagaataa

SEQ ID NO: 4978 - DNA, 1116 bp, Neisseria meningitidis
atgggcttgaaaaaggcttgtttgaccgtgttgtgtttgattgttttttgtttcgggatattttatacatttgaccgggtaaatcagggggaaaggaatgcggtttccctgctgaaggagaaacttttcaatgaagagggggaaccggtcaatctgattttctgttataccatattgcagatgaaggtggcggaaaggattatggcgcagcatccgggcgagcggttttatgtggtgctgatgtctgaaaacaggaatgaaaaatacgattattatttcaatcagataaaggataaggcggagcgggcgtactttttccacctgccctacggtttgaacaaatcgtttaatttcattccgacgatggcggagctgaaggtaaagtcgatgctgctgccgaaagtcaagcggatttatttggcaagtttggaaaaagtcagcattgccgcctttttgagcacttacccggatgcggaaatcaaaacctttgacgacgggacaggcaatttaattcaaagcagcagctatttgggcgatgagttttctgtaaacgggacgatcaagcggaattttgcccggatgatgatcggagattggagcatcgccaaaacccgcaatgcttccgacgagcattacacgatattcaagggtttgaaaaacattatggacgacggccgccgcaagatgacttacctgccgctgttcgatgcgtccgaactgaagacgggggacgaaacgggcggcacggtgcggatacttttgggttcgcccgacaaagagatgaaggaaatttcggaaaaggcggcaaaaaacttcaaaatacaatatgtcgcgccgcatccccgccaaacctacgggctttccggcgtaaccacattaaattcgccctatgtcatcgaagactatattttgcgcgagattaagaaaaacccgcatacgaggtatgaaatttatacctttttcagcggcgcggcgttgacgatgaaggattttcccaatgtgcacgtttacgcattgaaaccggcttcccttccggaagattattggctcaagccggtgtatgccctgtttacccaatccggcatcccgattttgacatttgacgataaaaattaa

SEQ ID NO: 4979 - DNA, 459 bp, Neisseria meningitidis
atgaaaacccaaatcagccttgctgctgccgccatcacactgctcctttccgcctgcggaggcagcggaataccttcccaacccaaaggcgaaatttccgaaaaccgcaccgccgcgttcaaatccatgatgcccgaattcacacgcatgggcaaaatggtcaaagacgaagaaccttacgatgtcgaaaaattcaaacaggcggcagcgtcgtttgccgaaagcagcaagaaaccgttcacactttttgagtccgatccgcaaggcaacggccgcgcactgcccgccgtttggtcggatggtgcaaaatttgaagccgaaaaaacaaaattcgccgccgccgtcgaaaaactcaacgccgccgcccaaaccggcaaactggacgaaatcaaagccgcctacggcgaaaccggcgcaagctgcaaatcctgccacgacagtttccgcgcgcccgaataa

SEQ ID NO: 4980 - DNA, 822 bp, Neisseria meningitidis
atggctgttttaattaccggtgcttcggcaggattcggcgaagcgatgtgccgtgcgtttgtcggggcgggataccgcgttatcggtgcggcgcgccgtgcggacaggcttcaggccttggcggatgaattgggtgctttgttttaccctttggaaatggacgtgtcgcgacgcgagtcggtggaaaacgccttaaacggcatccccgatgaattttccgacatcgactgcctcatcaacaatgccgggctggctttgggtctggacacggcggacaaggcggattttgaagattgggaaacgatgattcaaaccaatgttttgggtttgacgttcctgacgcgcaaaattttgccgcaaatggtggaacgcggcggcggttatgtgatgaatttgggttcgattgcaggcaattatgcttatgccggcagcaacgtttacggggcgaccaaggcgtttgtgcgccagttcagcctgaatttgcgcgcggagttggcggataagaacatccgcgttaccaatatcgagccgggtttgtgcggcaatacggagttttccaatgtgcgcttcaaaggcgatgacgagagggcggcgggcgtgtatgagggtgtggaatttatccgccccgaagatattgcggaaaccgcattgtggctgtaccagcggccggcgcatatgaatgtgaacacgattgaaattatgcccgtggcgcagacttttgcaggaatgaaagtgataaaaaaagccgtgcccgaagtgcgggaagactttgaaaaacagagtatgtcgctgttttcccgcatcaggtcctggttcaaatga

SEQ ID NO: 4981 - DNA, 447 bp, Neisseria meningitidis
atgcagcacgaagaaggcaaccgccaacgccctcaaggcgaactgctcctgcgtaccgtcgctatgccgcgcgataccaatcccaaccaagacattttcggcggctggattatgtcgcagatggatttgggcggcggcatattggcggcggaaatcgcgcggggacgcatcgttaccgtcgccgttcaggaaatgaacttcatccgcccggtcaaggtcggcaacgtcgtctgctgctacgggcattgcgtccgcgtgggcaacacttccctccagcttaaagtcgacgtctgggtgaaaactttgatgaacgattgcgttaccgaagaccgctacctcgtaaccgaagccgtgttcacttatgttgccatcgatgcggaaggcaatccgcgcccgattccgaaagaaggcaaccccaaattggcgggcttattgcctactccgtaa

SEQ ID NO: 4982 - DNA, 827 bp, Neisseria meningitidis
atgaatccagcccccaaaaaaccttctcttctcttctcttctcttctcttctcttctcttctcttctcttctcttctcttctcttctcttctcttctcttctcttccgcagcgcaggcggcaagtgaagacggcagccgcagcccgtattatgtgcaggcggatttagcttatgccgccgaacgcattacccacgattatccgcaagcaaccggtgcaaacaacacaagcacggtaagcgattatttcagaaacatccgtgcgcattccatccacccccgggtgtcggtcggctatgatttcggcggctggagaatagcggcagattatgccagttacagaaaatggaaagaaagtaattcttctactaaaaaagttactgaagagataaacaacaactacaaagaaacccaaacaaaacatcagggaaacggcagcttccacgcctcttcttctctcggcttatccgccatttacgatttcaaactcaacgataaattcaaaccctatatcggcgcgcgcgtcgcctacggacacgttaaacatcaagttcattcggtggaaaccaaaaccacgattgttacctctaaaccaacgcaaggcgctgcacagggaggtcctattatacaaactgatcccagcaaacctccctatcacgaaagccacagcatcagcagcgtgggtcttggtgtcatcgccggtgtcggtttcgacatcacgcccaagctgaccttggacaccggataccgttaccacaactggggacgcttggaaaacacccgattcaaaacccacgaagtctcattgggcatgcgctaccgcttctga

SEQ ID NO: 4983 - DNA, 933 bp, Neisseria meningitidis
atgtatgagataaaacagccttttcatagcggatacttgcaggtgtctgaaattcatcaaatttattgggaggaatcgggcaatcccgacggtgtgccggttatttttttacatggcgggccgggcgcgggggcttcgcctgaatgtcggggttttttcaatcccgatgtgttccgcatcgtcatcatcgaccagcgcggttgcggacgttcgcgcccgtatgcttgtgcggaagacaatacgacttgggatttggtggcggatattgaaaaagtccgtgaaatgctgggtatcgggaaatggctggtgttcggcggttcgtggggcagcactttgtcgctggcttatgcccaaacccatcctgaacgggtaaagggattggtgttgcgcgggatatttttgtgcaggccgtctgaaacggtgtggctgaacgaggcgggcggtgtgagccggatttatccggaacaatggcaaaaatttgtcgcgccgattgctgaaaatcggcggaaccggctgattgaggcgtatcacggattgctgtttcatcaagatgaagaagtgtgcctgtctgccgcgaaggcttgggcggattgggaaagctatctgatccgtttcgagccggaggaagtggatgaagatgcttatgcctcgctggcaatcgcgcgtttggaaaaccattattttgtcaacggcggttggttgcagggcgatagggcgattttgaacaatatcggcaaaatacggcatatcccgactattatcgtacaggggcggtatgatttgtgtacgccgatgcagagtgcgtgggcgctgtcgaaagcctttcccgaagcggaattgagggtggttcaggcagggcatcgtgcgttcgatccgcctttggtggatgcgttggttcaggcagttgaggatattttgccccatttgttgtaa

SEQ ID NO: 4984 - DNA, 1197 bp, Neisseria meningitidis
atgccgtccgaaccgttcggacggcataacgcaacaaacactttaatatccatcacacaggatgacacgatgacccatatcaaacccgtcattgccgcgctcgcactcatcgggcttgccgcctgctccggcagcaaaaccgaacagcccaagctcgactaccaaagccggtcgcaccgcctgatcaaacttgaagtcccacctgatttgaacaaccccgaccaaggcaacctctaccgcctgcctgccggttcgggcgccgtccgcgccagcgatttggaaaaacgccgcacacccgccgtccaacagcctgccgatgccgaagtattgaaaagcgtcaaaggtgtccgcctcgagcgcgacggcagccaacgctggctcgttgtcgacggcaagtctcctgccgaaatctggccgctcctgaaagccttttggcaggaaaacggcttcgacatcaaatccgaagaacccgccatcggacaaatggaaaccgagtgggcggaaaaccgcgccaaaatcccccaagacagcttgcgccgcctcttcgacaaagtcggcttgggcggcatctactccaccggcgagcgcgacaaattcatcgtccgtatcgaacagggcaaaaacggcgtttccgacatcttcttcgcccacaaagccatgaaagaagtgtacggcggcaaagacaaagacacgaccgtatggcagccctccccgtccgatcccaacctcgaagccgctttcctgacgcgctttatgcaatatttgggcgttgacggacagcaggcggaaaacgcatcggcaaaaaaacctacccttcccgccgccaacgaaatggcgcgtatcgaaggcaaaagcctgattgtctttggcgactacggcagaaactggcggcgcaccgtgctcgccctcgaccgcatcgggctgaccgtcgtcggtcaaaacaccgaacgccacgccttcctggttcaaaaagccccgaacgaaagcaatgcagttaccgaacaaaaacccggcctgttcaaacgcctgctgggcaaaggcaaagcggagaaacctgccgaacagccggaactgattgtctatgcagaacctgtcgccaacggctcgcgcatcgtcctgctcaacaaagacggcagcgcatatgccggcaaagacgcatccgcattattgggcaaactccattccgaactgcgttaa

SEQ ID NO: 4985 - DNA, 876 bp, Neisseria meningitidis
atgttacaaggtagcttggttgccctgattaccccgatgaatcaagacggcagcatccattacgaacaactccgcgacttaatcgactggcacattgaaaacggcacggacggcatcgttgccgtcggcacgacaggcgaatccgccaccctctccgtcgaagaacacaccgccgtcatcgaagccgtcgtcaaacacgttgccaaacgcgtccccgtcatcgccggcacaggggcaaacaacaccgtcgaagccatcgccctttcccaagccgccgaaaaagccggggcggactacaccctctccgtcgtcccctattacaacaagccctcccaagaaggcatttaccaacatttcaaaaccatcgccgaagccacttcgattccgatgattatctacaacgtgcccggccgtaccgtcgtcagcatgactaacgacactatcctgcgccttgccgaaatccccaacatcgtcggcgtgaaagaagccagcggcaacatcggcagcaacatcgaactcatcaaccgcgcgcccgaaggcttcgtcgtcctttccggcgacgaccacaccgccctgccgttcatgctctgcggcggacacggcgtgattaccgtagccgccaacgccgcgcccaagctctttgccgatatgtgccgcgccgcgcttcaaggcgatatcgcccttgcacgcgaactcaacgaccgactgattccgatttacgacaccatgttctgcgaacccagccccgccgcaccgaaatgggcggtatccgccctgggcagatgcgaaccgcacgtccgcctgccgctcgttccgctgacggaaaacggacaagcaaaagtccgcgccgccctgaaagcctcaggacaactttaa

SEQ ID NO: 4986 - DNA, 1392 bp, Neisseria meningitidis; identical to SEQ ID NO: 2521

SEQ ID NO: 4987 - DNA, 753 bp, Neisseria meningitidis
atggcaaaccaaagacccatctacggcttccacgccgtcaacgcccgattgtggcaaaaccccaaatccatcgtcgaactctacatccaagaaggcaaatcagacgcacgcacgcgcgaagtgttggaaaaggcggcaaacgaaaacatccgcgtatattttgccgatgccgaccgcctcaacgccatcagcaaaggcgcgcgccatcagggcgtggtcggatttatcgatgcctccaaaaaccacgtccacctcgaagacgtattggaaaacctcagcgaaccgccgctgctgctgatactcgacggcatcaccgatccgcacaacctcggcgcgtgcctgcgtaccgccgacgcaatgggcgtacacgccgtcatcgcaccgaaagacaaaagcgcggggctgaacgccaccgtcagcaaagtcgcctgcggtgcggcggaaaccgtcccctatatcaccgtaaccaacctcgcccgcaccctgcgcgaattgaaagaatacggcatttggattatcggcaccgatatgagcggcgagtccgacctttaccattgcaatctgcccgacagcgcggcgtgggtaatgggcaacgaaggcgacggtatgcgccgcctcacgcgcgaacattgcgacatgctggtgtctatacccatgttcggcacagtcgaaagcatgaacgtctccgtgtctgccggaatggtattaagtgaaacacgccgacaacgcgtattaaaaaacgaaaaagtataa

SEQ ID NO: 4988 - DNA, 489 bp, Neisseria meningitidis
atgaccgtactgaccgtcatcctcgccctcgccctgatagccgtcggcacggcgggcatcgtttaccccgccctgcccggattggcattgatgtttgccggaacatggctgcttgcctatgccggcggctaccaaatctacggcgcgggcgttttgtggacggtcggactcatcagccttgccggcatactggcggactatgtggcaggcatatgggggacaaaatataccggagcgggcaagctcgccgttcgcggcgcattggccggcagcatcatcggcatatttttctcccttcccggactaatactcggtccctttatcggcgcggcggcaggcgaactgatcgaacggcgcaatatgcttcaggcaggtaaagcgggcttgggtacgctgttggggcttgtcgtcggcacggcgttcaaaatcggctgcgccgtatccatcttgtttatcctgttggtgaaatacatcgcctacctgttttaa

SEQ ID NO: 4989 - DNA, 720 bp, Neisseria meningitidis
atgctgaccacaccgccgctcgcccccaaaaccgtcgccgccctgcacaggctcggtatccgtacactcgaagaactgcggcaaaacggttcggtcaaagcctttctgctgctcaaagcatcgggtttgaccctcacgaaaagcacactgtggcaactcgagtcgctgctggacggcacgccgccgcaagaaatgtcccaagcgcataaagcccgcctgcttgccgagttaaaaaaccatccgcccgtcgccgcctttccgccgcaggaagaaatggaacacttcatgtgcgaagcactgcgccaagcagaacaatcctccgccgacggcgaaatacccgtcggggcagtcatcgtttcagacggcaaaatcatcgcatcggcacacaacacctgcattgccgactgcaatgtcagccgacacgccgaaatcaacgccttggcacaggcaggcagagaaatacaaaactaccgccttgacggatgcgacatatatatcaccctcgaaccctgcgccatgtgcgcgtccgcactgatacaggcacgaatcaggcgtgtgatctacggggcggcagaacccaaaaccggcgcggcaggcagcatcgtcaacctgtttgccgacaaacgcctcaatacgcacaccgccatacggggcggaatcctgcaagaagaatgccgcgccgtgttaagccgtttttttcaaaacaaaagaaaaggttga

SEQ ID NO: 4990 - skipped

SEQ ID NO: 4991 - DNA, 942 bp, Neisseria meningitidis
atgccgaccccgaaagcctttgccctgctcgggccgaccgccggaggcaaaaccgcgctcgccctcaaaattgccgaaaccctgcctgtcgaaatcatcagcctcgattccgcgctggtttaccgcgatatggacatcggcacggcgaaaccgtccgcctccgaacgcgcctttgtcccgcaccaccttatcgacatcatcccgcctaccgaatcatacagcgccgcccgctttgtcgaagactgcacgcgcttggtcggggaaatttcctcacgcggcaggtttgcccttattgtcggcggcacgatgatgtatttccgcgccctgacccaaggtttgaacgatttgcccgaagccgacgcctgcctgcgtgccgacttggacgaacaaaaacagatgtacggcttggatttcctctaccgcaccctgcaaaaagtcgaccctgaaaccgcatgccgtctgaaaccgaacgacagccagcgtatcggacgcgctttggaagtttattatttaaccggcaaaccgatgagcacacatctcggcagcctgacctcccatacgctcccttttgatttgcataccgccgccctgattcccgaaaaccgtgcccgcctgcatgaaaacatcgccctgcgtttccacctgatgcttgaacagggctttatcggcgaagtagaaaacctgcgccgccgctatcccggcctgaccgcctactcccccgccatccgctgcgtcggctaccgtcaggcatggaaatatctggatggaaaaaccgatttcccggcatttgtcgagaaaggcattgccgccacccgccaacttgccaaacgccaactgacttggttgcgcaaaacacctttagactgcgttgccgacccgttttcagactgcacttcatgcacacgcctgattgaggcggcaaaacggtttttcggcgcataa

SEQ ID NO: 4992 - DNA, 1305 bp, Neisseria meningitidis
atggacattctcgtcttgcgggtagatgtgccaaaagaagggtttgcccgcaagctgggcgcgcacgaaactgtcttcgccgcggatgacggcgcagtcggcaaggtgcagcagttggtcgaagtcctgttgcggcacgaaagggattttgacgaggcggacggatgccgtctgaaaaacatcgccgtcgttttgcagggcatcttgcggaataacgccgctttgtttgaggctgtcgatgatttgcgtccccgccagcaacagtgtcatcgggctgcctgcctgtcgccacatttccagccactttgcccaaacatcgctccgatagccgaaaagcagccattcggaggcgtttttttcgggcagcatcagccgctctcgcagggcttcagtatcgaaacggacggcttcgcagtaatcacgttcgcgtatcaacccgccgcttttttcgctgaaacccataaaccaaaaatatttttgaacaccctcctgcggcgaaggcatcagatgcagcctttcattgctttcctccgcgctcaaatattcccaattcagccaaagcggcttgtgtcggcggataatgtgcagcacattttcgggcaggtcgcaggcaaaagtttcgatgacgacatcgggaacaggcgcggtatcaatatctgccgcatcggaatgccaagtgcggacatgaatatcctgatgaacgcagggaacatcgggcaaatcagggcaaagcgcacgcaaggcggacacatcgtccgtccacaaatgcacctgccaaccgagttcgcggtgcaaaacacgggcgagccgccacgaaacgccgatgtcgccgaaattgtcgatgaccttgcaaaaaatccaacagacaaaaggaggagtattcatagaaataacggaaacgggctaaaacgcgccaaaatagtggaacaaatacacaatcagcaaaataatcggaataaacagcaacatagtttgacgtttcaaatcaaactcttgtttcaaatgatgcttgatggtgtcgaaaaggacgaatttaaacaaaaacgtcgcttcgcaggcaaggatgatgccgttgatcagatgctggagtttgtcttcgggcggattggcggcgaaaacggcaagcgtcgccaacgggatgaggcagacggcaagccagcggacaagcaggtttcgggacattgcaaggctttcaaaaaagcaaaacgccattatcgccccaagcgcacgccttgtctaacggacgcaccagagatgccgtctgaagccttgccgcaggaaaacgccgcaccgccgaacctttaa

SEQ ID NO: 4993 - DNA, 561 bp, Neisseria meningitidis
atgaaaacagcacaagaactgcgcgccggcaatgtatttatggtcggcaacgatcctatggtcgttcaaaaaaccgaatacatcaaaggcggccgctcttccgccaaagtcagcatgaaactgaaaaacctgctgaccggcgcggcttccgaaaccatttacaaagccgacgacaaattcgacgtggtcatcctgtcccgcaaaaactgtacgtacagctactttgccgacccgatgtacgtctttatggacgaagaattcaaccaatacgaaatcgaagctgacaacatcggcgacgcgttgaaattcatcgttgacggtatggaagaccaatgcgaagtaaccttctacgaaggcaaccctatctccgtagaactgcccaccatcatcgtgcgcgaagtcgagtacaccgagcctgccgtcaaaggcgatacttccggcaaagtgatgaaaaccgcccgcctggtcggtggcaccgaaatccaagtgatgtcttacatcgaaaacggcgataaagtcgaaatcgacacccgcaccggcgaattccgcaaacgcgcctga

SEQ ID NO: 4994 - DNA, 837 bp, Neisseria meningitidis; identical to SEQ ID NO: 3281

SEQ ID NO: 4995 - DNA, 582 bp, Neisseria meningitidis
atgaacctgcgcgatgatttgcaactgatttacgaccggatacccgaaggcagccgcgtcttggacttgggctgcggcgacggcgaactgcttgccgcattggtcgaacacaaaaaatgcagcggctacggcatcgaaatcgacacaaatagcgtcatcgccgcgatgtcgcgcggcgtaaatgttatccaagccgatttggaagaaggtttaaccgcattcaacgatcaaagttttgatgtgattgtgttgagccaaaccatccaagcgatgcagaataccgaaaaaatcctgcgctgcctgatgcgcgttgccaaacaggcgattgtcagcttcccgaatttcggctactggcgcaaccgcgtccaaatcgcactcggcggacatatgccggtttccgaacgtatgccctaccattggtacgacacgcccaatatccattggtgcacgctcaaagactttgatttattgtgcgccaaaaacaacatccgcatcctcgagcgcgccgtgatgacgggcaacagacaggtcaaacatttccccaaccttttgggcagcctggcgttttaccgcgtcgggtaa

SEQ ID NO: 4996 - DNA, 1140 bp, Neisseria meningitidis
atgagtcaaaatgcctcggtgggcattgtaatgccccaaaaaattccgtttgagatgccgctggttttggaaaacggtaaaactttgccgcgtttcgatctgatgattgaaacctacggcgagctgaatgctgaaaaaaacaatgcggttttaatctgccacgcgctgtcgggcaaccatcatgttgcgggcaggcattcggcggaagataaatatacgggctggtgggacaatatggtcggacctggcaaaccgattgatacggaacgttttttcgtggtcggtttgaataatctgggcggctgcgacggcagcagcgggcctttgtcgattaatcctgaaacgggcagggaatacggcgcggattttccggtggttacggtgaaggactgggtaaaatcccaagccgcgcttgccgactatctcggtatcgaacaatgggcggcgattgtcggtggcagcttgggcggtatgcaggccttgcagtggacgatttcctatcccgagcgcgtgcgccatgctttagtgattgcgtctgcgccgaaactgtccacgcaaaatatcgcgtttaacgatgtggcgcgtcaggcaattttgaccgaccctgatttcaatgaaggacattaccgcagccacaataccgttcctgcacggggcttgcggattgcccgcatgatgggacacatcacttatcttgccgaagacggtttaggcaaaaaattcggacgcgatttgcgttccaacggttatcaatacggctttggtgttgaatttgaagtggaatcctatcttcgctatcagggcgacaaattcgtcggacggttcgacgccaacacttacctgctcatgaccaaggctttggactatttcgatccggcggcagatttcggcgacagcctgacccgcgccctgcaaaatgtgaaagcgaaattctttgtcgccagcttcagcaccgactggcgtttcgcacccgaacgttcgcacgaactggtcaaggcactgattgccgcccaaaaatccgtgcagtatatcgaagtcaaatccgcacacgggcacgatgcctttttaatggaagacgaagcctatatgcgtgcggtcgccgcctatatgaacaacgtttataaggaatgtcagcaatga

SEQ ID NO: 4997 - DNA, 126 bp, Neisseria meningitidis
atgcaggttctgtcttcactcaaaaccgccaaacaacgccaccgcgactgccaaatcgtcaggcgcaggggcaaagtttacgtcatctgcaaaagcaatccgcgttttaaagcgcgccaacgctga

SEQ ID NO: 4998 - DNA, 276 bp, Neisseria meningitidis
atgaaaccgaatattcatcccgacaattaccgaaccgtcctttttttcgatagcagcgccaatgaaggctggttaatccgctcctgtgccgaaacacacggaaaaacgatggtttggacagacggcaaagaatatccgctgttttcgctggatacttcttccgcatcccatcccgtctatactggcaaacagcgcaacgtcaacaccgaaggccgtgccagcaaattcaaccaacgtttccaatccgtaatgtcatcgtttagaaaggacaaataa

SEQ ID NO: 4999 - DNA, 879 bp, Neisseria meningitidis
atgaattacgcaaaagaaatcaatgcgttaaataacagcctttccgatttgaaaggcgacatcaacgtttcattcgaatttttcccgccgaaaaacgaacaaatggaaaccatgctgtgggattccatccatcgcctgcaaaccttgcacccgaaatttgtttccgtaacttacggtgcaaactcaggcgagcgcgaccgcacacacggcatcgtcaaacgcatcaaacaggaaaccggcttggaagccgcgcctcacctgaccggtatcgacgcttctcccgacgaattgcgccaaattgccaaagattattgggacagcggcatccgccgcattgtcgccctgcgcggagacgagccggccggttatgagaaaaaaccgttttacgccgaagacttggttaagctattacgctccgtcgccgacttcgacatctctgtagcagcatatcccgaagtgcatcccgaagcgaaatccgcacaagccgacctgattaatttgaaacgcaaaatcgatgcgggcgcgaaccacgtcatcacccaattcttcttcgatgtggaacgctacctgcgcttccgcgaccgctgcgtgatgttgggtatcgatgtggaaatcgtccccggtattttgcctgttaccaacttcaagcagctcggtaaaatggctcaagtaaccaacgtcaaaatcccaagctggctgtcgcaaatgtatgaaggtttggacgacgaccaaggtacgcgcaatctggtggcggcaagtatcgccatcgatatggtcaaagtcctgtcccgcgaaggcgtgaaagatttccacttctatacgcttaaccgcagcgagctgacttacgccatttgccatattttaggcgtgcgcccttaa

SEQ ID NO: 5000 - DNA, 2277 bp, Neisseria meningitidis
atgacaacattacatttctcaggcttcccgcgtgtcggcgccttccgcgaattgaaattcgcacaagaaaaatactggcgcaaagaaatcagcgagcaagaattgctggctgttgctaaagacttgcgcgagaaaaactggaaacaccaggtcgctgccaacgccgatttcgttgccgtaggcgatttcactttctacgaccacatcctcgacctgcaagtcgccaccggcgcgattcccgcccgcttcggcttcgacagccaaaacctgtctttggaacaattcttccaactggcgcgcggtaacaaagaccaattcgctatcgaaatgaccaaatggttcgacaccaactaccactacttggtgcctgaattccacgccgataccgaattcaaagccaatgccaaacactatgttcaacaactgcaagaagcccaagccctcggtctgaaagccaaaccgaccgttgtaggtccgttgactttcctgtgggtgggtaaagaaaaaggcgccgtcgaattcgaccgtctgagcctgttgcctaaactgttgcctgtttacgttgaaatcctgactgctttggttgaagccggtgccgagtggattcaaatcgacgagcctgctttggctgtcgatttgcctaaagaatgggtggaagcctacaaagacgtttacgctactttgagcaaagtaagtgccaaaatcctgttgagcacttacttcggttctgttgccgaacacgccgcattgttgaaagccctgcctgttgacggtctgcacatcgacttggtacgcgcccccgagcaactggacgcgttcgccgactacgacaaagtcctgtctgccggcgtgattgacggccgcaacatttggcgcgccaacctgaacaaagttttggaaactgtcgagcctctgcaagccaaactgggtgaccgtttgtggatttccagctcttgctcgctgctgcacactccatttgacttgtcagttgaagaaaaactgaaagccaacaaacccgacctgtactcttggttggcattcaccctgcaaaaaacccaagaattgcgcgttctgaaagctgcattgaacgaaggccgtgattctgttgccgaagaactcgccgccagccaagctgctgccgactcccgtgccaacagcagcgaaatccatcgtgcagacgttgccaaacgcctggccgatttgcctgccaacgcagaccaacgcaaatctccatttgccgaccgtatcaaagcgcaacaagcatggttgaacctacctctgctaccgactaccaacatcggttctttcccgcaaaccaccgaaatccgccaggcacgctcagccttcaaaaaaggcgaactgtctgccgccgattacgaagccgcgatgaaaaaagaaatcgccttggtggttgaagagcaagaaaaactggacttggacgtactggtacacggcgaagccgagcgtaacgacatggttgaatacttcggcgaattgttgagcggttttgcattcactcaatacggctgggtacaaagctacggctcacgctgcgtgaaaccaccgattatctttggcgacgtaagccgtcctgaagccatgaccgtggcttggtctacttacgcacaaagcctgaccaaacgcccgatgaaaggtatgttgaccggccctgtaaccattctgcaatggtctttcgtccgcaacgacattcctcgctctaccgtgtgcaaacaaatcgcactggctctgaacgacgaagtattggatctggaaaaagccggcatcaaagtcatccaaattgacgaacctgccatccgcgaaggcttgccgctgaaacgcgccgattgggatgcctacctgaactgggcgggcgaatccttccgcctgtcctctgccggttgcgaagacagcacccaaatccacactcatatgtgttactccgagttcaacgatatcctgcctgcgattgctgcaatggatgcggacgtgatcaccatcgagacttcacgttccgacatggaactcttgaccgcgttcggcgaattccaatacccgaacgacatcggcccgggggtttacgacatccacagcccgcgcgtaccgacagaagccgaagtggagcacctgttgcgcaaagccatcgaggttgtaccggttgaacgtctgtgggttaacccggactgcggcctgaaaacacgcggctggaaagaaactctggaacaactccaagtaatgatgaacgtaacccgaaaactgcgtgccgaattggcgaaataa

SEQ ID NO: 5001 - DNA, 165 bp, Neisseria meningitidis
atgaataaataccgtctgaaagcctttcagacggtattttgtcctgatttgcggcgcaagggcgcagttgccggaaaatcttttcattgcagcttgtttttttctaattcggctttatatgtgggaaacaggcaaatcggagttgtgtttgatagttttaaataa

SEQ ID NO: 5002 - DNA, 738 bp, Neisseria meningitidis
atggctttgcaagatcgtaccggtcaaaaagtaccttccgtagtattccgcacccgcgtcggcgacacttggaaagatgtgtctaccgatgatttgttcaaaggcaaaaaagtagtcgtattctccctgcccggtgcatttaccccgacttgttcttcttcacacctgccgcgttacaacgaattgttcggcgcgttcaaagaaaacggcgttgacgcaatctactgcgtatctgtaaacgatacgttcgtaatgaacgcttgggctgccgaagaagaatccgacaacatctacatgattcctgacggcaacggcgaatttaccgaaggtatgggtatgctggtcggtaaagaagacttgggcttcggtaaacgctcttggcgttactccatgctggttaacgacggcgtggttgaaaaaatgttcatcgaacctgaagaaccgggcgatccgttcaaagtatccgatgcagatactatgctgcaattcgttgctcccgattggaaggctcaagagtctgtggcaattttcactaaaccaggttgccaattctgcgctaaagccaaacaagctttgcaagacaaaggtttgtcttacgaagaaatcgtattgggcaaagatgcaaccgtcacttccgttcgcgccattaccggcaagatgactgcccctcaagtcttcatcggcggtaaatacatcggcggcagcgaagatttggaagcttacttggctaaaaactga

SEQ ID NO: 5003 - DNA, 1404 bp, Neisseria meningitidis
atgaaaaaaattcaagcggatgtcgtcgtaatcggcggcggtactgccggtatgggtgcgtttcgcaatgcccgtttacattcggataatgtttacctgattgaaaacaatgtgttcggcacgacctgcgcgcgcgtgggctgtatgccttccaaactcttgattgccgccgcagaggcgcgtcatcacgcattgcataccgacccgttcggcgtgcatttggacaaagacagcatcgtcgtcaacggtgaagaggtcatgcagcgcgttaaatccgagcgtgaccgttttgtcggctttgtcgttgccgatgtggaagagtggcctgccgacaagcgcattatgggttcggctaaatttatcgacgagcataccgtccaaatcgacgagcatactcaaattacggcaaaaagtttcgtgattgctaccggttcgcgtcccgtcatcctgccgcaatggcagtctttgggcaatcgtttgattatcaacgatgacgttttctcatgggatacgctgcctaagcgcgttgccgtgttcgggccgggtgttatcggtttggaactgggtcaggcattgcaccgtttgggcgtgaaagttgaaattttcggtttgggcggaatcatcggcggcatttccgaccccgtcgtttcagacgaggcgaacgccgtgttcggcgaagaattgaaactgcatctggatgctaaaaccgaggtcaaactcgatgcagacggcaatgtagaagtccattgggagcaggatggcgaaaaaggcgtatttgttgccgaatatatgctggcagccgtgggccgccgtccgaacgttgacaatatcggtttggaaaatatcaatatcgaaaaagatgcgcgcggcgtacctgttgccgacccgctgaccatgcagaccagtattccgcatatcttcatcgcaggcgatgcgtccaaccaactgcctctgctgcatgaagctgccgaccaaggcaagattgccggcgataacgcgggccgctacccgaatatcggcggcggtttgcggcgcagcaccatcggcgtggtgtttaccagtccgcaaatcggctttgtcggtctgaaatacgcgcaggttgccgcgcaataccaagccgacgaatttgtcatcggcgaagtatcgttcaaaaaccaaggccgcagccgcgtgatgctggtgaacaaaggccatatgcgcctgtatgccgaaaaagccaccggccgctttatcggcgcggaaatcgtaggccctgccgccgaacatttggcgcacctgttggcttgggcacatcaaatgaagatgaccgttccgcaaatgctggatatgccgttctaccatcccgttatcgaggaaggtctgcgtaccgcgttgcgcgatgccgatgcgaaattgaaagcctga

SEQ ID NO: 5004 - DNA, 378 bp, Neisseria meningitidis
atgtctgccaaaccgcgtcctgtttatctggatttgccgaacatccgtctgccgatacccgggatagtttccatccttcaccgcatcagcggggtcgggctgtttattatgctgcctttcctgctgtatttcctgtccggtaccctgagtcaagagtctgcatttgaaacttaccgtgccattgtttcccatcctttggtcaagctggttttaatcggtgtattgtgggcttatctgcaccattctctcgccggtatccgctttttatttttggatgcgcacaaaggccttgagctgaatactgcgcgcaataccgctaaagccgtatttgcttctgcattggttttgactgtcgttttgggagcgttgttatggtag

SEQ ID NO: 5005 - DNA, 342 bp, Neisseria meningitidis; identical to SEQ ID NO: 1095

SEQ ID NO: 5006 - DNA, 1764 bp, Neisseria meningitidis
atgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattga

SEQ ID NO: 5007 - DNA, 708 bp, Neisseria meningitidis
atggaaaaaatgagttttgaaatttaccgttacaacccggatgttgatgccaagccttatatgcagcgttacgagttggaattggaaccgaccgacgtgaaacttttggatgctttggtacgcctgaaagcacaagacgataccttgtctttccgccgctcctgccgcgaaggcatttgcggatcggacggtatgaacatcaacggcaaaaacggcttggcgtgtttgaccgatctgcgtggcttgaaacagccagttaaaatccgtcctctgccaggtctgcctgttatccgcgacctgattgtggatatgacccagttcttcaaacaataccattccgtcaaaccttatgttgtcaacgataatccgattgatgcggacaaagagcgtctgcaaactcaggaagagcgtaaagagttggacggtttgtacgagtgtattttgtgcgcctgctgttcgactgcctgcccgtcattttggtggaaccctgataaattcgtcggtccgtccggtttgctgaatgcttaccgtttcattgcggacagccgtgataccatcactaatgagcgtttggataatctgaacgacccataccgtttgttccgttgccacaccattatgaactgcgtagacgtatgtcctaaacacttgaatccgacccgagccatcggtaagattaaagagattatgttgaaacgggccgtttaa

SEQ ID NO: 5008 - DNA, 249 bp, Neisseria meningitidis
atgatggtttttgacgatattgccaaacggaaaatccgttttcaaacccgccggggattgttggaattagatttaatcttcggcaggtttatggaaaaagaattcgagcatttgagcgataaagagctgtccgagttttccgaaatccttgaatttcaagatcaagaattgcttgccttgattaacgggcattcggaaacggacaaagggcaccttatcccgatgcttgaaaaaatcagacgggcatga

SEQ ID NO: 5009 - DNA, 84 bp, Neisseria meningitidis
atgaggcatctgaaatctgcctgcaggcagatttcaaaatgcaaaagccgtctgaaggcaaagaacgtgctgcggatgcagtaa

SEQ ID NO: 5010 - DNA, 1284 bp, Neisseria meningitidis
atgtccaaatcaatcaaactcaacgtaccgggtcaggcaggtttggagctgccggtattggaagccagcatcgggcacgatgtggttgacattcgggggctgacaaaaaatacaggtttgttttccttcgaccccggatttgtttcaaccgcaagctgtgagtctaaaattacttacatcgacggcgatcaaggcttgctttattatcgcggataccccatcgagcagctggccgaaaagtccgattatttggaagtctgctacctgttgatttacggcgaactgccgactcccgagcaaaaggcagaatttgacaataccgtccgccgccacacgatggtgcatgaacagctgacttggttcttccgggggttccgccgcgacgcgcatccgatggcgatgatggtcggcgtggtcggcgcactgtctgcgttctaccaagacagcttggacattagcaatcccgaacaccgcaaaatcgcgatttaccgcctgatttctaaaatcccgaccattgcggcaatgtgctaccgctattcaaacggtctgccgttcaattatccgaagaataatctttcttattccgaaaacttccttcatatgatgttcgccacgccgtgtgaagactacaaacccaatcccgttttggcacgcgcgctcgaccgcatctttattttgcatgccgaccacgagcaaaacgcctcaacttcaaccgtccgtctggcagggtcttcgggtgcgaacccgtttgcctgtattgctgccggtatcgcctgcctgtggggtgcttcgcacggcggtgcgaacgaagccgtgttgaaaatgttggacgaaatcggcgatgtgtctaatgttgccgcatacatggaaggtgtgaaacaacgcaaataccgtctgatgggcttcggtcaccgcgtgtaccgcaatatggatccgcgtgccagcattatgcgcgaaacctgctatgaagttttgaaggaattgggcttggaagacagtccgaaattcaaactggcgatggaattggaacagattgcgctgaaagacccgttctttatcgaacgcaaactgtatccaaacgtcgatttctattccggcatcgtcctgtccgcgctgggcatcccgaccgaaatgtttaccgtcatcttcgccctgtcgcgcagcgtgggctggatttcgcactggcacgagatgattagcgatccttcgctgaaaatcggccgcccgcgccagctttataccggttcggaacgccgcgattatgtgccgccaggcgagaggtaa

SEQ ID NO: 5011 - DNA, 2829 bp, Neisseria meningitidis
atgatggacgaaaaactcaatttctcttacctgttcggttcaaacgcaccttacattgaggaattgtacgaggcttttttggaaaaccccgatgcggttgatgaaaaatggaagcagtatttcaccgatttgagcaaacagccggggacggttgctgtcgatgtcgcacacacaccgattcgcgaatcatttgttactttggcgaaaaagaaaattgcatctgccgttgcgggcggtgcggatgaggcaatgctgaaaaagcaagtcagcgttttacggctgatttccgcctatcgtatccaaggcgtgggtgcagcccaacttgatccgctcaaacgtatccccccgcgcgatattgaagccctcgatccgaaattccacggtctgtcagatgccgatatggcgcttcaattcaatatgggcgagggcgattttgccaatcgcggcaaactgcctttgtcccaaatcatcagcaacctcaaacaaacctactgcggccacatcgcattggaatatatctatattcccaataccgaagagcgccgctgggtacgcaattattttgaaagcgtattgtccacaccgcattacaatgccgatcaaaaacgccgtatcttgaaagagatgactgctgccgagactttggaacgttatctgcataccaaatatgtcggtcagaaacgtttcggtgtcgaaggcggcgaaagcgcgattgccggtttgaactacctgattcaaaacgccggtaaagacggtgtggaagaggtcatcatcggtatggcgcaccgtggccgtctgaatgttttggtgaacattttgggcaaaaaacccggcgatttgtttgccgaatttgaaggtcgtgccgaaatcaaactgcccagcggcgacgtgaaataccatatgggcttcagctccgatattgccacgccgcacggcccgatgcacgtttctttggcgttcaacccgtcacacttggaaatcgtcaacccggtggtggaaggttctgcgcgcgccaaacaaaaacgtttgggcgaaaacggccgcgacaaagtcttgccggtattgattcacggcgactccgcatttatcggtctgggagtcaaccaagcgacattcaacctgtctaaaacgcgcggttataccaccggcggtacggttcatatcgtcatcaacaaccaaatcggctttaccacttccgatatccgcgatacccgttcaaccgtacactgtaccgatatcgcaaaaatggtttccgccccggttatccatgtgaacggcgatgatcccgaacgcgtttgctttgctatccaagccgctttggattaccgcaaaaaattccataaagacatcgtgattgacgttgtctgctaccgtaaatggggtcacaacgagggcgatgatccgaccttgacccaaccgatgatgtacaaaaaagtatcgcaacaccccggtgcgcgtgctttgtacaccgagcaactgattgccgaaggcgtggtaacccaagccgaggctgacggttacatccaagcttaccgtgatgctttggacaaaggcgagcacgtcgagcaaacaacgttgagcaacttccaacgcacgcaaatcgactggagcaaataccaaggcaaagattggcgcgaacacatcgaaaccggtttgcctgccgcagatattgaacgtctcactgagaagtttaccgccgtaccggaaggctttgccctgcatccgactgcaaaacgtgtgattgaagcgcgtaaagccatggcatccggcaaacaggccatagattggggtatggccgaaaccttggcatacgccagcctcgtaaccaaaggtcacggcgtgcgtatttccggcgaggactcgggacgcggcacgttctcgcaccgccacgccgtattgcacgatcaaaaacgcgaaaaatgggacgacggtacttatgttcctctgcgccatatgggcgaaggcatgggcgagttcctggttatcgactccattttgaacgaagaagccgtgatggcgttcgagtacggctttgcctgctccgcacctgacaaactgaccatttgggaagctcaattcggtgacttcgccaacggcgcgcaagtgactattgaccaattcctgtcttcaggcgaaaccaagtggggtcgtttgtgcggtctgactaccatcctgccgcacggctacgacggtcaaggccccgagcactcttctgcacgcgtagaacgttggttgcaactgtgttctgagaacaatatgcaagtcattatgccgtctgaagcgtcgcaaatgttccacctcttgcaacgtcaagtcttgggttcataccgcaaaccgctggtgattttcatgtccaaacgcctgttgcgcttcaaaggtgcaatgagcccgctggaaaacttcaccgaaggttcgaccttccgtccggttatcggcgataccgcagaacgcgcaagcaacgacagcgtgaaacgcgtggtattgtgtgccggtcaggtttactatgacttggaagccggccgtgccgagcgtaaactggaagatgatgttgctattgtccgcgttgagcagctgtatccgttcccatatgacgaggttaaagctgaactggcgaaatatccgaacgcaaaatctgtggtttgggcacaagaagagccgaaaaaccaaggcgcgttctaccaaatccgccaccgcatcgaagatgttattagcgaagagcaaaaactgtcttatgccggtcgtccaagcagcgcatcgcctgcagtgggctactcaagcaaacacattgctcaattgaaacaattggttgaagacgctttggcattgtaa

SEQ ID NO: 5012 - DNA, 1182 bp, Neisseria meningitidis
atgattattgatgtaaaagtacctatgttgtctgaaagcgtatctgaaggcacgctcttggaatggaagaaaaaagttggcgaagccgttgcccgtgacgaaatcctgatcgatatcgaaacggacaaagtggttttggaagtaccttctccacaagccggcgtattggttgaaatcgtagctcaagacggtgaaaccgttgttgccgaccaagttttggcgcgcgtcgatacagctgctactgccgctgctgaagccccagccgccgctcctgcagaagctgccccagctgccgctcctgctgctacacaaaacaacgccgctatgcctgctgccgccaaactggctgccgagaccggtgttgacgtgaacgcattgcaaggttccggccgtgacggtcgcgtattgaaagaagacgtacaaaatgccgctgccaaacctgccggagccgctgctcctgctgttgcacttcctgccggcgcacgtcctgaagaacgcgtaccaatgagccgcctgcgtgcccgtgttgcagaacgcctcttggcttctcaacaagaaaacgccattctgactacattcaacgaagtcaacatgaaaccaatcatggacttgcgtgcgaagtacaaagaaaaattcgagaaagaacacggcgtgaaactgggctttatgtccttcttcgttaaagccgctgttgccgccctgaaaaaatacccggttgtgaatgcttctgttgacggcaaagacatcgtgtaccacggctacttcgacatcggtatcgcaattggcagcccacgcggtttggttgtgccaattctgcgtgatgccgaccaaatgagcattgccgacatcgaacaagcaattgttgattacgcgaaaaaagccaaagacggcaaaatcgctatcgaagatctgaccggcggtacattcagtattaccaacggcggtactttcggttctatgatgtctaccccgatcatcaacccacctcaatctgcgattttgggtatgcacgccactaaagagcgcgctgtggttgaaaacggccaagttgttgtccgtccgatgatgtatctggctctgtcttacgaccaccgtatcattgacggccgcgaagctgtattgaccttggtagccattaaagacgcgttggaagacccggcccgcctgttgttggatctgtaa

SEQ ID NO: 5013 - DNA, 1434 bp, Neisseria meningitidis
atgtctcaatatgatgtagtagtgattggtgcaggcccgggtggatacgttgccgccatccgtgccgcgcaactgggtttcaaaaccgcttgcgtcgatgcaggcgttaacaaagcaggcaatgcccctgcattgggcggtacttgcttgaacgtaggctgtatcccttctaaagccctgttgcaatccagcgaacatttccacgctgcgcaacacgagtttgccgaacacggtatcactgtcggcgacgtaaaattcgacgcggccaaaatgattgagcgcaaagatgccatcgtgaccaagctgaccggcggcgtcaaattcctgttccaaaaaaataaagtaaccagcctgttcggtacggcttcctttgccggtaaaaatggcgatgcttaccaaatcgaagtcgataacaaaggcgagaaaaccgttatcgaagccaaacacgtcatcgtagccaccggttccgtaccgcgtccgctgccacaagtcgctatcgacaatgtgaacgtattggacaacgaaggtgcattgaacctgaccgaagtacctgccaaactcggcgtgatcggttccggcgtgattggtttggaaatgggttccgtatggaaccgcgtgggtgcggaagttaccattcttgaagccgcgccgactttcctggctgccgccgaccaacaaatcgccaaagaagccttcaaatacttcaccaaagagcaaggtctgagcatcgaattgggcgtgaaaatcggcgacatcaagtctgaaggcaaaggtgtttccgttgcttacgaaactgctgctggcgaagccaaaaccgaagtattcgacaaactgatcgttgccatcggccgtattccaaacaccaaaggcctgaacgcggaagccgtaggcttggaaaaagacgagcgcggctttatcaaagtagatggcgaatgccgtaccaacctgcctaacgtatgggcaatcggcgacgtggttcgcggcccgatgttggcacacaaagccagcgacgaaggcgttgccgttgccgaacgcattgccggtcaaaaaccgcatatcgacttcaacaacgtaccgttcgtgatttacaccgatcctgaaatcgcttgggtgggtaaaaccgaagagcagctcaaagccgaaggcgtggagtacaaaaaaggtacttcaggttttggtgcgaatggtcgcgcattggcaatgggcaaagccaaaggtacggttaaagtgttggcagatgccaaaaccgaccgcatcttgggcgtacacatgattggtccggttgtcagcgaattggttaccgaaggcgtgactgcgctcgaattcttcgccagcagcgaagacatcgcccgcattatccatgcccacccaaccttgtccgaagtggttcacgaagctgcattggcggccgacaaacgcgctttgcacggttga

SEQ ID NO: 5014 - DNA, 288 bp, Neisseria meningitidis
atgaacaaagaaatagtcggtattttctttataccggcgggcatcatcagcatgtgtatggccgcattgtggcagatgtatgtgatgatgaccgaaacttatacgctcaaccgtttcaaagataaagaattggtttggcgcgtggcattgttgtttatcagtttcagccttgccgtttatctgctctgtccgaattcgcgtaaaaaaggcatcgtcttttttattctcgggggaggcggtgcagccatgtatctgctggcgcggatgtggttgcctttcagcaagtga

SEQ ID NO: 5015 - DNA, 1167 bp, Neisseria meningitidis
atgaatttacacgagtatcaggctaaagaactgctggctagctacggtttgcccgtacaaggcggtattttggcacacaacggcgaagaagccgctgcagcttacgacaaattgggcggcaaattcgctgttgtcaaagcacaagtacacgccggcggccgcggtaaagcgggcggcgtaaaagtcgttaaaagccgcgaagaagctaaagaagtggctgaaagcctgattggcaccaacttggtaacttaccaaaccgatgccaacggccaacctgtcaacagtgttttggtttgcgaagacatgtatccggttcaaaccgagctgtacttgggcgcagtggttgaccgttctacccgccgcattacattcatggcctctaccgaaggcggcgtggaaatcgaaaaagttgctgccgaaactcctgaaaaaatcttcaaagtaaccgttgatccgctggtcggcctgcaaccttgccaagctcgcgaagttgcgttccaactgggcttgaaagacaaacaaatcaacgagttcgtcaaactgatgaccggtgcgtacaaagcgtttgtcgaaaatgacttcgccctgtttgaagtcaacccgctggcagttcgcgaaaacggcgcgctcgcctgcgtggacggcaaaatcggcatcgacagcaacgcgctctaccgcctgccgaaaatcgccgaattgcgcgacaaatctcaagaaaacgaacgcgagttgaaagcttctgaatttgacctgaactatgttgccctggaaggcaacatcggctgtatggtgaacggtgccggtttggcgatggccactatggacatcatcaaactgaaaggcggccaacctgccaacttcttggacgttggcggcggcgcaaccaaagaccgcgtggttgaagcgttcaaactgattctggaagacaaatccgttcaaggcgtattgatcaacatcttcggcggtatcgtacgttgcgacatgattgcggaagccatcgtggcagccgttaaagaaatcaacgtcaacgttcctgtcgttgttcgtttggaaggcaacaacgccgaactcggcgcgaaaatcctgaacgaatcaggtctgaaactgacttctgcagacggcctgaatgacgcagccgaaaaaattgttgcagccgtaaacgcctaa

SEQ ID NO: 5016 - DNA, 891 bp, Neisseria meningitidis
atgagcgtattgattaataaagacactaaagtattggttcaaggtttcaccggtaaaaacggtactttccactccgaacaagctctggcttacggcactaaagttgtcggcggcgttaccccgggcaaaggcggtcaaacccacctgaacctgcccgtgttcaacaccatgaaagaagccgttaaagaaaccggcgcggatgcatccgtgatttacgttcctgctccgtttgtgttggattctatcgttgaagcagttgattcaggcgtaggcttggtcgttgtgattaccgaaggcgtgccgactttggacatgctcaaagccaaacgctacttggaaaccaacggtaacggaacacgtttggtcggccctaactgcccgggcgtgattactccgggcgagtgcaaaatcggcattatgccgggccacatccatactcccggccgcatcggcatcatttcccgttccggtacattgacttacgaagccgtggcacaaaccaccaaactgggcttgggtcaatcaacctgtatcggtatcggcggcgacccgattccgggtatgaaccaaatcgacgcactgaaacttttccaagaagacccggataccgacgccatcatcatgatcggtgaaattggcggtactgcggaagaagaagcagccgaatacatccaatccaacgtaagcaaacctgttgtcggctatatcgccggtgttaccgcacctaaaggcaaacgcatgggtcacgccggtgcgattatctccggcggcaaaggtactgcggaagaaaaattcgccgctttcgaaaaagccggtatcgcttacacccgcagccctgccgagttgggcactaccatgctggaagtgttgaaagcaaaaggtttggcataa

SEQ ID NO: 5017 - DNA, 1596 bp, Neisseria meningitidis; identical to SEQ ID NO: 3529

SEQ ID NO: 5018 - DNA, 2850 bp, Neisseria meningitidis
atgtgcaaccatcatccccaacattcgcacgacaacgacaccatccgcatccgcggcgcgcgcacgcataatttgaaaaacatcgatttagacattccgcgccacaaactcgtggtggtaacaggattgtcgggcagcggcaagtcgtcgctggcgtttgacacgctgtatgccgaagggcaacggcgttatgtcgagagcctttccgcctatgcgcggcagtttttgcagatgatggacaaacccgatgtcgatttaattgaaggtctgtcgcctgcaatttccatcgagcaaaaatccaccagccacaacccacgctccaccgtcggtacggtaactgaaatccacgactatctgcgtcttttatacgcccgtgtcggtaccccgtattgtcccgaacacaagctgccgctgtcgagccaaaccgtatcgcagatggtcgatgccgtattgaaactgccggaagacacgcgtgtgatgattcttgcccccaccgtgcgcgagcgtaagggcgagtttgtcgatttctttgccgacttgcaggcgcagggttttgcgcgggtgcgcgtggacggcgaggtctatcagttggacgaagtgccgaagctggaaaaaaacatcaagcacaatatcgacgtggtcatcgaccgcgtgaaagtgaaggcggacatcaagcagcggctggcggaaagttttgaaaccgcgctgcgccacggcaacgagcgtgcgctggcgatggagatggacagcggcgaagaacattggttttccgcacgtttcgcctgccccgtgtgttcgtacagcctgcccgaattagagcctcgccttttttcgttcaacaacccgatgggttcctgcccgacttgcgacggcttgggcaacaccaatttcttcgaccccgaaaaagtggtcgcccatcccgaattgtcgctggcaacaggtgcgattgacggttgggacaagcgcaaccaattctatttccaaatgattcaatcattggcgcggcattacggtttcgatgtgcaggctgcttgggaaacactacctgaaaaagtgaaaaaagttgtgctgcacggctcaggcaaagaagtcattgatttcacttacctgtccgaacgcggcaccaccttcaaccgcagccacgcctttgaaggcatcatccccaatctcgaacgccgctaccgcgaaaccgacagcgaaaccgtgcgcgaaaaactgcgcgaataccaaaaccaccgcgcctgcccaagctgcggcggcgcacgtttgcgcaaagaagcccgctacgtttacgtcagcggtgagccgttgcacgaagtttccgcctggccgctcaccaaaacccaccaattctttgaaacactggatttagacggcaacaaaaaacaaatcgccgaaaaaatcctcaaagaaatcaccgaacgcctcggcttcctgattaacgtcgggctggattacctgaatttaagccgctccgccgaaaccctctccggcggcgaagcccagcgcatccgcctcgccagccaaatcggcagcggcctgaccggcgtgatgtatgtactggacgaaccctccatcggcctgcaccagcgtgacaatgaccgcctgctggccaccctcaaacgcctgcgcgatttgggcaacagcgtgattgtggtcgaacacgacgaagacgccatccgcgaagccgatttcgtggtcgatatgggccccggcgcaggcgaacacggaggcaacgtactgattgccgacacgcccgaaaacgtcgcccaatgcgaaaactccgttaccggacaatacctcagcggcaaaaaatccattgccgtgccgtctgaacgcacgcccgtcaatcccgaccggatgctcgtcctcaaaggcgcacgcggcaacaatctcaaaaacgttacccttgagctgccgctcggtttgattacctgcatcaccggcgtgtccggcagcggcaaatccaccctgattaacgacaccctcgccaaaattaccgcccgcgaactcaaccgcgcccaagaagaacccgccccattcgacgacatccacggcctcgaacacctcgacaaagtcatcaacgtcgatcagtcccccatcggccgtactcctcgctccaaccccgccacctacaccggcctgttcacccctatccgcgaactcttcgccggcgtccccctctctcgcgaacgcggctacaacgtcggcagattctccttcaatgtcaaaggcggccgctgcgaagcctgccaaggcgacggcgtgattaaagtcgaaatgcacttcctgcccgacgtgtacgtcccctgcgaagtctgccacggcaaacgctacaaccgcgaaacgctcgaaatccaatacaaaggcaaaaacatcagccaagtcctcgacatgaccgtcgaagaagcccgcgaatttttcgacgccgtccccaccgtatcgcgcaaactgcaaaccctgatggacgtaggcctaggctatatccgcctcggacagtccgccaccaccctctccggcggcgaagcccaacgcgtgaaactcgccttggaactctccaaacgcgacaccggcagaacgctctacatcctcgacgaacccaccaccggcctgcacttcgccgacatcgccctgctgctggaagtcataggccgtctgaaaggcaaaggcaactcgatagtgattatcgagcataatctggatgtgattaaaacagcggattggattgtggacttggggccggaaggcggagatggcggggggaggattattgctaaaggtagtcctgaacaggtggcgaaagttaaggggagttatactgggaagtatttgaaggtggttttgaggtaa

SEQ ID NO: 5019 - DNA, 798 bp, Neisseria meningitidis
atgaaccgtctttacccccacccgattatcgcccgtgagggctggccgattattggcggcggtttggctttgagcctgctggtgtcgatatgttgcggctggtggtctttgccgttttgggtgtttaccgtatttgcattgcagtttttccgcgaccctgcgcgtgagattccgctaaatcctgaagcggtgttgagcccggttgacggccgtatcgtggtggtcgaacgcgcacgcgatccgtatcgtgatgtcgatgctttgaaaatcagtatttttatgaacgtgttcaacgtgcattcgcaaaaatcgcctgccgattgtacggtaacgaaagtggtctataacaaaggcaaattcgtgaatgcggatttggacaaagccagcacggaaaacgaacgtaatgcggtgttggcgactacggcttcaggtcgtgaaattacttttgttcaagtggccggtttggtggcgcgccgtattttgtgctacacccaagcaggtgcgaaactgtcccgcggcgaacgttatggctttatccgcttcggttcgcgcgtggatatgtatctgcctgtcgatgcgcaggcgcaagtggcgattggcgataaagtaaccggcgtcagcactgtattggcgcgtttgccgctgactgcgccgcaaactgaatctgagcctgaatctgagcctgctttacaaactgctccggttgaaacagcggcaaacccatctgccgaacaacggcaaatcgaggcagcggcggctaagattcaggcggctgtgcaagatgtgttgaaagattaa

SEQ ID NO: 5020 - DNA, 2277 bp, Neisseria meningitidis; identical to SEQ ID NO: 1585

SEQ ID NO: 5021 - DNA, 273 bp, Neisseria meningitidis
atgcgccctcgtgaacctggcgcagagcctcgcgttctgacaagtacgccattttgccaccttttcgaccgttcgggaacgtgccgtttttatgcactcataaattttggttatcccgcagccgaacataatgggcaaacacagcggaatctgcgtcaacatcaaccgcgcccccgaaggacggcggatacaaatggacaccgcccgatgccgcaaccgtttcatttgaaaaacttttgcctatgccctctgagtgttctcaaaatcttatga

SEQ ID NO: 5022 - DNA, 591 bp, Neisseria meningitidis
atgcttttgtttatcgacaattacgacagttttacttacaacatcgtccagtatttcactgaattggggcaggaagttgccgtgcgccgcaacgatgatattacgttggaggaaatcgaggcattgaatccgcaatatctcgttatcggccccggcccgtgttcgcccaaagaagcggggatttccgtggcggcgatgcgccatttcgccggccggctgccgattatgggcgtgtgcctcgggcatcagacgataggcgaggcgttcggcggcaggatagtccgcgccaaaacgctgatgcacggtaaggtgtcgcccgtgtcccattcgggcaagggtatgtttaagggtttgcccaatccggttacctgtacgcgttatcacagcctcgttatcgatcggaatacgatgcccgaatgtttggaagtaacggcttggactgaggacggcgagattatgggtgtgcgccataaggaatatgccgtcgagggcgtgcagttccaccccgaagccctcttgaccgagcacggacatgatatgttaaacaattttttaatcgaatttcaaaacttcaaaccgcaaaaaatctga

SEQ ID NO: 5023 - DNA, 1059 bp, Neisseria meningitidis
atgattacaccgcaacaggccatcgaacgattaatcagcaataacgagttgttttacgatgaaatgaccgacttgatgcgtcagattatgagaggacaggttctgccggagcagatagcggccattttgacaggattgcgtatcaaggttgaaaccgtttccgaaattaccgcagctgcagccgtcatgcgcgagtttgcgacaaaagtgccgctggagaatgcagaggggctggtcgatatcgtcggtacgggcggggatggcgcgaaaaccttcaatatttcgacgacttcgatgtttgttgccgcagcggcaggcgcgaaggttgccaaacacggaggccggtcggtctcttcctccagcggtgcggctgacgtggtggagcagatgggcgcaaacctcaacctgactcccgaacaggttgcccaaagtatcaggcagaccggcatcgggtttatgttcgcgcccaatcaccacagtgccatgcgccatgtcgcccctgtacgccgttcgctcggtttccgaagtattttcaacatattgggtccgttaacgaatcctgcgggcgcgccgaaccagcttttgggcgtgttccacaccgatttgtgcggcattttgtcgcgggtcttgcaacaacttggttcaaaacacgttttggttgtttgcggggagggcggtttggatgaaattacactgacgggcaaaacacgcgttgccgagctcaaagacggaaaaatcagcgaatacgacatccgcccagaagatttcggtatcgaaacccgccgcaatttggatgaaatcaaagttgccaatactcaggaatctttgttgaaaatgaatgaggtgctggaaggaagagaaggggctgcgcgcgatatcgtattgctcaacaccgccgccgccctgtatgccggaaatgtcgctgcttcgctttcagacggcatatctgccgcacgggaagccatcgattcaggcagggccaaatcgaaaaaagaggagtttgtcggttttcaaccacaacaaagatgccattttcttggaaagatggagcttgggtga

SEQ ID NO: 5024 - DNA, 90 bp, Neisseria meningitidis
atgattatggaacttttgtggcaaaacataagcacttcacgaagagaacttaccaaactgtttttatataaaaacttggggctgtactag

SEQ ID NO: 5025 - DNA, 174 bp, Neisseria meningitidis
ttgttgccaattatccgaaagaaagttaagcctgatggcattgtatacacggatacctttcgtagttatgatgtgcttgatattagtgaatttagccatttacgtaagtttaacggcattcccaaagagcatttggggctgcatttaaagaaatgccaatggcattttaaatag

SEQ ID NO: 5026 - DNA, 1425 bp, Neisseria meningitidis
atggaagataagcaagggatgacaaaggcggttgccggcgtgatgacggacgcgctagcggacggcaggaagccgacaaccgcttcaaatcttccccccttatctaacagggggggacagaaaccgaaacggcaggcagggttcaggaagtcttcgaatgttacgaaacgtacataacggacggtaaaggaaacctgttaggcgttcctcttcggcgcggtgtatcagattcggctttcattgatcaaattagcttttcatttcatgaaaaaacctttttcgataaatacggcgttcgtgtaagtcttttggaagacgaagattttattcgcgccgcgtccatgctcgccgaagaagttttcggtttcggtatctacaaagaatccaaaggttcgggcggtcgtttctatgagcgctgttggttgatgggttcggaagacgccctatacggtcgcgtccattttggcggccaacaaaataccattcttttcgaactgaccggcaccggttgcggcgtcgcaaaagaaggctgggaatcacgacttttcgcattcctgactaatgcaatccgcccaaaaatcacacgcgttgacatcgcaaaagactttttcaacggcgaatacagcccgaaccaagcccgtgaagaccgaaataaaggtatgtttacctgtcatcacgtcaaaccaaaaggcgaatgtttggggtcagattgggaagaagacgatgaagccaaaatgaccaaaggcaagacctatggtatcggctcccgtgaatcgtccaaatatgtccgcgtctatgaaaaaggcaagcagttgggcgataaaacaagcacatggacgcgatttgaaattgaattcaaagcaaaagacatcgttatccctttcgaagttttgcagaatccgggcgaatatttcggcggcgcatatccgatttgcgaacgattcgcccaaaaggcaacgcgcatacacgcggttaaggaagataaggtcatttcagccgaccgctaccttgaatgggtaaaaaaacagttcggacgtgcggcaaacggtctgaaattcatttttcccgaattggacaaagccaaactgtttgaactgattgagccgagtcatcacaagctgcccaagtctttggctcccgaagcctacgactgcgcctttttgaaagctcaagccattcatgaacagcccgcattcaaaccgtacaaagacccttactatatgtacgaatattacgagaatcttgaaaaacagcttgaacagcaaaaacacgtcaacaatgaagaaagctataacaacttcatttacgacaaattcgcaagactaccgatttcatgggcttaaagtgtctgcccgaaagacgtttaatcacacaaggaaaccaaaaaatgaacatccaacttcaaggccacatcgtcggcgttaa

SEQ ID NO: 5027 - DNA, 291 bp, Neisseria meningitidis; identical to SEQ ID NO: 4541

SEQ ID NO: 5028 - DNA, 198 bp, Neisseria meningitidis; identical to SEQ ID NO: 4540

SEQ ID NO: 5029 - DNA, 285 bp, Neisseria meningitidis; identical to SEQ ID NO: 4539

SEQ ID NO: 5030 - DNA, 279 bp, Neisseria meningitidis; identical to SEQ ID NO: 4538

SEQ ID NO: 5031 - DNA, 318 bp, Neisseria meningitidis
atgaacaagccgtttatcactcaggcgcagttggcactttataaatatcagccgtccagcaagtattttgggcaatcgatggcggttatagcgcaatctgaatttgttgaatttgcgaagattaataagtctgaaaatgttattgattgtttctcttttttctggaatagaagaattaaacatgatatttggctaatctcattttctgataattcagaaatggtaattaaagaatccctgaaagatggtcataaaatatacaaatttgaattttgcgaaattgtcgataattgcaattttgatgatgtattcgtttga

SEQ ID NO: 5032 - DNA, 396 bp, Neisseria meningitidis; identical to SEQ ID NO: 4536

SEQ ID NO: 5033 - DNA, 474 bp, Neisseria meningitidis
atgacgatgcaggtatttctgacgattcccggctatgatgttgaggcagaaatcgaaaaattcgtttggatggatgctgtgatttggcagatgccgggctggtggatgcacgagccttggacagtgaaaaaatacatagacggagtattaaccgctggacacggcaaactctaccaaagcgacggcagacacagcgtcaatccgactgagggctacggcacaggcggcttgttgcaaggcaaaaaacatatgctttcactgacttggaatgcgccgattgaggcgtttacccgcgaaggcgatttctttgaaggcaaaggcgttgatgttttgtatatgcacttccacaaagccaacgagtttttgggtatgacccgcctgccgacattcttatgtaacgatgtggttaaaaatccgcaagtggaaaaatacttggcagattatcaggcacacttggaaaaagtgttcggctaa

SEQ ID NO: 5034 - DNA, 1386 bp, Neisseria meningitidis
atgtcttcaggactcgtaacagcggcgtatatcgttgccgcaattttattcatcttctcactggcggggctgtccaaacaggaaaccgccaaacagggctgctattccggtatcgccggtatggcggtcgccctttttgtaactgttttttccgacaatacccacggactgggctggatcatcatcgccatgctcatcggcgcggcaatcggcatctacaaagccaaaaaggtggaaatgaccgaaatgcccgaactgattgccctgctgcacagcttcgtcggcctagcggcggttttggtcggcttcaacagctatatcgcgccgggcaacgtttcgcacgatatgcacaccatccatctggtcgaagtgtatttaggcatcttcatcggcgcggtaacctttaccggctcgctggtcgcattcggcaaactcaacggcaaaatcagcagcagcccgctgcaactgcccgccaaacacaagctcaacgcactggcacttgccgtatcgtttgtgttgctgctcgtatttgtcggcattgacggcagcggcttcatcctgctgattatgaccctgattgccctcgcattcggctggcacttggttgcctccatcggcggcgcagatatgcccgtggtcgtgtccatgctcaactcctactccggctgggcggccgcagcggcaggcttcatgctctccaacgacctgctcatcgttaccggcgcgctggtcggctcaagcggcgcgattctgtcctacattatgtgcaaagccatgaaccgctcgtttgtctcggtaattgccggtggtttcggcagcgacagcggcacattatcttccggcagccaagagataggggaataccgagaagtcaaagctgccgatattgccgaaatgctgaaaggcgcaaacaatgtcatcattaccccgggctacggtatggcagtcgcacaagcgcaataccccgttgccgaaatcaccgagcttttacgtaaaaacggcaccgaagtacgcttcggcatccaccccgtcgccggccgcctgcccggtcatatgaacgtactgctcgccgaagccaaagtcccctacgacatcgttttggaaatggacgaaatcaacgacgacttccccgaaaccgatgtggtcttggtcatcggtgcgaacgacaccgtcaaccccgccgcccaaaccgacccgaacagcccgattgcgggtatgcccgtgttggaagtgtggaaggcaaaagaagtcgtcgtcttcaaacgctcgatgaataccggctacgcaggtgtacaaaacccactgttcttcaacgaaaacagcgtgatgtgtttcggagatgcgaagaaaaccgtagatgacattctgtccgaactgaaaaaataa

SEQ ID NO: 5035 - DNA, 384 bp, Neisseria meningitidis; identical to SEQ ID NO: 1627

SEQ ID NO: 5036 - DNA, 1542 bp, Neisseria meningitidis; identical to SEQ ID NO: 1621

SEQ ID NO: 5037 - DNA, 834 bp, Neisseria meningitidis
atgccgcacgccctcgtcctccaatttccctccgccgcagccctgccttccgacttccccttacgcctgcccgaacctgattgcgccgatgaaaagcgtatgcgttttatcgttgaagaagggttttctttaagcgaaaaagacgcggcgttgcttggcagccgtcaaatcgaccacgccgtgttgccggatatggatttcgacgaactcggtttgattgtcagcgatatggattcgacgctgattaccatcgaatgcgtcgatgaaattgcggcaggcgtgggtttaaaaaacaaagtagcggaaattaccgagcgttcgatgcgcggcgaactcgatttcgaacagtctttacgcagccgcgtcgcgctgttggcgggattggacgaacgggttttggcggacgtttatgaaaacgttttgaagctctcgcccggtgcggaatttttgttggacgaatgcaaaaggcacgatgtgaaattcctgctggtgtcgggcggcttcacgttttttaccgaaaggctgcaacaacgcctcggcttcgaataccaacacgccaatgttttggaaattgaaaacggcaggctgaccggccgtctgaaaggcagaatcatcgacgcgcaggcaaaggcagatttgttgcgcgaataccgcagccgcctcggattgcagccgcatcaggtgttggcggtgggcgacggtgcgaacgatattccgatgctcaaagaagcgggcataggcgtggcttaccgtgccaaaccgaaagcgcgggccgccgccgatgcctgtatcaacttcggcggtttggagcgtgtacgcggcctgttcggatag

SEQ ID NO: 5038 - DNA, 1143 bp, Neisseria meningitidis
atgcacttcatacagcatacggcatacggttatggcgcggacggcgtgtacacttcgttccgcgaaggcgtggcacaggcttccggtatgcggcgcgttgccgtgctgacgctgtgcggcgcggtcgcaggcagcggctggtggttgctgaaacgtttcggcaagccgcaaatcgaaatcaaagccgccttgaaacagccgttgcaggggctgccgtttctgacgacggttttccatgttctgctgcaaatcataacggtcggactcggttcgccgctcggacgcgaagtcgccccgcgcgaaatgaccgccgcgtttgcttttgccggcggcaaacgcttgggtttggatgaaggcgaaatgcggctactgattgcttgcgcttcgggtgcgggtttggcggccgtgtataacgtgccgctcgcctccacacttttcattctcgaagccatgctgggcgtgtggacgcagcaagccgtcgccgctgcattgttaacttcagtcatcgccaccgccgtcgcgcgcatcggcttgggcgacgtgcagcaatatcatccggccaaccttaccgtcaatacttcattactttggttttccgccgtcatcggcccgatactgggcgtagccgccgtctttttccagcgtaccgcccaaaagttcccctttatcaagcgcgacaatatcaaaattattcccttggccgtctgtatgtttgcactcatcggcgtgatttccgtttggtttcccgaaattttgggcaatggcaaagcaggcaatcaactgacctttggcggattgaccgattggcaacacagccttgggctgaccgccgtcaaatggctggtcgtcttaatggcgcttgccgtcggcgcatacggcggtctgattaccccgtccatgatgctcggcagtaccatcgcctttgctgctgccaccgcgtggaacagtgtttttcctgaaatgtcctctgaaagcgcagccattgtcggcgccgcagttttcctcggtgtttcccttaaaatgcccctgaccgccatagcctttattttggagctcacctacgcccctgttgccttgctcatgccattatgtacaggcatggcaggtgcagtatgggtggcaaagaaaatgggatttaaatag

SEQ ID NO: 5039 - DNA, 1581 bp, Neisseria meningitidis
atgtcttccatcaaacgcgccctgatcagcctatccgacaagacaggcgcagtcgaatttgcccaaaccctgcacaaactcggtgtcgaaattctttctaccggcggtacagcaaaactcttggctgatgcaggcgttcccgttatcgaagttgccgactataccggttttcccgaaatgctcgacggccgcgtgaaaaccctgcatccgaaaatccacggcggtattctcggtcgtcgcgatttggacgaacacgtcgccaagatggaagaacacggcatcggcaatatcgacctcgtgtgcgtcaacctctacctcttcgctgccaccatcgccaaaccaaactgcacgctggaagacgcgattgaaaacatcgacatcggcggcccgaccatggtgcgctctgccgcgaaaaactggaaacacgtcgccatcgttaccgacaccgccgatttcccggccatagctgccgaactcgaagccaacaacggcgcattgagcgacaaaacccgtttcaacctctcgcgcaaagcattcagccataccgcccaatacgacggtatgatttccaattacctgacctcgctttcagacgacgtcttgagcggcacgcccgaaatcgccggattccccggccggttcaatcaaagctggattaaagtgcaagacatgcgctacggcgaaaacccgcatcagcgcgccgcgttctaccgcgatattgaccccgccgcaggcagcctcgctgcatacaaacaactgcaaggcaaagaattgtcttacaacaacatcgccgatgccgatgccgcatgggaagccgtcaaatccttcgacgtgcccgcctgcgtgattgtgaaacacgccaatccgtgcggcgtagccatcgcctccaataccttggatgcctacaaactcgcctacgccaccgacaccaccagcgcgttcggcggcatcatcgctttcaaccgcgaagttgacggcgcaaccgtcaaacaaattaccgacaaccagtttatggaagtcctcatggcgcctaagttcaccgccgaagccctcgaaatcgccgccgccaagaaaaacgtgcgcgtattggaagtgccgcttgaggcaggcgcaaaccgcttcgaactcaaacgcgtcggcggcggactgttggtgcaaacgcccgacatccaccgcatcagccgcgccgatttgaaagtcgtctccaaacgccaaccgaccgagcaggaatggaacgatttgctgttcgtctggaacgtcgccaaatacgtcaaatccaacgccatcgtattcggcaaaggcggtcaaacctacggcatcggcgcaggccaaatgagccgcgtggacagcacccgcatcgccgcccgcaaagcgcaagatgccggtctcgacctcaacggcgcgtgtgccgcatccgatgccttcttccccttccgcgacggcgtggacgtgattgccgaacagggcatcaaagccatcatccatccggcaggctcgatgcgcgatcaggaagttttcgacgcagccgacgaacacggcatcgccatggtcgtaaccggcatccgccatttccgccattga

SEQ ID NO: 5040 - DNA, 944 bp, Neisseria meningitidis
ttgttaattcactatatcgacatcgccaaacgaaacttcgtcatcgccgtttcgtctttgtctaaaaccaaaaccgaaaccaacaaccccaaaggtatcgcccatactatcgaataccttaaaaaacacaaggtcgccctcgtcgtgacggaaagtaccggcggtctcgaaatccccgccgccaaagccatccgccgagcagggccgtgattatcgccaacccgcgtcagacgcatcagtttgcccaatcgcagccgctgaccaaaaccgacgccaaagatgccaaaatgcccgccttcttcgcacagatgacggcacagaaagaagattcgcaaaccatgccctaccacccgcccaccgaagtggaagaagtgttggaagccttggttaaccgccgcaaccaactggtggatatgcggactgccgagaaaaaccgtctgcattaggttcatgaaacgcaagtcgaaagcgtcaaacaactgattgcccattttgaccggctgattgacgaattggacaaacaaatcgacaaccacacccacacgcattttgacggcaaagcccaagtggcagagcaaatcaaaggcatcggttcgataacgacggctacgctgatggcgatgttgcccgaattggggcggctgtcgcacaaacggatagcgagtctagtcggcattgccccacacccgagggagagcggggaaaccaaattcaaaagccgctgctttggcggaaggtctgcggtgcgtaaggcactgtatatggctaccgtggcagcgacacgttttgaaccgcttattcgggatttctaccaacgcctgccgtccgagggtaagccgtataaggttgccgttacggcatgtatgcgcaaactgctgacgatatcgaatgcccggatgcgtgattattttgccgaaaacgataccgccgaaaacggtatctaa

SEQ ID NO: 5041 - DNA, 498 bp, Neisseria meningitidis
atgtctgtccgtttcgcaaaaaacatcggcttaatactatatattgtgttttatgggtttgagatgcgccgggcgttgattgcgaaaattaagattgctcaaaaggagctgggcttggatgacggtacctatcgcgcggtgttggagcgtgtgacgggcaagcggtcgtgtgcggatatggatgtttccgaacttgagtctgttgtcgctgatatgcggtcgcacggatttaagcctaaagcaaaaggtaacccacacggcaaaccgcatctgcgtcggacatcatcagcggcaatgttggacaaagtcgaagccctgctgaccgtcggcggcaaacattggaactatgcacacgcaatggcgcggcggatgtttggtaaggataaggtcgaatatttagacgatacgcagctacataaactggttgctgcgttgcagattgcggaaaacaggaaaacggaaaaagcgggtggggatgatggggttcgaaaaagttga

SEQ ID NO: 5042 - DNA, 432 bp, Neisseria meningitidis
atgatggggttcgaaaaagttgaacatttattgccggataccgtgttggacattgtggatgtcatcggactggcagcgacggaacagctggtcaaggcgattggcggggcgcggtttaaatttggtaagggcaaggtggacaccgagcgtttggcaattttggtcgaagccatcggcgaagtgaaaacacatgagctgttgcaggtatatggtggcgaggaattgtatgtcccacggtgcggcaaggcgttaatacagttgagaaaccataggttttatcaggagtttgtcaaattgcgcgatattgataagaagagcgggcttatggcgatgacgaagctatgccctaaatacggcatctcttcacgaacgggatatacgattatcaatgaaatgagccgacctgcggcacagcaggcagctttattttag

SEQ ID NO: 5043 - DNA, 546 bp, Neisseria meningitidis
atgggcaaaaccgtaaccttaaccgctggacacagcaacaccgacccgggtgcggtcaacggaagcgaccgtgaggcggacttggcgcaggatatgcgcaacattgtggcttcaatcctgcgtaacgattacggcctgaccgttaaaaccgacggcacgggcaaaggcaatatgccgctgcgcgatgcggtcaagctgattcgcggctcggatgtggcgattgagttccacaccaatgcggcggcgaacaaaacggcgacaggcatcgaagccttgtccacgccgaaaaataaacgctggtgtcaggtgctgggcaaagccgttgccaagaaaaccggctggaaactgcgcggcgaagacggctttaagccggataacgcagggcaacattcgcgcctggcttatgcgcaggcaggcggcattgtgtttgagccttttttcatcagcaacgacactgatttggccttgtttaagacgaccaaatggggcatctgccgcgcgattgcggacgcgattgcgatggaattgggagcggcgaaggtatga

SEQ ID NO: 5044 - DNA, 204 bp, Neisseria meningitidis
atgaaaaagtctttgattgctttatgtgttgcccattgtgcaaagttgaaaaacgattttggcgtaccaccgttacctgaaatcaaaatcacgccaagccctgttcgggtaggctctttgaaacaacatccgagcctgcgcttgggtaaatcaggcgtggcggctgctaaacgtgcggcgcgcaaacgcaagaatcgtcgttaa

SEQ ID NO: 5045 - DNA, 165 bp, Neisseria meningitidis
atgggacaggttgcgttttacgaaaagatgattgggctgtggtcggccaaaagccgtgaggcaagcgaacaggcggacttggctgcgtttgaatttgcggagggcgaactggccaattatcgggaaatgctgaaacggcacctgcaaaccaaaagtgtggaatag

SEQ ID NO: 5046 - DNA, 405 bp, Neisseria meningitidis; identical to SEQ ID NO: 3435

SEQ ID NO: 5047 - DNA, 1113 bp, Neisseria meningitidis
atgagcaccttcttccggcaaaccgcgcaagccatgattgccaaacacatcaaccgtttcccgctattgaagttggaccaagtgattgattggcagccgatcgagcagtacctgaaccgtcaaaaaacccgttacctccgagaccaccgcggccgtcccgcctatcccctgctatccatgttcaaagccgtcctgctcggacaatggcacagcctctccgatcccgaactcgaacacagcctcatcacccgcatcgatttcaacctgttttgccgttttgacgaactgagcatccccgattacagcaccttatgccgctaccgcaactggctggcgcaagacgacaccctgtccgaactgttggaactgattaactgccaactgaccgaaaaaggcttaaaagtagagaaagcatccgccgccgtcattgacgccaccattattcagaccgccggcagcgaacagcgtcaggccatagaagtcgatgaagaaggacaaatcagcggccaaaccacaccgagtaaggacagcgatgcccgttggatcaagaaaaacggcctctacaaactcggttacaaacaacatacccgtaccgatgcggaaggctatatcgagaaactgcacatcacccccgccaatgcccatgagtgcaaacacctgtcgccgttgttggaagggttacccgaaggtacgaccgtctatgccgataaaggctatgacagtgcggaaaaccggcaacatctggaagaacatcagttgttggacggcattatgagcaaagcctgccgcaaccgcccgctgtcggaagtgcaaaccaagcgtaaccgatatttatcgaagacccgttatagtggattaaatttaaatcaggacaaggcgacgaagccgcagacagtacaaatagtacggcaaggcgaggcaacgccgtactggtttaaatttaatccactatatgtggtcgaacagagcttcggtacgctgcaccgtaaattccgctatgcgcgggcagcctatttcggactgattaaagtgagtgcgcaaagccacctgaaggcgatgtgtttgaacctgttgaaagcggccaacaggttaagtgcgcccgctgccgcctaa

SEQ ID NO: 5048 - DNA, 1776 bp, Neisseria meningitidis; identical to SEQ ID NO: 895

SEQ ID NO: 5049 - DNA, 171 bp, Neisseria meningitidis
atggcgcaatatatgtgcggcccctgcggctggatttacgatgaagaacacggcgaccccgaacacggcatcgcccccggaaccaagtttgaagacatccccgacgactggaaatgccccgaatgcggcgtgggcaaagaagatttctacctgttggatttcgtgatatag

SEQ ID NO: 5050 - DNA, 1092 bp, Neisseria meningitidis
atgaacgcccaaaccctgattgccaacgttgccgaattcgtcaaaaccaagctcaaacccatagtggacgacatcgaccgcaaaggatactaccccgaagcatttatgcgcgaactcggcgcaatcggtggattcggcgcagtcggtacagaagccgaaggcggcaacggcttgggtttggcaacgcaaatcgccgtattgcgcgaaatcggcaaagaatgcggcgcaacctctttcagtgcgtggtgtcaggcggcttgcgcgtggtatctgcaccaaacgcccaaccgggccgtcaaagacaaataccttgccgacatcctgcaaggcaaagtattggcgggtacgggcatgtccaataccgtcaaacaccttgccgacatcgaaaaacacaacctccaagccgaacgcgtggaaggcggctacacagtcaacggcgcgctgccgtgggtgtccaacatcggtgaagaccacatctgggcgaataccgcccaaatcggcgacggctacgttatgttcatcacaggcggacaatgggaaggcgtaagcctgcaaaactgccccgaattttgcgccctcgaaggtacgcgcaccttcagcctgaatttcaaagacgtatttatccccgacgaagacatcatcgccgcgcccgaacagtttgccgactacatccaaagcatcaaagcaggctttatcctcctgcaaatcggcatcggcgcgggcgtaatcgacggcagcctcggcatcatccgcctcgccaacgtcgtcaacgccgaagtcaacaactacctcaacgacggctacgacagcctcaaaacaaggctggacggcgcgtgggcagaaaccgaacggctcgccggcttggcttggagcggcacgcccgacaaccttgctaccctcaagctgcgcgaagccgccgccgtactggcacttgccgccgcccaatccgccgccctgcattccggcgcaaaaggctacctgatgcgcagtcccgcccaaaggcgcgtccgcgaagcaatgtttgttgccatcgtaacccccgctatcaaacacctacgcaaagaaatagcggcaatcgaagccgcaaaataa

SEQ ID NO: 5051 - DNA, 684 bp, Neisseria meningitidis
atgccgtctgaaaaatgttcagacggcatttcttataaccttttgtttgcagcacataaccaatcagtctttcctattccgttccgaaatgcataccatgcgcccgtacccaatatttgcgaacaaggaaagaaaatggcacgtttaaccgtacacaccctcgaaaccgcccccgaagccgccaaagcgcgcgtcgaggcggtacttcaaaacaacggctttatccccaaccttatcggcgtattatcaaacgcccccgaagccttggcgttttaccaagaagtcggcaagctcaacgccgccaacagcctgaccgccggcgaagtcgaagtcatccagatcatcgccgcccgtaccaaccaatgcggtttttgcgtggcagggcacaccaaactcgcaaccctgaaaaaactcctgtccgaacaatccgtcaaagccgcgcgcgctttggcagcaggcgaatttgacgatgccaaactcggcgcgctcgccgccttcacccaagccgtaatggcgaaaaaaggcgcggtatccgacgaggaactcaaagcatttttcgatgcgggctacaaccagcagcaggcagtcgaagtcgtgatgggcgtagccttggcaaccctgtgcaactacgtcaacaacctcggacaaaccgaaatcaaccccgaattgcaggcttacgcctga

SEQ ID NO: 5052 - DNA, 372 bp, Neisseria meningitidis
atgaaaccatacaaaatctacacccatcccgccctgccgccccaagccgtcaaacaaggctggtcatggccggggctcttgttcggcacgctgtgggcgtgtttcaaaagaatgtggggtttggggctggggctgacgggcgcgatattcgtgctggctgtgtttgcccaactggtttacggcgacacgcccgccacagactcggcgtttaacgtattgggcttggcggtttccgtctggttcggcgcaaagggcaacagcctttatgcacgccaccttttatcgcgcggctataccgaattgcccgaaacggttgaggcagccaatccccaagccgcattggcgcaatatttcgggcgcgggggccgataa

SEQ ID NO: 5053 - DNA, 1692 bp, Neisseria meningitidis
atgagcgcatcacaattactgtcaagactgacccaaaccgtaggcgaaaaatacatcatcaccgaccccgcgaaaaccgaacaataccgccaaggttaccgcttcggcgagggtaaggcgttggcggtggttcgccccggaagcattctggaaatgtggaaaattctgcaggcgtgcgtcgaagcagacgtgattgtgattacgcaggcggcgaataccggtttgacgggcggctcgacccccgacggcaacgattacgaccgcgacatcgtgattgtgaacaccatgcggatgaacatcatccaaaccatcaacaacaacgaacaagtcgtctgcctgcccggctcgaccctgaaccagctcgaattgctgctgaaacctttggggcgcgaaccgcattcggttatcggctcatcctgtatcggcgcgtccgtcttgggcggcgtgtgcaacaactctggcggcgcgttggtacagcgcggcccggcctacaccgaaatggcgttgttcgcccaaatcaacgaagaaggcaggttggaactggtcaaccacttgggcatagacttgggcaacacgcccgaagaaatcctgaccaatcttcaaggtcatcattatcaaaacaaagacatcacgcaagacgcgggcaaaggacacgaccacgcctattgcgaacatgtccgccaagtggacgaaccgaccgccgcgcgtttcaatgccgacccagcgcgccattacgaagcctcgggctgcgcgggcaagctgatggtattcgccgtccgcttggatacctttccgcaagaaaaacaaacggccgtgttctacatcggcacgaacgacatcaacgagctgaccgacatccgccgcgccgccttgggcgaatttgaaagcctgcccgtttccggcgaatacatccaccgccacgctttcgacattgccgacgtgtacggcaaagatacgttttacgtcatcaaaaaattcggtacgcaccaactgccgaaattatttgatttgaaggcacgcgtggacaggttcggcaaaaaagtcagcttcctgcccaaacatttttccgacaaggcaatgcagttcgtcagcaaattcctgcctgaccatctgcccaaatccatgcgcgattaccgcgacaaatacgaacaccacctgattctgaaaatgggcggaaaaggcgtggatgaggcgcgcgcgttcctgaaagagtattttgcacatcacggcggcgcgtttttcgagtgcaacgccgaagaaacccaagccgcgatgctgcaccgtttcgccgtcgcctcagccgccatccgctaccgtgccgtacacgacgacgaagtggaggacttggtcgcgcttgacatcgccctgcgccgcgacgaccgcgactggtttgaaaaactgccgccggaaatcgacaataaaatcatccacaagctctactacggacatttcatgtgccacgttttccatcaggattacatcatcaaaaaaggcaacgactgcatggcattggaacacgaaatgctgcatctcttggatcaacgcggcgcgcaatatccagccgaacacaacgtcggccatttgtacgaagccaagcccgcgctcaaacagttttaccgcaaacttgacccgaccaacagcttcaacccgggcgtaggcaaaaccagcaaaaagaaaaactgggcggaataa

SEQ ID NO: 5054 - DNA, 3834 bp, Neisseria meningitidis
atgaccacgactaccgcccctcagcgtattcgggaaatcccctacaactatacttcctacaccgaccgcgaaatcgtcatccgattattgggcgacgaagcgtggcaaatcctgcaagacctgcgcggtcaacgcaaaaccgggcgttcggcgcggatgctgtttgaagtgttgggtgatatttgggtggtcgtgcgcaatccgtatctggtcgatgacttgctggagcacccaaaacgccgcgccgcgctggtacgtgaaatgcgccaccgcttaaatgaaatccgcaaacgccgcgacgataatcggcaagtggatgtgttggttgccgcagcagaaaaagcagtcgagcgttttgatagcagttttgatgaaaccagccaaaaacggcggcagattttggagcgtttgagcaaaatcaccaagccgcacaatattatgttcgacgggctggcgcgggtaacgcacgttaccgatgcaaccgactggcgcgtggagtatccgtttgtcgtcgtcaatcccgacacggaggctgaaatcgcgcctttggtgcgcgccttaatcgagctggatttggtcattattccgcgcggcggcggcacgggttataccggcggcgcgattcctttggacgcaaacagcgcagtcatcaataccgaaaaactcgacaagcatcgtggtgttgaatacgttgagctggcaggcttggacggcaagcatccgattatccggtgcggcgcgggcgtggttacgcggcgggtggaagaaaccgcgcatcaggcaggtttggtgttcgccgtcgatccgacttctgccgacgcgtcatgcgtgggcggtaatgtggcgatgaacgcgggcggcaaaaaagccgtgctgtgggggacggcgttggacaacctcgcctactggaacatggttaaccctcaaggcgaatggctgcgtatcgagcgcgtgcgccacaatttcggcaaaatccacgacgaagaaaccgccgtgttcgacgttcacacgctggattcagacggcatcaatatcgttaaaaccgaacgcttggaaatccccggccacaaattccgcaaagtcggtttgggcaaagacgttaccgacaaattcttgagcggcctgcccggcgtgcaaaaagaaggtacagacggcatcatcaccagcgttgccttcgtgttgcataaaatgccgaaatacacgcgcaccgtgtgtatggagtttttcggtacggtcgccaccgccacgccatctattgtcgaaatccgcgactttttgcttgcccatgaaagcgtgcggctggcgggtttggaacatttggactggcgttatgtccgcgccgtcggctacgccaccaaagcggcgggcaagggacgaccgaaaatggttttgctggcagacgtggtttcagacgacgaagccgccgtagaggcagccgccgaacacatctgtgaactcgcacgcgcccgcgacggcgaaggctttatcgccgtatcgcccgaagcccgcaaaaccttctggctcgaccgcagccgcaccgccgccatcgccaaacataccaacgcctttaaaatcaacgaagacgtggtcatcccgctcgaaaggctcggcgagtattcggacggcatcgaacgcatcaacattgagctttccatccaaaacaagctcaaactctgtgccgccttggagcaatatctttcgggcaaactccccatcgacaaaatgggcactgacctgccgaccgccgaactgttgggcgaacgcggcaaacacgccctggcccacgtttccgccgtcaaaacgcgttgggaatggctgctcgccaatcttgacacgccgcttgccgactacaaagcccgctacggcgcagccgtccacgccgcacccgaagccaaaaacaatgaaagctgctttattgccttccgcgatttccgcctgcgcgtgtctgtcaaagcggacgtaatgaaaccgctttctgaaatcttcagcggcaaaaccgacaccaaaattatccaaggcttgggaaaaatccacgcaaaaaccgtacgcagccgcgtctttgtcgccctgcatatgcacgccggcgacggtaacgttcacaccaatattccggttaactcagacgatgccgaaatgcttcagacggcataccgctcagtcgaacgcattatgaaaatcgcccgttcgcttaacggcgtgatttccggcgaacacggcatcggcattaccaagctcgaatttttaagcgacgaagaaatgcagccgttttgggactacaaaaaccaagtcgatccgaaacacaccttcaaccgtcacaaactgatgaaaggctcggacttacgcaacgcctacacgccgtccttcgagctgttgggcgcggaatcgctgattatggaaaaatcaaacctcggcacgattgccgattccgtcaaagactgcctgcgctgcggcaaatgcaaacccgtctgctctactcacgttccgcgtgccaacctgctgtacagcccccgcaacaaaatcctcggcgtgggcttattgatcgaagccttcttatacgaagaacaaacccgccgcggcgtttccatcaaacactttgaagaactcatggacatcggcgaccactgcaccgtgtgccaccgctgcgtcaaaccctgccccgtcaacatcgacttcggcgacgttaccgtagccgtccgcaactatcttgccgattccggccacaaacgatttgcgcctgccgcagctatgggtatggcgtttttgaacgccaccggcccgaaaaccatcaaagcccttcgcgccgccatgatacagatcggcttcccagcgcagaatttcgcctacaaaatcggcaaacttcttccaatcggcacgaaaaagcaaaaagccgaacccaaggcaaccgtcggcaaagccccgattaaagaacaggttatccatttcatcaaccgcccactgcccaaaaacgtacccgccaaaacaccgcgctccttattgggcatcgaagacggcaaaagcatccccatcatccgcaaccccgccgcgcccgaagatgccgaagccgtgttctacttcccgggttgcggctctgagcgtctgttcagccaaatcggacttgccgttcaagccatgctctggcacgtcggcgtacaaaccgtcctgccgcccggctatatgtgttgcggctatccgcaagacgcaggcggcaataaggcaaaagccgaagaaatgagcaccaacaaccgcgtggctttccaccgtatggcgaacaccctcaactacctcgacatcaaaaccgtcgtcgtcagttgcggcacttgttacgaccagctcgaaaaataccgctttgaagaaatcttccccggctgccgaatcatcgacatccacgaatacctgctcgaaaaaggcgtgaaactcgacggcgtaaaaggtcagcaatacctctaccacgacccctgccatacccccatcaaaaccatgaacgccacccaaatggccagcagcctgatggggcagaaagtcgttttaagcgaccgctgctgcggcgaatccggtatgtttgccgtcaaacggccagacatcgccactcaggtcaagttccgcaaacaagaggaaatcgagaaaaacctcaaagagctgccgcagggcgaacccgtcaaaatgctgacctcctgccccgcctgcctgcaaggcttgagccgctacgccgacgacaacaatatgcctgccgactacatcgtcatcgaaatggcgaaatacatcctcggcgaaaactggctggatgagtttgtaaaaaaagccaacaacggcggtgtagagaaagtgttgctgtaa

SEQ ID NO: 5055 - DNA, 1002 bp, Neisseria meningitidis
atgattgacagacaaacaaacgaacccaaacaaaaaacccgaatcatccttgcccctatgcagggtctggtcgatgacgtgatgcgcgacctgctgacgcgtattggcggctacgacgaatgcgtcagcgaatttgtacgcattacccataccgtgcattcccgatccatatggttaaaatatgtccccgaaatcgccaacggaaacaaaacgttttccggcacgccttgcaccgtccaacttttgggcagcgatgcggacaatatggcggcgaatgcgctggaagccgtccgcttcggtgcgaacaaaatcgatttgaacttcggctgccccgcgcccaccgtcaacaaacacaaaggcggcgcaatccttttaaaagagccggaactgatattccacatcgtcaaaacgctgcgcggacgtttgcccgcacatattccgctcaccgcaaaaatgcggctcggttacgaagacaaaagccgggctttggaatgcgcctgtgcgattgccgaagggggcgcatgcggactgaccgtacacgcgcgtaccaaagccgagggttacgaaccgccggcgcattgggaatggataaggaaaatccgagacagcgtcaatattcccgttaccgccaacggcgacgttttcagcctgcaagactatatcggcatcaaaacaatcagcggctgcaacagcgtgatgctcggtcgcggcgcggtcatccgccccgatttggcgcggcaaatcaagcaatacgagaacggcgggccggtcaaagacacggattttgccgaagtttccaaatggatacggcagtttttcgagctgtgcctgacaaaagaggcaaacaacaaatatccgctggcgcggctgaaacagtggctgggtatgatgaagaaagaatttgcagcagcacaaaatctgttcgaccgcgtccgaacggttaaggatgcggacgaagttcggaacatcttggctgaatttgagcgagaaatgaatacttga

SEQ ID NO: 5056 - DNA, 1018 bp, Neisseria meningitidis
atgattgccaaacacatcgaccgtttcccactattgaagttggaccaggtgattgattggcagccgatcgagcagtacctgaaccgtcaaaaaacccgttacctccgagaccaccgcggtcgtcccgcctgtcccctgttgtccatgttcaaagccgtcctgctcggacaatggcacagcctctccgatcccgaactcgaacacagcctcatcacccgcatcgatttcaacctgttttgccgtttcgacgaactgagcagtatagtggattaacaaaaaccagtacggcgttgcctcgccttgccgtactatttgtactgtctgcggcttcgtcgctttgtcctgatttttgttaatccactatactttatgccgctaccgcaactggctggcgcaagacgacaccctgtccgaattgctcaaactgattaactgccaactgaccgaaaaaggtttaaaaatagagaaagcatccgccgccgtcgttgacgccaccattattcagaccgccggcagcaaacagcgccaggccatagaagttgacgaagaaggacaaatcagcagccaaaccacaccgagtaaggacagcgatgcccgttggatcaagaaaaacggcctctacaaactcggttacaaacaacatacccgtaccgatgcggaaggctatatcgagaaactgcacatcacccccgccaatgcccatgagtgcaaacacctgtcgccgttgttggaaggtctgcccaaaggtacgaccgtctatgccgacaaaggctatgacagtgcggaaaaccggcaacatctgaaagaacatcggctgctggacggcattatgcgcaaagcctgccgcaaccgtccgctgacggaaacgcaaaccaaacgcaaccggtatttgtcgaagacccgttatgtggttgaacaaagcttcggtacgctgcaccgtaaattccgctacgctcgggcagcctatttcggactgatttgcgcccgctgccgcctaaaaggcagcccggatgcctga

SEQ ID NO: 5057 - DNA, 573 bp, Neisseria meningitidis
atggggaaaccggggaagtcatcccgtccgtccgcactgctttccgcccgctggcaagacatcgacctcaccgcccggttatggcacatccccgccgccgacatgaagaccaaacacccctttaccgtcctactgtcggactgggcggtagaaatactccgagagctgcacacacagaccggcgacaacatccaccttttccccggcatccgcccacggcgcaaacccgccccccatcccgaccacatcagcatcaaattcgcccacaacgccatccgacgactgggctatgacggcagcacccccggcaaatccaaacacacaatgcacggattccgccacctcttcaccaacatcagcctgaccgccggaaaagacaccctcacaacagacctcgccctcggccacatcagccgcgccgccctccaacgcgccggcttctcaagcctgcaccactacctgaccgccgacagctaccgcctccaagagcggcgcgaactcgccgaatggtacagccgccgccaccgccaagcatacgaagccgccgcccaaaacacttgcaataaaacctaa

SEQ ID NO: 5058 - DNA, 876 bp, Neisseria meningitidis
atgaatacagaaattgaaattatcgcaaccgacaaagtaagcaatcaggcagcgatgcgcagtgtgctggtgatggagcagtggggtaacggcgagacttatagcgaagagcgttgggttgaacgcggtcgtcaagcagtacggcagacgatggaaggcatgttcgaactgggacgtgcgctgattattttaaaagagcatacggaacacggacggtttatggaaattgtgaaaagccaatttgggctgggtatcgcagaaacatcacgtctgatgtcagccactcgccgctttgcgaccccgcaaatgcagaaagccgcgccgaagctgatggatttgggcaagtcgaagctgcttgagctgctggtcgaagaagacgttacgctggtgggtttggccgaaggggaagaagtcaacggcatgacctttgacgatgtggaccgaatgacggtgcgcgagctgcgcgtcgccctgcgcgaaagccgcgaaaacctcgccgccaaagacgaagtgatgaaaaccaaaacagccaaaattgatgagctggccgagaagctggctaagaagcaaaccgttgtcagagagccgaaggcggaagacgtaggcagcgagttggcgatgcagttaacaagccttgaggtcggtatccgcagtcaagtgagccgtctgaaagatttgttcgaccaacttaatgcgcacagtgaggcacacgggatcagccatcaggcaaagatggtcggcacgctcaatcaaattattttggactgcgagcaactgcgcgaaagctatgccctgccgactgaagcaccgacagacaatgtgccggaatggttgggcggtgaaacgggagaaggcgatgaatccggcaatgattga

SEQ ID NO: 5059 - DNA, 297 bp, Neisseria meningitidis
atgcggatggcagaaagtaaaagggtacaacggctattgagggtctttatcgcgcttgacgagcatccgattatcggtctgagcaataaggatttatcggtcggactggggctgacgccatcgcaagtcagcagggatattgatgatttggttgcctcgggattggtcatcaaacttgaaaacggcaactacgcctacggcatcaaaaccctgcaaatcgcagagcggttcaggcagcagcatgaacggctgcaaagcaagattgccgaaatcggcaagcgggtcgatgtggattaa

SEQ ID NO: 5060 - DNA, 246 bp, Neisseria meningitidis
atgattaatcatgagtgtattaaccaaccgtacggacggatactgaaattttcccgcgtacaggccaaagaaatgcttacggcagacgaattgaaagaaaattttgccaaaaacggccagacgctggcgcagtgggcaagagagaacggctttaagccgcgcgatgtgtatctggtgatcggcggacagcgcaaaggcaattacggcaaggggcacgaaattgccaagaagctgggactgaaataa

SEQ ID NO: 5061 - DNA, 225 bp, Neisseria meningitidis
atggaaaaacctttgaatttcaagcctatttcctatccgcaaacgcgcgagagcgcggccgggtggtttaagcgcaacggggtgtgcaaggcgcattgggcgaaatatttcaatctggagcgcaccacggtggagcacctcttgcgcggcaagctgaaaggcaattttggcaaaagccacgaagcggcggttttgctggggatgaaggagaaaagcgatgattaa

SEQ ID NO: 5062 - DNA, 180 bp, Neisseria meningitidis
atgaacactttgaaggctcatgcgcgacagctcatgatggatcacatacacccagctacgagaaaaagcttgtttactttaaaacaagccaagaccctgctgctgcacaacagaccggatgtttatcgtgcaaagagacctaaaaacaaacacattatatcacacgaaaggcataaataa

SEQ ID NO: 5063 - DNA, 372 bp, Neisseria meningitidis
atgaataactcttccttttttggcaaccgattgaaagaagaaagaaaaaaattaaaaatgactcaagctgaaatcgctgaaaaatgtggggtttcaggaagaatgtggggggattatgaacgtggcatcagccagccaaaagcggaacttttcttccaatttgaaaaggtgggtatagacgttcaatacgtcatgcacggcagacgcggcgaaacagcggtcatgccgtctgaaaccctgaacgccgaagaacaagaactgctggtcttgttccgcgaggcggcagctgccgaccgtgaaatgattctgatggttgcgcgcagggcagagaaaaaagcccaaactgcgcttggtaaagtgagtaatggataa

SEQ ID NO: 5064 - DNA, 624 bp, Neisseria meningitidis
atggatcaattcgaattgtgccaaaaagaacatgtcaatccatttgccttgtcaaagcaatatctattggttgtaacattcgtcaaatccagcagtaaaaattttcaggcagcattactttgggcaagaagtgccaaattatttgagaatcttgagattggaaaagaaaccatctattgctgcgctttcgataaaacagcagaacaggctgggatggccggggtatttttgaattatattgaaaattggaatggcaaacagatttacatcaatggccgaatccatagtggcagtatttatgatttgttaggggttttagactgctatcaaaaatcacagtcctgtcccaaccctaaaagccactgttgctttgtttcagacgacatttttctatggcatggatcaagaccaacgtttgaaatcagtcttgatctaactggaaagaaaaaagaaacatcctctgcaaagaaatttgtgatgccttgtattaatttccgtcaccataggattgaaaaagaaacctacttaggaaattggaatgaacaaattgccgcattggcagtaaaacaaaatatagattggtgtccaagttttgatattgagaattttagacagtatgaataa

SEQ ID NO: 5065 - DNA, 195 bp, Neisseria meningitidis
atgaataattactatctatataggaattgcagcagcgatgtgttatgggtcaaacgtatccaacgccaaatcgacggcagcctactcttgatttctgacaattcaacctatccacccatgcccttggcactggcggaacaccccgatattcaaatcatcgggcaggtagtgcaggtatcaaaagacttgaactag

SEQ ID NO: 5066 - DNA, 564 bp, Neisseria meningitidis; identical to SEQ ID NO: 3577

SEQ ID NO: 5067 - DNA, 948 bp, Neisseria meningitidis
atgatgattgagaaaagtatttctattgtagatggaaaggaatactccgtttttgctgtatcacacgagtttcgttatacctttgatgagcctattttagtcgctgacttgattagttctctaaaagcttatgaaacactgacaagtagttatcttccagcaattttgaatcagctgtttgatgtcaaaatccaaaaaatcaaagtagctgtatctgaaattgaaagaggatctttccttgaaaaactgattttcaatttattcttcaaagatgaagatgcttataatgaattttgtcttaaaatacgaaaatttctaggaacagaaaatcaggacggaagtattaatatgtccaaaatcattatgtttgcaatgactacacttttaggggtaggtgctggttatctcttgtttaaaaacccgccacaagagaagcaggcaataaccaacaacatcgttaccgtcattaatgctgatagttctgtcgcactggatggtgaacatttggtttcagtggtaaaagaagtaacaggaagcagcaagcaaaaaactgcagaaaatgtggcaaaagtatatgctccagcaagtaaaaataatggcagtattacccttgggacagatgatgttcggattgaacctgttgcacaacaaactgtagcaactttgcctaaagatgtggacttacgtgatacgccattgactgaagattacaccgatattgatgtgcaaattcgtgctactgaccgtgataaaaattcagggtggtatgcagtcatagaccaaattgttccatcacgtgttcgattagaactgcctgaagatattgatttgaataggctggctaacaatgctactatccgtgcaaatgtaacagttgagtttgacttaaagcaaaatggctctcgtaagcctaaaaaaatcatcctcacatctctctctactgattaa

SEQ ID NO: 5068 - DNA, 504 bp, Neisseria meningitidis
atgtcagacaagttcaaccaattcatcaaccgcgtcctctctcacgagggtggttacgccaaccatcccaaagaccccggcggcgaaaccaattggggcatcactaagcgcaccgcacaggcaaacggctacaacggctccatgcgtgccatgacgcgtgaacaggcaatcagcatttaccgtaaagcgttttgggagcgttaccgcgccgaccaaatgccggaagcggtcgcgttccaattttttgatgcctgcgtcaaccacggttacggcaatgccgcccgtatgctgcaacgcgccgcaggcgtaccggacgacggcgttatcggagcagtcagcctcaaagccatcaattcccttcccgaaaacgaccttttattgcggttcaacgccgagcgtctggtcttttataccaagctcggtacgttcacctctttcggcaagggctgggtacgccgtgtggcgcaaaacctgattcacgcgtctgcagataacactgattaa

SEQ ID NO: 5069 - DNA, 174 bp, Neisseria meningitidis
atgtcaaaaaagtcactcatcgccctaatgaccgcagccatgcagcccgatttcagccacagcgacctaggcattcgctacgccatgccgactcagggatgttggacgcaagcccaccgcaagagcggggtagccgccgcgaaacgcgcagccaaaaaaaagcgtcacaaataa

SEQ ID NO: 5070 - DNA, 594 bp, Neisseria meningitidis
atgggcaaacgtcgccgcagccgccatgacttggaagttcgtgcaggcggcggacgcgcccgaatggctctagtgggcttatggcgcattggtcggcgggtatgcattaatcaaacgcggcatcgcggcgattccgcagttggcagaaatcaaaaaatccgcaaatcaggaaggggggcggcaatgattgaatttgtccgagccaaaaaacggctgctttgggcatttgtgcttttgcttgtgtggacgtgcggttaccgatacgccgccgacaaggccgaagcgaaacaaaccgccctgattgccacctatcggcattcttctatggttgcggcggaacaatatgccttgcagcttaaaaaagcgcaggacgaaaggcagcggtggtacgacttttcccaaaaacaaggaagaaagcccgtgaaaaaacagtatccgccgcaaacgaaaaaagccggctatctgaaaaccaaggaagaactgcttgcggaattggcttgccttaaagcggaaatggttgccctaaaaaagcccgatgccttaatccatgggaaagaagtgcggcagaaagaacgcaactcgtcgcagggttaa

SEQ ID NO: 5071 - DNA, 794 bp, Neisseria meningitidis
ttgaactgctgttggagattgtccttctattaccaattggccgtccaatcggcagaagacaaatatgccgatttgaaacggcatatccatgatatttatcgacgacataagggaagatacggctaccggaggattgcggcagccatccgtcacgcaggaacaccggtcaatcacaagaaagtcagccgtctgatggcgaagacggggctgaaggcagtgatacggcggcgcaaataccgctcgttcaaaggagaagtcggcaaaattgcgccgaatatcctgcgacgctgtttccatgcagaaaagccgaatgagaaatgggtaacggacgttaccgagttcaatgtaggcggagaaaagatatacctttctccgattatggatttgtttaacggggaaatcgtcagttaccgtattcaaatccgcccgactttcgatttggccggcgagatactgaaaggtgcgccggagaaaccgggatcgtctgaaaagccgatactgcattcggatcaaggttggcaatatcagatgttttttatcaaaagcagttgaaaggcaacggtctggttcagagtatgtcccgcaagggaaactgcttggacaatgcggcaatggaaagtttcttcggaacgttgaaatcggaatgtttccatacgtgcaaatatgattccgttaccgaatcgtaagcggcactgcacgaatatatccgttactacaacaacgatagaatcaagttgaaattaaaaggactgagccctgttcagtacagaactcagtccctgaaagccgcttga

SEQ ID NO: 5072 - DNA, 606 bp, Neisseria meningitidis
atgaataccgacttccaaaacatcctcaaacaactgggcaaacaagcccaaaaagaagcggcagaaaaacaggcagccgaaaaaaacaagcaaaaacaagaacaggatttcgatttttcacaagcagtcggacaactctccccattaaaaaaccggcagcaatattatgcgccgcccgacaaaacccccatcaaagtccgtcccaaagacaaccgcgccgacgaagaaaactacttctacatcggcagcacatacaacgacccgcccgccagcttcagcaaaaacggacagggaaaaaacgacatccaacgcctgaaaaacggatactatcccgtcgttaccgatgtcgacctgcacggctacacacaggaagaagcccaaaaagtcctcaacgaattcatcgcattcacccaaaaacgcggcgtatgcggcgaaatcatccacggcagcggattaggttccaaaggctacaaacccgttctgaaaaatatgacccgaaactggctgatgcaacaccccgacgtactcgcctacgccgaaccccgggaaggcaacgacggctgcgtccgcatcctgctcaaacgcaaattaaggcagcaagactga

SEQ ID NO: 5073 - DNA, 1056 bp, Neisseria meningitidis
atgaaaacctacgcaccggcactctataccgcagccctgctcaccgcctgcagccccgcagccgattcaaaccatccgtccggacaaaatgccccggccaataccgaatccgacggaaaaaacattaccctgctcaacgcctcatacgatgtggcacgggatttttacaaagaatacaaccccttatttatcaaaacataccaatccgaacaccccggcacatccgtcagcatccaacagtcccacggcggctccagcaaacaggcattatccgtagccaacggccttcaagccgatgtcgtaaccatgaaccaatcctccgacatcgacctgctcgaaaaaaaaggactggtagaaaaaggctggcaacaagccctccccgaccacgccgcgccctacaccagcactatggttttccttgtccgaaaaaacaaccccaaacagatccgcgattggaacgaccttgccaaagacggcgttaacatcgtcatcgccaatcccaaaacctcgggcaacggacgctacgccttcctcggcgcatacggttacggtctgaaaaccaccaacggcaacgaacaggaagcccaaaaactcgtcgcatccatcctcaaaaacacccccgtttttgaaaacggcggacgcgccgccaccaccaccttcacacaacgcaacatcggcgacgtactcatcacttttgaaaacgaagccaactacgtcagcaaaaaactgacccaaggacagtttgaaatcgtctatccgagctacaccatttccgccgaaagccccgtcgccgtcgtcaacagcgtcgtcgcgaaaaaaggcacgcaaaaaaccgcccgcgcctatctcgaatacctttggagcgaaccggcgcaagaactcgccgcctcactctacctgcgcccccgcaaccccgaagtattggcaagacacaaagccgacttcccagacttagacaccttctctcccgaaaaaaaattcggcggatgggacaacatcatgaaaacctacttcgccgacggcggcatattcgaccgcctgaccgcacaaaaatga

SEQ ID NO: 5074 - DNA, 483 bp, Neisseria meningitidis
atgagcctgctgacactgttacgccccgccaccgtgcaagactgcaaagacatcttcaaagtccacctgcactccgtccaatacacctgcatcctcagctacaacgaacacgccctaaaagtatgggaaggcttgctaaacacagaaagctacctgccgaccatttccgatcccgacaaagcactttgggttgccgaatacaaaggcaacatacagggatttttccaaatcgactgccaagaagcacaactcgatgcactttacgtccaccccctgttccacaacctcggactgggcactgccctacttcatcaggcggaaaccatcgcccacaaatccggtttgagctttctgaaactctacgcatcgctcaactccgtcccgttttaccttctcaaccgctacgaatcgctcggttcggcagtattgcagcttgaccccagcatcaaaatcaaatgcgaactgatgcggaaacacctctga

SEQ ID NO: 5075 - DNA, 1137 bp, Neisseria meningitidis; identical to SEQ ID NO: 3113

SEQ ID NO: 5076 - DNA, 546 bp, Neisseria meningitidis
atgacttatgaaaaactttatgagcttcgccaaacactcagaccgactaccaaagacggtctctatacagataatgaaaaaaatcgagaaatcctaacggttagatggagcggcaacacagaaaatcctaaaaatttctcagctgtcgctataggaattaatccaagtaaagcaaatgatgaaagaagcgacaaaacccttacccaacttgcacgtttcttggatatgtacggttttaccaacttcaaaatgttaaatattttttccagttactctacacagcaaacaggaattagggcaaacacccaaaccgatttttccaaatttaaaggatgtttggaagatgctgatatgattattcttgcatggggtacagaccgcggtgcttataaggatgaaaaaaacagaatactggaatttctaaaagcagaaaaatttatggaaaaagtattctgtatttctgaaactggtaattccagcgatacaagacatccgtcaagaattagttatagctatcaacttgtacaatttgaagagtcagcatga

SEQ ID NO: 5077 - DNA, 1476 bp, Neisseria meningitidis
atgatcagcaaacaagaataccaagcccaagccgcccaaggctacaaccgcatcccgctcgtgcaagaactccttgccgatttggatacgccgctttccctctatctcaaactcgccaaccgcccctatacctacctgctcgaatccgttgtcggtggcgaacgtttcggccgctattcttttatcggcctgccttgcagccactatctcaaagccagcggcaaacacgtcgatgtttatcaaaacggcgaaattgtcgagcaacacgacggcaaccccctgccctttatcgaagccttccacaaccgcttcaaaacacccgaaatcccaagcctgccgcgctttaccggcggactggtcggctacttcggttacgaaaccatctacaattttgaacacttcgcccaccgcctgaaaaacaccaccaaagccgacccgctcggcacgcccgacatcttgctgatgctgtcgcaagaattggcggtgatcgacaatttgagcggcaaaatccatctcgtcgtttacgccgatccgtcgcagcccgacggctacgaacgcgcccgcgaacgcctcgaagacatccgcacccagttgcgccaaagctgcgccatcccgctctcgctcggcagcaaacacaccgaagccgtcagcgaattcggcgaagagccgttcaaagcctgcgttaacaaaatcaaagactacatcttcgcaggcgactgcatgcaggttgtccccagccagcgcatgagcatggaattcaccgacagcccgctcgccctctaccgcgccctgcgtacgctcaacccttcgccttatctcttttactacgatttcggcgatttccacatcgtcggctcctcgcccgaaatcctcgtccgacgcgaacgcaacgacgttatcgtccgccccatcgccggcacgcgcctgcgcggcaaaacccccgccgaagaccttgccaacgaacaagatttgttaagcgatgccaaagaaatcgccgaacacgtcatgttgattgacttaggacgcaacgacgtcggccgcatcagtaaaaccggcgaagtcaaagttaccgacaaaatggtgattgaaaaatactcccatgtaatgcacatcgtttccaacgtcgaaggccgtctgaaagacggcatgaccaacatggacatcctcgccgctaccttccctgccggcacactctccggcgcacccaaagtccgcgccatggaaatcatcgaagaagtcgaaccgagcaaacgcggcatctacggcggtgccgtcggcgtatggggtttcaacaacgacatggatttggcaatcgccatccgcaccgccgtagtaaaaaacaacacgctatacgtccaaagcggcgcgggcgtggttgccgactccgatccggcctccgaatggcaggaaacacaaaacaaagcccgagccgtcatacacgccgcgcaaatggtacaggaagggttggataaatga

SEQ ID NO: 5078 - DNA, 966 bp, Neisseria meningitidis
atgagctacacgcaactgacccaaggcgaacgataccacatccaatacctgtcccgccactgcaccgttaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacccccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 5079 - DNA, 960 bp, Neisseria meningitidis
atgtccaaaaaaaccaaacaagaactcgaaaacaacaaactcagcaaacgcctgcgccacgccgtcggcgacgcgattaacgatttcaatatgatcgagccggacgacaaaatcatggtctgcctctccggcggcaaagacagctatgccctgttagacatcctgcgccagctccaagccagcgcgccgattgatttccaactggttgccgtcaatctcgaccaaaagcagccgggcttccccgaagaagtattgccgacctatctcgaaagcatcggcgttccctacaaaatcgttgaagaagacacctactccaccgtcaaacgcgtattagacgaaggcaaaacgacttgttcgctgtgcagccgcctgcgccgcggcatcctctaccgcactgcaaaagaattgggctgcaccaaaatcgccttgggacaccaccgcgacgacatcctcgccaccttgtttttaaatatgttttacggcggcaaactcaaagccatgccgcccaagctggtgagcgacaacggcgaacacatcgtcatccgcccgctggcgtatgtgaaagaaaaagacttaatcaaatacgccgaattaaaacaattccccatcatcccgtgcaacctctgcggctcgcaacccaacctgcaacgccaagtcatcggcgatatgctgcgcgattgggacaaacgcttccccggccgcatcgaatcgatgttctccgccctgcaaaacgtcgtcccttcccaccttgccgataccgaactcttcgactttgtcggattggaacgcggtcaaagcctgaaacacggcggcgatttggcgtttgacagcgaaaaaatgcccgaacgtttttcagacggcagcgaagaagacgagagcgaaatcaaaatcgagccgcaaaaagccgaacgcaaagtcatcaatattctggcgaacaagccgaaaacctgcggctcatag

SEQ ID NO: 5080 - DNA, 867 bp, Neisseria meningitidis
atgatgaaaaccttactgccctttttcggcgtggtgcgcgtcagcggcgaagaccgccaaaccttcctgcacggacagctttccaacgacatcaaccaccttcagaccgggcaggcgtgttatgcgacttacaacacgcccaaaggccgcgtcatcgccaatatgattgtcgtcaaccgaggcggcgatttgctgctgattatggcgcaagacctgcttgaagcaacggtcaaacgtttgcggatgtttgtgttacgcgccaaagccgtttttgaaatccttgaagattacgccgtcggcgcggaattagaagcatccgccgaaccgcttgccgcgcaagaacccagcctcgcctttaccgccgaatgcggttcagacggcatctgttccgtcgtcctgccacatcggggcattttgcacatcgcccccaaaaacgccttgccgccttatgatgccgccgccgaaaacgcgtggcggctgcacgaaatccgtagcggttatccgtggatatgcgcggctaccaaagaaaccgccgtcgcccaaatgctcaaccagcacatcatcggcggcgtacacttcaaaaaaggctgctatccgggacaggaaatcattgcccgtgcccagtatcgggggcaggtcaaacgcggcttggcggtattgtcgggaaattcggccgtcgaagcaggaaccctgctgacggcggacggcgaagaggccggcatcgtactcgacagcgttcaagattcggaaaactttaccgcccttaccgtgattaaattctccgccgcacaaaaaacactgaccgtcccaaacggcggtatcttcaaagcggttcatctcttctttaaaaccgaaaatgcagaataa

SEQ ID NO: 5081 - DNA, 363 bp, Neisseria meningitidis
atggatatccgatatttcggcacaacgccccgctattccgaagccgtcggcgcaaacggcttgattttcctctccggcatggttcccgaaaacggtgaaacggctgccgaacagactgccgacgtgcttgcccaaatcgaccgctggctggcggaatgcggctcggacaaagcgcacgttttggatgcggtcatctatctgcgcgatatgggcgactatgcggaaatgaacggcgtgtgggacgcttgggttgccgccggcagaacgcccgcccgcgcctgcgtggaagcacggctcgcccgtccggagtggcgcgtcgaaatcaaaataaccgccgtgaagagagacgcggcaactgcataa

SEQ ID NO: 5082 - DNA, 480 bp, Neisseria meningitidis
atgagtaaacacacttatccgataacacctgccgtgcgcgttttgcgtgaaaacggcatcgaatttgaaccttttacctatgcctatgaggaacacggcggcacggcgcagtttgcccgactattcggcaaagacgaacacttggtcattaaaaccattgttttgcaagatgaaaacggtaaggggctgattgtcttgatgcacggcgacaagcagatttcaacccgcaatctggcgcggcatttgggtgcgaaacacatcgaacccgccacgcccgtacaggcaaacaagtggacgggctatctggtcggcggcacaacgccgttcggcatccggacaaagttggatatttacgtcgaacagtcggtgatggatttggaaaccatctatatcaacggcggaaaacgcgggttcattatcggcatccgtcccggagatttaaatattttgaacccgaaaacaatacaggcggcggtttga

SEQ ID NO: 5083 - DNA, 723 bp, Neisseria meningitidis
atggacaaagatttgtatgccgtattgggcgtgtcgccgcaggcgggagcggacgaaatcaaacgcgcctaccgcaagctggcgatgaaatatcatcccgaccgcaatccgggcaatccgaaggcggaagaaaagttcaaagaaatccaacgggcttacgatacgctttccgacctgtcgaaacggatgcaatacgacgcgtccttcagacggcatgaggaacgcgggcggcaggaagaggcattccgccgcgaacaggcgcgcagggagcagttttaccgcgaacagatgcgccgcgaacaggcgttcagacaggcgtttgaacggcaggcatcacgttcgtgccatacttacgaaccgtccggcggcggaagcgggcgcaactatgtcctcgccgcctacatcctgttcggtttgggtgcaatcatgctgttcatgcccatagtcggcgtgattttcgcctatatgcccatagtcggcgtgattctcgcctatatgaaacggaacagtttggacagcattgtctatgccgcacataccgaatacctgattaaaaccttttggcgcacattttggctttatattttgggtgcgctgactgcccttttgggtatcggcgtgctgattattattgcaacgaacgtctggtatttctaccgcatcatcgccggctttatccgcttcaacggcggcagggcggttgcacccgagaaatggatatag

SEQ ID NO: 5084 - DNA, 876 bp, Neisseria meningitidis
atggcttacctgttaatcagcatcgtgttcagcgtgtcggtttccattttgctgaaaatggcaaggaagaaaaaaatcgacatcgcgcaggcggtcgccgtcaattatgtggtcgcggtcatactgaccctgctggtattgaagccggatatcggcaatatcggcgcatttttgccgacgtggccgctgtttgccgctttgggcgtgctgctgccgtccgtattcgtgataatgggcaaatctgtggaagccgccggtatcgtcaaatccgacgcggcgcagcgtttgtcgctgtttttgccgattgttgccgccttgacgctgtttggcgaaaaactcagcgaaggcaaactaatcgggctgtgcctcgcatttgccgcactgttctgcctgctttggaaacacagcggtggcaaaaaatcaggaagcgcgtggcggcaggcggcattgctgctgggcgtgtgggcaggttacggcattatcgatatcctgttcaaacagcttgccaaaagcggaacggcatttgcgggcaacctgctggttgcatttgtgctggcgggtgtgctgatgtttgcctgcctgtttgccaaatcggtcagatggcgtgttgagagtgtggtcggcggcatattcttgggcggtttgaattttatgaatatcgtaacctacatcaccgcgcaccaaatgatgaaggataatccgaccttggtttttgccggtatgaatatcggcgtgattgttttgggtacgctttcgggcgcattgttctttaaggaaaaaatcaacacaatcaatacggcgggaatcgtgttggcactgtgttctatcgcctgcctgttttattggggggaagtcaaggtactgttcggcatataa

SEQ ID NO: 5085 - DNA, 1398 bp, Neisseria meningitidis
atgactgtccgtatcgaacacgatttattgggcgaccgcgagattcccgccgaagtgtattggggcatccacaccctgcgcgccattgaaaactttaaaatctccacacaaaaaatttctgacgtgccgcagtttgtccgcagtatggtgatggtgaaaaaggcgacggcacaggcaaacggtgagttgggcgcggtcaagcccgaaatcgccgccgccattgaaaaagcctgcgacgaagttctgctgaacaaccgctgcctcgaccaattcccgtccgacgtgtatcagggcggtgcgggtacttcggtcaatatgaacaccaacgaagtcatcgccaacctcgcattggaagtcttgggatacgaaaaaggccgctacgacatcgtcaatccgatggatcacgtcaatgccagccaatcgaccaacgatgcctatcccacgggcttccgccttgccgtgtattacagcatcggcgaattgctcgacaaactgactgtcctgaaaaacgcctttgccgccaaagccgaagaatttaaagacgttttgaaaatgggccgcacccagcttcaagatgccgtgccgatgactgccggccaagaattccaatctttccaagtgttgttggaagaagaaatcctcaacctcgaccgcacccgccaactgctgttggaagtcaatttgggcgcaacggcaatcggcacgggcgtgaacacgcccaaaggctacgccgaactggtggtcaaaaaactctccgaagtcagcggcttgccttgcaaactgaccgaaaacctgattgaggcgacctccgactgcggcgcatatgtgatggtacacggcgcattgaagcgcacggcggtcaaactctccaaaatctgcaacgacttgcgcctgctctcttccggcccgcgtgccggcttgaaagaaatcaacctgcccgaattgcaggccggttcttccataatgcccgccaaagtcaatcccgtgattcccgaagtggtcaaccaagtctgcttcaaagtcatcggcaacgacacgacgattaccttcgccgccgaagccgggcaactgcaattaaacgtgatggagccggtcatcgcccaatgtatgtttgaaaccatttccctcttgggcaatgccgcagtcaacctgtccgacaaatgcgtcaaaggcattacggtcaaccgcgaaatctgcgaacgttacgttttcaactccatcggtttggtgacttatctgaatccgtatatcggacaccacaacggcgatttggtcggcaaaatctgcgcccaaaccggcaaaggcgtgcgcgaggttgtcttggaacgcgggctgttgagcgaagaagaactcaaccgcatcctctctcccgagaacctgatgaacccccatctgtaa

SEQ ID NO: 5086 - DNA, 564 bp, Neisseria meningitidis; identical to SEQ ID NO: 3899

SEQ ID NO: 5087 - DNA, 1071 bp, Neisseria meningitidis
atgaccaaacatatcgccatcctccgaggtgacggcatcggtcccgaaatcgtcgccgaaaccgtccgcgtactcgacaaactcatcgcccaaggtttggatgccggctacgaatacgccccattgggcggcgaagcctatgacgaatacggtcatccttatcccgaatttacgcaaaacctctgccgcaaagccgatgccgtcctgcttggtgcagtcggttctcctcaatacgacaacctcgaccgtccgttgcgccctgagcgcggcctgttggcaatccgtaaggatttgaacctgtttgccaatttgcgtcctgctgttttatatcccgaattagccaacgcctccacgctgaagcctgaaatcgttgccggtttggatattttgattgtgcgcgaactcaccggcgacatctatttcggcgaaccgcgcggcatccgcgttctggaaaacggcgaacgcgaaggctacaacaccatgaaatacagcgaaagcgaaatccgccgtattgcccatgttgccttccaatccgcccaaaaacgcagcaaaaaagtctgttccgtaggcaaagccaacgttttggaaaccaccgaattgtggcgcgaaatctttgaagaaatcggcaaagagtaccctgatgtcgagctttcccatatgtacgtcgacaacgccgccatgcagctcgtgcgtgcgcccaaacaattcgacgtcattgccaccggcaacatcttcggcgacattctctccgacgaagcctccatgctgaccggctccatcggtatgctgccttccgcctcgctggacgaaaacggcaaaggcctgtacgaaccgtctcacggctccgcccccgacatcgccggacaaaacaaagccaacccgctggccaccatcctctcgctcgcaatgttgctgcgttacagcctgaacgacgaagcgcgcgcgcaacaagttgaaaacgccgtccaaaaagtgctgcaacaaggcttgcgtaccagcgacatttacgaagaaggcacaaaactcgtttcctgctccgaaatgggcgatgcggtactcgccgccttgtaa

SEQ ID NO: 5088 - DNA, 732 bp, Neisseria meningitidis
atggtaaaacttactgcacaacaaatatttgataagttgctgaatgaggaaaaaatcttatcggtcaatggtcaaattagatttttcttgggcgatgtggatattatcgtcaaacaaaaagatgtcgtcggcaacatcattcaggaatggctcggcggatggttgagaaaaagggaaattgaatttgatgtttcaaccaatacccaaatgccccccgatttctttttaaataaaaaagaccgcagtagagaattgttggaagtaaaggcgttcaaccgaaatgccagtccgggttttgatattgcagattttaaaatgtattctgatgaaatcattcataaaccctatatgctggatgtagactatttaatattcggttacgatatggacgacaacggcaatgtaaccatcaaggatttatggcttaaaaaagtatggcaaattacgagaagcatggatgggtgggcaattaatcttcaagtcaaaaaaggcgtggtgcataaaatccgcccgggtgtttggtacagcataaataaaaagaatatgcctatgtttgaatgcttggaagattttgtttccgcaattgaagaaaccgtttatcaaaacccggcaacacggcataacgcatccttatggaaaaagaaatttgaggaagcctataaaaaacactacaaccgatcgatttccatacctcgttggcacgaaattgcacacaaatacaaaaagaaataa

SEQ ID NO: 5089 - DNA, 1272 bp, Neisseria meningitidis
atgcaacaaattaaatttattgacttattttccgggatgagcggtatcaggaaaggatttgaacaagcctgtcggaaacagtcggttgcttgcgaatgtgtttttacctcagaaatcaaaccggcagctttggaagtattgaagcaaaactaccctgatgaagtgccgtatggagatataacgaaaattgaaacgggagatattcccgattttgacatcttgttggcaggcttcccttgccaggctttttctttcgccggaaaaagattgggctttgaagatacgcggggaacgcttttctttgatgtggcaaggattttaaaggcaaaaaaaccaaaaggttttattttggaaaatgtggaaggattggtgacgcacgatagaaaagatccgacacaaaaaataggacgcaccctgaccgttattttggaaaccttggaaacattgggctactatgtttcttggaaagttttaaatgcaaaagatttcggcattccccaaaacaggaagcgtatttatctgacaggcagtttgaaatccaaacccgacttatcttttgaaacaaccctaagtccgaaattaaaaaatattttggaatcgggactgcctaccgaaagcagtcctttcatcaaaaaattgctaaagaaatttcccccgtccgaactgtacggaaaatcagtaaaggacaaacggggagggaaaaacaatatccacagttgggatattgaattaaaaggcacagtaaccgaagaagagaagcaattattaaatatgcttctaaaagaacggaggaagaaaaaatgggcttcagaaatcggcatcgattggatggatgggatgcctttgacaaaagcgcaaatttcaactttctataaacaccccaatcttcaaaatattttggacagcctgacagataaaggctatttggttttggagcatccgaaacaaaaaattggcgggcgaagaatcaaagatgaatccctgcccaaaggctacaatattgtttcaggaaaaaaatcatttgaaatcaataaaatattagacccaaatgatgttgcgccaaccttagttgcaatggatatggagcaccttttcgtcgttgacaacggcggtttgcgcacacttaccggaaaagaaggtttacgcttattcggctatccggacgattattcgtttgatattcctaaaaaagacaaatacgatttattgggcaataccgttgccgttcctgtgattaaggcggtatctgaaaggcttctgcatactttataa

SEQ ID NO: 5090 - DNA, 642 bp, Neisseria meningitidis
atgaaagcctttaccaaaattaccgccatcgtcgccccgctcgaccgcagcaacgtcgataccgacgccatcatccccaaacaatttttaaaatccatcaaacgcagcggcttcggccccaatgcctttgacgaatggcgttacctcgaccacggcgaaccaggcatggacaacagcaaacgcccgttgaaccctgatttctcgctgaaccagccgcgttaccaaggcgcgcaaatcctgttgacgcgtaaaaacttcggttgcggctcttcacgcgaacacgccccttgggcattggacgactacggcttccgcgccgtcatcgcccccagcttcgccgacatcttctttaacaactgctacaaaaacggccttttacctatcgtgttgaccgaagaacgggttgaccgacttttcaaagaagttgaagccaacgaaggctatcagctctccatcgaccttgccgaacaaaccctgaccacaccaagcggcgaaacgttcacatttgacattaccgaacaccgcaaacactgcctcttaaacggcttggacgaaatcggtctgaccctgcaacacgccgacgaaattcacgcctttgaagaaaaacgccgccaaagccagccttggctgtttaacggttaa

SEQ ID NO: 5091 - DNA, 255 bp, Neisseria meningitidis
atgaacaaacttttcattaccgccctgtccgccctcgccttgtccgcctgcgccggcacttgggagggcgcgaaacaagacaccgcccgcaaccttgacaaaacacaggccgccgccgaacgcgccgccgaacaaacaggcaacgccgtcgaaaaaggctgggacaaaaccaaagaagccgtcaaaaaaggcggcaatgccgtcggacgcggcatttcccatctcggcggaaaaatcgaaaacgccaccgaataa

SEQ ID NO: 5092 - DNA, 1410 bp, Neisseria meningitidis
atgacagcacaaaccctctacgacaaactttggaacagccacgtcgtccgcgaagaagaagacggcaccgtcctgctctacatcgaccgccatttggtgcacgaagttaccagccctcaggcatttgaaggcttgaaaatggcggggcgcaagctgtggcgcatcgacagcgtcgtctccaccgccgaccacaacaccccgaccggcgattgggacaaaggcatccaagacccgatttccaagctgcaagtcgatactttggacaaaaacattaaagagtttggcgcactcgcctattttccgtttatggacaaaggtcagggcatcgtacacgttatgggccccgaacaaggcgcgaccctgcccggtatgaccgtcgtctgcggcgactcgcacacttccacccacggcgcattcggcgcactggcgcacggcatcggcacttccgaagtcgagcacaccatggcgacccaatgtattaccgcgaaaaaatccaaatccatgctgatttccgttgacggcaaattaaaagcgggcgttaccgccaaagacgtggcgctctacatcatcgggcaaatcggcacggcaggcggtacaggctacgccatcgagtttggcggcgaagccatccgcagcctttctatggaaagccgcatgactttatgcaatatggcgattgaggcaggcgcgcgctcaggcatggttgccgtcgaccaaaccaccatcgactacgtaaaagataaacccttcgcacccgaaggcgaagcgtgggacaaagccgtcgagtactggcgtacgctggtgtctgacgaaggtgcggtattcgacaaagaataccgtttcaacgccgaagacatcgaaccgcaagtcacttggggtacctcgcctgaaatggttttagacatcagcagcaaagtgccgaatcctgccgaagaaaccgatccggtcaaacgcagcggtatggaacgcgcccttgaatacatgggcttggaagccggtacgccattaaacgaaatccccgtcgacatcgtattcatcggctcttgcaccaacagccgcatcgaagacttgcgcgaagccgccgccatcgccaaagaccgcaaaaaagccgccaacgtacagcgcgtgttaatcgtccccggctccggtttggttaaagaacaagccgaaaaagaaggcttggacaaaattttcatcgaagccggttttgaatggcgcgaaccgggctgttcgatgtgtctcgccatgaacgccgaccgcctgaccccggggcaacgctgcgcctccacctccaaccgtaactttgaaggccgtcaaggcaacggcggacgtacccacctcgtcagccccgctatggcagcagccgccgccgttaccggccgctttaccgacatccgcatgatggcgtaa

SEQ ID NO: 5093 - DNA, 1350 bp, Neisseria meningitidis
atgaaattaccggtgatgtcgcccgaacattcggcgcaacttcaggcgtttgaggcaaaaatcctgtccaatcacgccaaaatcgaggcgtggttccgcacgcagtggagcgtacaccgcccgccgttttacggttcggtcgatatacgcaatgccggttacaaaatttcgtctatcgatatgaatttgttccccggcggcttcaataatctgaatcccaactttatcccgctggcggcggttgccgcgcaagatgcggtgcaacgcgcctgcgaaacggcgaaatccgtattgattattcctgaaaaccacacgcgcaatacgttttacctgcaaaacgtttacgccctcggcgagattttgcgttcggcagggtatgaagtgcgcttgggcagcctgaatccggaagtaaccgaaccgaccgaatttgaaaccgcattgggcgacaaaatcctgttggaacctttattgcgtacccgcgatcgcgtccatcttgcagacggcttttcgccttgcgtggttttgttgaacaacgatttgtccgccggcattcccgacatcctcaaaggcatcagccaaaccgttttgccgccgttgcacggcggttggacgacgcgccgcaaaacaaatcatttcggcgcgtacaaccaagttaccgccgaatttgccaagttaatcggcatcgacgaatggcaaattaacccttattttgaaaaaatcggcggtttggacttccaagggcgtgaaggcgaagacgcgttggcggaagcggtagaacgtgtgctggcgaaaattcaagccaaatacgacgaatcgggcattaccgacaaacctttcgtcatcgtcaaagccgatgccggcacttacggcatgggcgtgatgagcgtcaaatccgccgacgaagtgcgcggattgaaccgtaaaaaccgcaataaaatggcgaaagtcaaagaaggcttggaagtcagcgaagtgattgtccaagaagggatttatacttatgaaaccttaaacggcgcggtgtgcgaacccgtcgtgtatatgatggaccgcttcgtcatcggcggctttttccgcgtacacgaagggcgcggtgcggacgaaaacctaaacgccggcggtatggtgtttgttccgctgtctaacagcattcctaccggtaacggcgataattcccaagaagcgcccgaagcctgcaagcgcgtattcgaacaatgggactcgctgggtatgccgcgctctgaaaaagactgcgacgtggacaacgaacacaaccgcctctacgtttacggcgtaatggcacgcctgtcgcttctggcggcttcaatcgagttggaagaaacggcgtaa

SEQ ID NO: 5094 - DNA, 678 bp, Neisseria meningitidis
atgagcatcaagcaatggccggaaggcgaaagacccagggaaaagctgttggaacgcggggcggcggcgttgagtgatgccgaacttttggcaatcctgctgcgcgtcggcacgcgcggaatgagtgcggtcgatttggcgcgttatttgctgcaggagttcggcagtttggggaggctgatgagcgcggaggtcggcaaactgtcggcatacaaagggatggggacggcaagtttcacacagtttgccgtggtcagggaaatcgggcggcggatattggcggaagaattgcaggagagcatcgtcctgtccgatccggatacggtggccgattatttacgctttcatttggggcaggaaaaagtcgaagtcagcgtcgcgctgctgctgaaccgccaaaaccaactgattgcggtcagagagctgtcgcgcggtacggttgcggaaaacacgatttacatccgcgaaatcgtcaaactggcattggacgaatatgccgacagcctgattattgcgcacaaccatccgggcggctcgcccgaaccttcgcaggaagacatcatgttcacaaggcggctggcacaggcaatgtcgctggtcgatgtgtcgctgctcgaccattttatcgttacctcgcaaagcgtctgttcgttcagacagctcgggttgatgccctga

SEQ ID NO: 5095 - DNA, 726 bp, Neisseria meningitidis
atggaaacacaaaacaaacctaccgttaccgacattgaccgccctatactcgtcccgcccggtggacataaaaaagtcttgctgcattcctgctgcgccccgtgcagcggcgaagtgatggaagccatgctggccagcggcatcgactacaccatttatttttacaatcccaatatccatccgcacaaagagtatatgctccgaaaagaggaaaacgtgcgctttgcggaaaagttcggcattcctttcatcgataaagacgacgactacgaaaacgaccgcaaagaatggtttgccaaagccaaaggcatggagtttgagccggaacgcggcatccgctgcaccatgtgtttcgatatgcgttttgaaaaggcggcgcaatacgcgcatgaacacgggttccccgtctttaccagttcgctgggcatttcacgctggaaaaatatggcgcaaatcaacgactgcggacaccgcgccgccgcgccttacgatgatgtggtgtattgggatttcaactggcgcaaaggcggcggcagcgcgcgcatgattgaaatcagcaaacgtgaaaacttctaccagcaggaatattgcggttgtgcctattccctgagggattccaatgcccaccgcaaatcacagggcagaatccccatcaaactcggcgtgctgtattacggcgacgaatcgacacaatacgaacctgcccccatccgggtggacaaataa

SEQ ID NO: 5096 - DNA, 1281 bp, Neisseria meningitidis
atgaaatccctttttattcggctgctcctgttgggttcggcggcaggcgttttctaccatacccaaaaccaatccctgcccgcgggcgaacttgtctatccgtccgcaccgcaaatcagggacggcggcgatgcgctgcactacctcaaccgcatccgagcccaaatcggtttgcacaagctggcacacgcgccggttttggaaaactccgcccgcaggcacgcaagctacctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaagaagccgccgaatcgtccgacagcgacatccgcacgcagcaacgccaagtggacggattaatgagcgcaatctaccaccgcctttccctacttgaccgccatacggatgaggcaggagcggcatttgtgcgcgaaaacggtaaaaccgttctcgtattcaatcagggcaacggcaggtttgagcggcattgcgcccaaggcagaaatcagccggaagcaggacggaaatattaccgcaacgcctgccataacggtgcggtcgtgtacaccgacgaagccatgcccgcacaggagctgctctatacagcctatcccgtcggcagcggcgcactgccttatttccacggcgagcgtccagaccccgtgccggaatatgaaatcacgggcaatcctgccagcattgatttttccgaggcggcaggcaaaattacgatgaaaagtttcaagctgtatcagggtaaaaacgaaatccgccccgtcagggttttaaccgccggcaacgaccccaacggcaggctgaccgcgtaccaattcgcgctttttccgctcaagcctttggaatacggcacgctttatacggcggtattcgactatgtccgcaacggacggcgagcgcaggcgaaatggcagtttagaacccgaaaacccgattacccttattttgaggtaaacggcggcgagacacttgcggttagaaaaggcgaaaaatatttcatccactggcgcggacgctggtgtttggaagcgtgtacccgttatacctaccggcagcgacccggcagccgcctgtccataggaaggcacgaggcgggcggcatcgtcttcagcgttgacggaatggcgggcagccgcatcacgcttgcaccggaaggagaaacggaacgaggcgtaaccctttatttacaggattga

SEQ ID NO: 5097 - DNA, 1179 bp, Neisseria meningitidis
atgacaggcagaacaggcggcaacggcagtacccaagcgcaacccgaacgcgtcatgctggtgggcgtaatgttggacaaagatggtacgggcagtagtgccgcccgtctgaacggttttcagacggcattggcggaagctgtcgagctggtcaaagcggcgggcggcgattccgtgcgcgtggagactgccaaacgcgaccgtccgcacaccgcgctgtttgtcggcacgggcaaggcggcggagctgtcagaagcagttgccgcagacggcatcgatttggtcgtattcaaccacgaactcacgcccacgcaggaacgcaaccttgaaaaagaactgaaatgccgcgtattggacagggtagggctgattctggcgattttcgctcgccgcgcccgcacgcaggaaggcaggctgcaagtcgagttggcgcaattgagccatttggcgggacgcttgatacgcggttacggccatctgcagagccagcgcggcggtatcggcatgaaaggccccggcgaaaccaaactggaaaccgaccgccgattgatcgcccatcggatcaatgccttgaaaaaacagcttgccaacctcaaaaaacagcgcgccctgcgccgcaagtcccgcgaatcgggcacaatcaaaacgtttgcgctggtcggctataccaatgtcggcaaatccagcctgttcaaccggctgaccaagtcgggcatatatgcgaaagaccagcttttcgccacactcgacacgacggcgcggcggctgtacatcagtcccgaatgcagcattatcctgaccgataccgtcggattcgtcagcgatctgccgcacaaactgatttccgccttttccgccacgctggaagaaaccgcgcaagccgatgtgctgctgcacgtcgtcgatgccgccgctccgaacagcggacagcagattgaagacgtggaaaacgtactgcaagaaatccatgccggcgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtcttgtgccgccgcaccaaacacagacgaaaccgaaatgccatga

SEQ ID NO: 5098 - DNA, 2472 bp, Neisseria meningitidis
atgaaaaaaacctgtttccactgcggtctggatgttcccgaacacctccacctgactgtccgttacgaaaacgaagaccgcgaaacctgctgcgccggctgtcaggcggtcgcacaaagcattattgacgcgggcttgggcagttattacaaacaacgcaccgccgacgcgcaaaaaaccgagctgccgccccaagaaatcctcgaccaaatccgcctgtacgacctgcccgaagtccagtccgactttgtggaaacccacggcggcacgcgcgaggcggttttaatgctcggcggcatcacctgcgccgcctgcgtctggctgatcgaacagcagcttttgcgtacagacggcatcgtccgcatcgacctcaattacagcacgcaccgctgccgcgtcgtctgggacgacggcaaaatccgcctttccgacattctgttgaaaatcaggcagataggctacaccgccgcaccctatgacgcgcaaaaaatcgaagccgccaaccaaaaagaacgcaaacaatacatcgtccgcctcgccgttgccgggctggggatgatgcagacgatgatgttcgcgctgccgacctacctttacggcggcgacatcgaacccgatttcctgcaaatcctccattggggcggctttttaatggtgctgcccgtcgtattctattgcgccgtcccgttttatcaaggcgcgctgcgcgacttgaaaaaccgccgcgtcggcatggatacgccgattaccgtcgccatcatcatgacctttatcgccggcgtttacagccttgcgacaaatgcggggcaggggatgtatttcgaatccatcgcgatgctgctgtttttcctgctgggcggacgctttatggaacacattgcccgccgtaaggcaggcgatgccgccgagaggctggtgaagctgattcctgcgttttgccatcatatgcccgattaccccgatacgcaggaaacctgcgaggcagctgtcgtcaaattgaaagcgggcgatatcgtgctggtcaaaccgggcgaaaccatccccgttgacggcacggtgctggaaggaagcagtgccgtcaacgaatctatgctgaccggcgagagcctgcccgtcgccaaaatgccgtctgaaaaagtaaccgccggcacactcaacacgcaaagccccctgattatacgcaccgaccgcaccggcggtggcacgcgactgtcgcacatcgtccgcctgctcgaccgcgccttagcgcaaaaaccgcgcactgccgagttggcggaacaatacgcctcgtctttcatattcggcgaactcctgcttgccgtccccgtcttcatcggctggacgctgtacgccgacgcgcacaccgcattgtggattaccgtcgccctgctggtcattacctgcccctgcgccttatcgcttgccacgccgaccgcgctggcagcttctaccggtacgctggcgcgcgaaggtattttaatcggcggaaagcaggcaatcgaaaccctcgcccaaaccaccgacatcatcttcgacaaaaccggcacgctgacccaaggcaaacccgccgtccgccgtatctcattgttgagaggcacagacgaagcctttgttctcgcggtggcgcaggctttagaacaacagtccgaacatccccttgcccgcgccatcctcaactgccgcatttcagacggcagcgtccccgacatcgctattaaacaacgcctcaaccgcatcggcgaaggcgtgggcgcgcaactgaccgtcaacggcgaaacacaggtttgggcattgggcagggcatcctatgtcgccgaaatttcaggtaaagaaccgcaaacagaaggcggcggcagcgcggtttacctcggcagtcaaagcggtttccaagccgtgttctacctgaccgaccccttgaaagacagcgcggcggaggcggtgcggcagttggcaggcaaaaacctgaccctgcacatcctcagcggcgaccgcgaaaccgccgttgccgaaaccgcacgcgccctgggtgtcgcgcactaccgcgcccaagccatgcccgaggacaaactggaatacgtcaaagccttgcaaaaagaagggaaaaaagtgctgatgataggcgacggcatcaacgacgcgcccgttttggcgcaggcagacgtatccgccgccgcagcgggcgggacggatattgcgagggacggcgcggacattgtgttattgaacgaagatttgcgtaccgtcgcccacctgctcgatcaggcgcggcgcacccgccatattatccggcaaaacctgatatgggcgggcgcgtacaatatcattgccgtaccgcttgccgttttgggctatgtccaaccgtggatagccgcactgggtatgagcttcagttcgctggcggttttgggcaacgccctgcgccttcacaaacgggggaaaatgcagtctgaaaaaatgccgtccgaacaatga

SEQ ID NO: 5099 - DNA, 207 bp, Neisseria meningitidis
atgaggaaaaaaattaaaaagtggatttatgcgataaatggaataatgatgtcaatatggattattttttttccaaataccggttctgtgtatgacggtggcagaacaaccattttcaatgaaaaccatccttttcattttattttctgcataacatttcttattgggacaatttttcttatatatcatgaatataatgataactaa

SEQ ID NO: 5100 - DNA, 777 bp, Neisseria meningitidis
atggcagcattcaatacccaaaaagtattgtccgtacaccactggacagacgcatattttacctttacctgcacccgcgacgaatcgttgcgctttgaaaacggacagttcgttatggtcggattgatggtggacggcaagccgctgatgcgtgcatacagcgtcgcctccgccaactgggaagaacacctcgaatttttcagcattaaagtccaagacggcccgctgaccagccgcctgcaacacctcaaagtcggcgacgacgtgttaatcagcaaaaaaccgaccggaaccctggttgccggcgacctgaatccgggcaaacacctttacttgttgagcaccggtaccggcatcgctcctttcttgagcatcaccaaagaccccgaaatttacgagcaatttgaaaaaatcatcctcgtacacggcgtgcgctacaaaaaagatttggcgtactacgaccgctttaccaaagaattgcccgaacacgaatacctcggtgacttggttaaagaaaaactgatttactacccgattgtttcgcgcgaagaattcgaacaccacggtcgcctaaccgacctgatggtgagcggcaaactgtttgaagacatcggcctgcccaaaatcaacccgcaagacgaccgcgccatgctgtgcggcagccccgcgatgctgaaagatacctgcaaagttttggacgatttcggactgaccgtctctccgaaaacaggcgtacgcggcgattacctgattgagcgtgcgtttgtagatcaataa

SEQ ID NO: 5101 - DNA, 795 bp, Neisseria meningitidis
atgaccttacctatgcaggaaacccgtttttccatactgctagacgaattggcggcaaaacaggaggcagccatcgccccccacctgcttgccgacggaaccaaggtatggatacgcaaagcaggcaggcacaatgcacgatggcgttacgcgctgctcggtatggttgcccgatatttgaaactgggggtgttgaagccggttcccagcctcggcggcgagcctgccattgcaaccgaatcaaaacgcctgtacgaattgcgctcggcggggatagccgttcccgaattgctcgccgtcaggaaaaatgcccttatgttcggcaatttggaaggcatcccgctcgatgcgcaaatccgccaagaagccgaggctggaaagtcggacgcttggcttgccggtttggaagccattgcacgcgtgcataaaaaacggcagttcctcagtcaggcgtttgcgcgaaatatgatgtcggacggaaaaaacatcagctttttggattttgaagacgacccttccgaagtcctgaccatagcgcaatgccaagcccgcgattggctctgctacatccattcgaccgcgctgatattgaaaaacggcggactgctggaagcggctgcggaaaaatggggcggcgtattgtcagatcagcctgccgaaatacaaaagctgattgccgccaccgtcaaaccgatcctcccgatacgcaggctggaacacccccgctggggacgggacgcactcaggctggcagcctcgatttccctgatttcccttgccgatatgccgccgtaa

SEQ ID NO: 5102 - DNA, 1410 bp, Neisseria meningitidis
atgaaatacatcagcacgcgcggcgaaaccgcacacaaaccgttcagcgaagttttattgatggggcttgcccccgacggcggcctgatgctgccggaacattatccgcaaatcgggcgcgaaaccttggacaaatggcgcggtttagcttatcccgaattggcgtttgaaattatgcgcctgtttgttacggatattccggaggacgatttgcgcgacattctgaaccgtacttacacggaagcggcgttcggtactaaggaaatcacccccgtccgcacgctttcagacggcatcaaaatccaagccttgtccaacggcccgacgctggcgttcaaagatatggcaatgcagtttttgggcaatgcgtttgaatatgttttaaacaaagaaggcaaaaaactcaatatcttgggcgcgaccagcggcgatacgggttcggctgcggaatatgccttgcgcggcaaaaagggcgtgaacgtatttatgttgtcgcccgacggtaaaatgagcgcgttccaacgcgcgcaaatgtacagcctgcaagacgagaatatccacaatatcgccgtgaagggaatgtttgacgactgtcaggatattgtgaaggcggtgcagaacgatgccgcgttcaaggaaaaataccatatcggtacggtcaactcgatcaactggggacgcatcgtcgcgcaagtggtttattactttgcaggctatttcaacgccacttcaagcaatgacgaaaccgtcagcttctgcgtaccgagcggcaacttcggcaatgtttgcgcgggacacattgccaaacaaatgggcctgcctatccgccgcctgattgtcgcgaccaatgaaaacgatgtgttggacgagtttttcaaaaccggtgcataccgcccgcgcaacagcgcgcatacttatgtaacctccagcccgtctatggacatttccaaagcgtccaacttcgagcgtttcgtgttcgacctgatggatcgcgatcctgcggaaatcaatacgctgtgggcggaagtggctgcaggcaaaggctttgacctgcgatttgccttggacaaagtcggtggcaaatacggttttacctctggcaaatccacccacgccgaccgcctcgccaccatcaagcaggtttacgagcaagaccaagaactcatcgacccgcacactgccgacggcgtaaaagtcgcccgcgaagtgcgcgaagaaggtgaaatggtggtttgtttggaaaccgcgttggcggcgaaattcgatgcgaccatacgcgaagccgtcggcgatgccgccattccgcgccctgccgcgctggaaggtttggaaaacctgccgcagcgcgtgcaaaccgtgccgaacagtgcggatgcggtaaaaggcatcatcgaacaaacccttgcctga

SEQ ID NO: 5103 - DNA, 372 bp, Neisseria meningitidis
atgaataaaaccttgtctattttgccggtggcaatcttactcggcggctgcgccgccggaggcggtaacacattcggcagcttagacggtggcacaggcatgggcggcagcatcgtcaaaatggcggttgggagccaatgccgtgcggaattggacaaacgcagcgaatggcgtttgaccgcgctggcgatgagtgccgaaaaacaggcggagtgggaaaacaagatttgcgcttgcgtcgcccaagaagcacccgaacggatgaccggcaacgatgtgatgcagatgctggctccgtccacgcgcaatcaggcacttgccgccctgaccgccaaaacggtttccgcctgcttcaaacacctgtaccgctaa

SEQ ID NO: 5104 - DNA, 1470 bp, Neisseria meningitidis
atggaaaaacataatgggacttatcgggatttgcaccgtccagcttcggaatttgcgacgcgggacgaatatttggaacatgaattgcagattatgcaaccaaaacgctggcggcccaacctgccctttcgcgattaccgcttcgagtgggaggatttgattcctgcgatggcgggaacgattggaaaagtggtgatggtgggggcggtggcggcggcgtttgccgcacctttggggctgcctgacagctttgtactggaaaatgtgcgctatgagcttttaatcgccgccgcgtttatcttattggtatcgggcttttttctgcccggcgccaacctgcccggtacgcacgggccgctgattccgatgattcccatcgttgtgtcggcaggcgggcatcctttggcgttcggcatttcgattgcggttttaggtctgctgatggctttatttcgcggcggcagtattatggcgaagctgacaagcaacggcgtatgcggcggattattactctatttgggctttatcggcacgacggggcaggtaaaaaaattgttttcgtgggcaggcggttttaatatgccctacatcgcttttaccgtcattattgtaacgattgtgatgtacgctttgttggagcattggaaaaaacgctggttagccgtgcctttgggatgcttgattgccggtgtggtggcatttgcattgggtgcgccgtttgagtttcacaccgcccccggcctgcctccaatgagtcctgcttattggtggggtgaaaacagcggctggcatctggggttgccgacggcagaaagttttttggttgtctttccatttgcggtattggctgttgcaatgtggtcgcccgattttttaggacatcaagtgttccaaaaaatcagctatccggaaaaaaccgataaggtattgatgaatatagacgacaccatgacaagttgttctgtccgtcaagcagtgggttctattttagggggtgcaaattttacctcttcttggggaacttatatcgtaccggcatcgattgccaaacgccccattccgggcggtgcggttttaacggcggttttatgtattatcgccgggttatggggctatccgatggacttggcgatttggcagccggtattgagcgtagccttggtcgtaggcgtatacttaccgcttttggaagcgggcatggaaatgacgcgcaaaggcaaaaccacccaatccgccgccatcgtggtgttctcttccgccttggtcaatccggttttcggctgggcgttgacgatgctgttggataatttgggcttaatcggctgcaaagagcgcagtgcgcaattaggtttcgccggacgcgtgttgatacccgcagtaggtttcttgatcttgtgtgtggcgatgggtgcggtcgggatgctgcccggtatcccgccgtttttggaacacttcaaatctttgggctag

SEQ ID NO: 5105 - DNA, 915 bp, Neisseria meningitidis
atggatgccgtacaattaaaatcatttgtcgccgtcgcgcacgagggcaaccttacccaagccgccaaacgacttttcctttcccagcctgccgtttctgcccaaattaaagcccttgaagaatatgtcggcacgccgctgttcaggcgcacggggaaaggcatggtattgacgcgggcgggcgaaatactgttgcccgaagcggaatccctgctgcaatacaaacacaagctggagcattttgccaaaacgctggcaggcgattattcggaagagaccagtttgggcattatccaccccatcgattcggcaaaactcgtcgcgctgacggacaatatcggtcaaacagcccccaaaacgcgcctgcacatccaatacggaatgagcggcgaaatcctctcgcgcatccaacacaaaaccctgcacggcggctttatactcggcaacgccgcccaacgcggcatccgcagcgtattcctgcaaaacctgacctacgcgctgatttgcccgcaaagccaatatccccatctgacccgctcccttccgcagagcctgcaagaatgcgtatggatagaaatgtcgggcgtgtccggaagtaggaagcacctgcaccagttttggcgcagcaaccggctctcacccaaaaaacagatcttgtgcgactacccccaaaccattatcgatttggttgcaggcggtataggtgtggcaatggtgccgggaaacaaagccgaagcggcggcaaaagaaggcgcgggcgtggctattatcgaatcgtgccgccacagtatgccgctcaatttcatttatgcggaagaatacgaggataatccccacgtctcactcctgctcgagtgcattgaaaaagtatggggagtgcaggcggtgcagccgcccgttgtctcggacaactga

SEQ ID NO: 5106 - DNA, 966 bp, Neisseria meningitidis
atgagctacacgcaactgacccaaggcgaacgataccacatccaatacctgtcccgccactgcaccgttaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 5107 - DNA, 1911 bp, Neisseria meningitidis
atgaatatattatctgtagaaaacgcttcttttgccatcggccacgttgccttgctcgacaaaacttcttttcaactcgacagcggcgaaaaagtcggcttaatcggacgcaacggcgcaggcaagtcttcgtttttaaaaatcctcgccggtttgcaaaagctcgacgacgggcagattattgttcaaaacaacctcaaaatcgtttatgtaccgcaggaatccttttttgataaggacgcaaccgtatttgataccgttgccgaaggtttgggcgaaattcgtgatttattgcgccgttatcatcatgtcagccatgagttggaaaatggttcgagtgaggctttgttgaaagaactcaacgaattgcaacttgaaatcgaagcgaaggacggctggaaactggatgcggcagtcaagcagactttgggggaactcggtttgccggaaaatgaaaaaatcggcaacctttccggcggtcagaaaaagcgcgtcgccttggctcaggcttgggtgcaaaagcccgacgtattgctgctggacgagccgaccaaccatttggatatcgacgcgattatttggctggaaaatctgctcaaagcgtttgaaggcagcttggttgtgattacccacgaccgccgttttttggacaatatcgccacgcggattgtcgaactcgatcgcggtattttgcgttcctatcccggctcgttctctaaatacagcgagaaaaaagcgcaagagttggcagtcgaagcggaacacaaccgcctctttgacaaattccacgcacaggaagaagcatggatacgcaaaggcatcgaagcgcgccgtacccgcaacgaaggccgcgtgcgccgtttggaagagctgcgccgccagcgtgcagaacgccgcaacgtacagggacaagtcaacttcaagctcgatagcggtgagaaaagtggcaaaatcatcgccgaattggaacacgcttcgtttgcctatggcggcaaagtcattatggacaaattctccgctatcttgcagcgcggcgacaaaatcggcctaatcggccccaacggcatcggcaaaaccaccttccttaagctgattttgggcgaattgcagccgacctacggcagaatccgtatcggcagtaagcaggaagtcgcctatttcgaccagttccgcagcgcgttgaatgaaaacgacaccgtgttttacaccctcggacagggaaacgattacgttgaagtcggcggtaagaaaaaacacgtcatgagctatttggaagatttcctgttccatccagcccgtgcgcaaagccctgtttcatcgctctccggcggagaacgcaaccgccttttgctggcaaaactctttacccgtcctgccaatatcctggtcttggacgaaccgaccaacgacttagacatcgacacccaagagctgctcgaagacctgttgcgcgattatcaaggcacagtattccttgtctcgcacgaccgtatgttccttgataacgtaattacccaaagcattgttttcgaaggacaaggccgtctgaaagaatacatcggcggctatcaggactatatcgacgcaaaatcgcgggaagataaaattcagacggcatccgcacccaaagcatccgatgccgaacccgccaaagaaaaacccaaagccaaccgcacggtcaaactgtcctacaaagagcagcgcgaactcgatgccctgcccgacgaaatcgccgctttggaagccgagcaggctgaaatcaatacccaactttcctatcctgaaattttcaaagattacgaaaaagcaggtgcattgcaaaaccgcgccgaagaaatcgaaatgctgcttttggaaaagctggaacgctgggagctgctggaaaccaaacggaacggcaatgccgtctga

SEQ ID NO: 5108 - DNA, 645 bp, Neisseria meningitidis
gtgcttgcctccgccatcgacttcatcctccatatcgaccaacacctgctcgcgctgtcggcgcaatacggtgtgtggatttatgcgattctgtttttgattgttttttgcgaaaccggcctgattgttacgcccttactgcccggcgattcgctgctgtttgccgccggcgggattgccgcgctgggcggtatggatattcatttgatggttgcattattaagccttgccgccatactcggcgacgcgctcaattttaccgtcggcaaatatttcggcggcaggctgttcgccaaccccgattctaaaatcttccgacgtgaatatctcgataaaacccaccgtttttacgaaaaacacggcggcaaaaccatcatcattgcccgttttatgcccatcgtccgcaccttcgcccccttcgtcgccggtatggggaaaatgcactatgccaaatttatccgctacaacatcatcggtggcttgttgtgggttatcctgttttcttacgcgggctatttctttgccaacttccccgtcgtaaaaaacaatctgggcttggtgatgggcggcatcattattgtttccgtcctgccgggtgcggttgaaattgcccgcgccaaacttgcggtaaaatccaaacggtaa

SEQ ID NO: 5109 - DNA, 819 bp, Neisseria meningitidis
atgaaaaaaacagtttttacatgtgccatgattgccctgaccggtactgccgccgctgcacaagagcttcaaaccgctaatgagtttaccgtccacaccgacctctcttccatttcttcaactcgtgctttcctgaaagaaaaacacaaagctgccaaacacatcagcgtgcgtgctgatattccttttgatgccaaccaaggcatccgcttggaagccggtttcgggcgcagcaaaaaaaatattattaatttggaaacagatgagaacaagctgggtaagactaaaaatgtaaaactgcccaccggcgttcctgaaaaccgtatcgatctttacacaggctacacctacacccaaacgttaagtgattctttaaatttccgtgtgggtgccggcttgggttttgaatcttcaaaagacagcattaaaaccaccaagcatacgcttcacagcagccgtcagtcgtggttagccaaagttcacgcggatttgctttcccaactgggtaacggctggtatatcaacccttggtctgaagtgaaatttgacctcaattcccgctataaattaaacaccggcgttaccaatctcaaaaaagacatcaatcaaaaaaccaacggctggggctttggattgggtgcaaatattggtaaaaaactgggcgaatccgccagcatcgaggcggggccgttctacaaacaacgcacttacaaagaatccggcgagtttagtgtaacaaccaagagtggcgacgtatcgctcaccatcccgaaaaccagtattcgtgaatacggcttgcgcgtcggcataaaattctga

SEQ ID NO: 5110 - DNA, 936 bp, Neisseria meningitidis
atgttcaaagccgtcctgctcggacaatggcacagcctctccgatcccgaactcgaacacagcctcatcacccgcatcgacttcaacctgttttgccgttttgacgaactgagcattcccgattacagcaccttatgccgctaccgcaactggttggcgcaagacaacaccctgtccgaattattggaactgatcaaccgccaactgaccgaaaaaggcttaaaagtagagaaagcatccgccgccgtcattgatgccaccattattcagaccgccggcagcacacagcgtcaggtcatagaagtcgatgaagaaggacaaatcaacggccaaaccacaccgagtaaggacagcgatgcccgttggatcaagaaaaacggcctctacaaactcggttacaaacaacatacccgtaccgatgcggaaggctatatcgagaaactgcacattacccccgccaatgcccatgagtgcaaacacctgccgcctttgttggaaggactgcccaaaggtacgaccgtctatgccgacaaaggctatgacagtgcggaaaaccggcaacatctggaagaacatcagttgttggacggcattatgcgcaaagcctgccgcaaccgtccgctgacggaaacgcaaaccaaacgtaaccgatatttatcgaagacccgttatagtggattaaatttaaatcaggacaaggcgacgaagccgcagacagtacaaatagtacggcaaggcgaggcaacgccgtactggtttaaatttaatccactatatgtggtcgaacagagcttcggtacgctgcaccgtaaattccgctatgcgcgggcagcctatttcggactgattaaagtgagtgcgcaaagccacctgaaggcgatgtgtttgaacctgttgaaagcggccaacaggttaagtgcgcccgctgccgcctaa

SEQ ID NO: 5111 - DNA, 1251 bp, Neisseria meningitidis
atgttttcaaaaagcgttaccctcgcacaatacgaccccgatttggcagcagccattgcccaagaagaccaacgccagcaagaccacgtcgagctgattgcttccgaaaactacgtcagctgcgccgtaatggacgcgcaaggttcccagctgaccaacaaatacgccgaaggctaccccggcaaacgctactacggcggctgcgaatacgtcgatattgtcgaacaattggcgattgaccgcgtaaaagaactgtttggcgcagcctatgccaacgtccaaccgcactccggctcgcaagccaaccaagccgtgtacgcttccgttttaaaaccaggcgacaccattttgggtatgtctctagcgcacggcggccacctgacccacggcgcgagcgttaatatctcaggcaaactctacaacgccgttacttatggtttggatgaaaacgaagtgctcgattatgccgaagtcgaacgcctcgcgctcgaacacaaacccaaaatgattgtggcgggtgcgtctgcctacgcgttacaaatcgactgggcaaaattccgcgaaatcgccgataaagtcggcgcatacctctttgtcgatatggcgcactatgccggtctggttgccggcggcgaatatcccaacccggtgccgttctgcgacttcgtgaccaccaccacccacaaaaccctgcgcggtcctcgcggcggcgtaattttgtgccgcgacaatacccacgaaaaagcgttgaactcttccatcttcccaagcctgcaaggcggtccgctgatgcacgttatcgccgccaaagccgtggcgtttaaagaagcattgcaacccgagttcaaacaatacgcaaaacaagtgaaaatcaatgcagccgccatggcggaagagttggttaaacgcggtttgcgcatcgtttccggccgcaccgaaagccacgttttcctcgttgacctgcaaccgatgaaaattaccggcaaagccgccgaagccgctttgggcaaagcgcacatcaccgtcaacaaaaacgccattccgaacgatccggaaaaacccttcgttacctccggcatccgcatcggctccgctgccatgaccacacgcggttttaacgaagccgacgcgcgcgtattggcgaacttggttgccgacgtattgtctaaccccgaagacgaagccaacctcgccaaagtccgcaaacaagtaactgctttgtgcaataaataccccgtttacggcgcgtaa

SEQ ID NO: 5112 - DNA, 213 bp, Neisseria meningitidis
gtggtgtatcagcgggttatggctgataaagatgtggttggtgctggttatttgattgattttgcacaaactgccgaaaatttaccatttaatgtattgcttttgattagtcttgtactaaataaaggtaatgagacgctaaaaaccagcatgttaaataaattacctgataatgccaaagaaaatttacgcattatgggctatctgccttag

SEQ ID NO: 5113 - DNA, 1821 bp, Neisseria meningitidis
atgccttgtatgaatcatcaatcaaactcaggcgaaggagtgcttgtggctaaaacatatttattgactgcattgataatgtctatgacaatctctggatgtcaagtcatccatgccaatcaaggtaaggttaatactcattctgctgtcatcacaggtgcagacgctcacacgcctgaacatgcaacgggactgaccgaacaaaagcaggtgattgcaagtgattttatggtagcgtcagccaatccattagcaacacaagctggctatgatatcttaaagcaaggcggtagcgctgcagatgcgatggtggcggtgcagacgacactaagcttggtagagccacagtcgtcaggcttgggcggtggtgcatttgtgttgtattgggataataccgccaaaacattgaccacatttgatgggcgtgagacggcaccgatgcgtgcgacgccggaattatttttggataaagatggtcaaccattgaaatttatggaagcggtggtcggtggtcgctcggtgggtacgcctgctatccctaaactgatggagacaatacatcagcgatacggtgtattgccttggggaaaattatttgatacaccgatccgcttggcaaaacaaggctttgaggtgtcgccaaggcttgccatctcggttgagcaaaatcagcagcatttggcacgctatccaaaaacagccgcttattttttgccgaatggtgtgccgctacaagcaggcagcttgctgaaaaatttagaatttgctgacagtgttcaggcgttagcagctcaaggtgcaaaagctctgcatactggtaaatatgcccaaaatatcgtttcagttgtccaaaatgctaaggataaccccggtcaattatccttacaagatttatctgattatcaagtggtggaacgcccgcctgtttgtgtgacttatcgtatttatgaagtatgcggtatgggtgcaccaagctcaggtgggattgctgtgggtcagattttggggattttaaatgaattttcacccaatcaggtggggtatgatgctgaaggtttacgtctcttgggcgacgcttctaggcttgcgtttgcggatcgtgatgtatatttgggcgaccctgattttgtaccagtacccattcgccagttgatttctaaagactacctaaaacatcgcagccagctgcttgagcagtcggataaggcattgcctagcgtatctgcaggcgattttattcatgagtgggtgtcctcacaagcgattgagttaccttctaccagtcatatatcaattgtggataaggcgggcaatgtgctatcaatgacgacttccattgaaaatgcgtttggctcaactttgatggcaaatggctacctgctgaataatgagctgacagactttagttttgagccaataaagcagggcaaacaggtcgccaatcgtgtcgagcccggcaagagaccacgctcctcaatggcaccaaccatcgtatttaaagcaggcaagccttatatggcaatcggctccccaggtggtagccgtatcattggctatgtcgctaagacgattgtggcacatagtgactggaatatggatatccaaaatgccatcagtgcacccaatttattaaatcgctttggtagctatgaactagaaacgggtacaaccgccgtccagtggcaacaagcattaaatgatttgggctataagactgatgtgcgtgagctaaattcaggtgttcaagccattattatcgagccaagcaggctggttggtggtgccgatccacgccgagaaggtcgagtgatgggtgattag

SEQ ID NO: 5114 - DNA, 263 bp, Neisseria meningitidis
atgaaaggcacgccccagtttccccaatgtggattttcagcgcgtgcagtagaggtgctgacccaattggcagaccctttgcttttgttaatatcctagaaaacccagaaattcgcagtactctaccactcatcgccagtcggccaacctttccacagctttgggttaatggtgagttaatcggtggtagtgatattatcctacaaatgtaccaatcaggtgagctaaaaccactcattgaagagcatagcccaaaggtctga

SEQ ID NO: 5115 - DNA, 219 bp, Neisseria meningitidis
atgttcccagaataccgtgatttgatttccaaattgaaacaggaaaattcccgcttcgcccgtctgttcgacgaacacaacgagctggacgataaaattaccggtctggtcaacaatccggttaccagcggtgcggaaaccatcgatgagctgaaaaaagccaaattgaaactgaaagacgagttgtacgccatcctgcaaaaagcagcgggaaaataa

SEQ ID NO: 5116 - DNA, 975 bp, Neisseria meningitidis
atggacacactgacccgattcctccccgaacacctgcaacaaaaccagctgcccgaagcactcggcggcgttttactgtccgttgtttccgcctgcaccgaaatcaacgccaaagtccgcctcggcgcactggccggcgtattgggtatggcgggcacgggcaatattcagggcgaagaccaaaaaaaactggatgttatcgccaacaacatcatgattgacacactcaaagccaattctgccgttgccgggctggcgagcgaggaagaagacactttcgtaaatgccggtgaaaacggacgctatctcgtcctattcgaccctttagacggatcgtccaatattgatgtcaacatttccgtcggtacgattttctccatccttgaaaaacccgaaggcgcattggcaaccgaatcattccttcaaacgggcagacagcagcttgccgctggttacgttctttacgggcctcaaacccagctcgtattcacattcggacatggcgtatatatgttcacgctcaatgccgaaaacgaatttgtgctgaccaaagaaaacccgaaagtacccgaaagtaccaaagaatttgccatcaatatgtccaaccgccgccactggctgccccccgtccaacaatacatcgacgagctcttggcgggcgaaaccggtacgcgcggcaaaaactacaatatgcgctgggtagccagtatggttgccgaaatccaccgcatcctgatgcgcggcggcgtgttcatgtatccgcaagacaaacgcgaccccgctaaacccggcaaactgcgcctgatgtacgaagccaaccctatgagcctgatactcgaacaggcgggcgcatcggcaagcaacgcatatcaagccatgctcgacatacagcccgaaaacctgcaccaacgcgtcgccgtcttcatgggcagcagcgaagaagtcgcctatctcgaccgcctgcacgcaaaatag

SEQ ID NO: 5117 - DNA, 846 bp, Neisseria meningitidis
atgctcagttacagacacgcattccacgccggcaaccacgccgatatgctcaaacatttcaccttgtttttagtgctgcaatatttcaaccgcaaagacaagccctactggtacatcgacacgcacggcggcgcgggtgtgtacaatctcgaaggcagcgaggcgcagaaagtcggcgaataccgacaaggcatcgccctgctccgacaggcgcaaaacctgcctgccgaactctctgactttgccgcgcacatacaaaaaatcctgccctcgcccaaactttactgcggttctccgtggctggcgcaatcgctgacccgcgtcggcgacaaattacgcctgtttgagctgcaccccaccgactttgtccatctgcaaaacaatatgggcgaagcaggattgggcaaacgcggacaagtattacgcgaagacggttacaaagggctgatttccctgctgccgcccccgccgcgccgcgccaccgtcctcatcgacccgccctatgaggaaaaacaggactaccggcgtgtaacggaaacgctgaaagccgctttaaaacggtttgagtccggctgttatctcatttggtatccctgcctcagccgcgaagaaagccgcaagctgcccgaagaattgaaaaaactcctgcccgacaactaccttcacgccgaacttcacgtccacgcgccgaaagccgacggtttcggtatgcacggcagcggaatgttcgtcatcaatccgccctatctgttggcggaacaattggcggcaaacctccccgccctgacgcggctgctggcgcaagacgaaggctcgcgctaccttttggacagcaaaatccgctga

SEQ ID NO: 5118 - DNA, 603 bp, Neisseria meningitidis
atgttcaacataccggctgttgctgtttcctatctgatcggctcactttctttcgccgtcatcgtgtccaagtattacggcatggacgacccgcgcacctacggatcgggcaatccgggggcaaccaatgttttacgcagcggcaaaaaaaaggcggccgcgctgacgctcttgggcgatgccgccaaaggtttagttgccgttttgcttgcacgcgtgcttcaagaaccgctcggtttatccgacagcgcaatcgcggccgtcgcactcgccgcgctggtcgggcatatgtggccggtgtttttcggatttaaaggcggcaaaggcgtggcaacggcattgggcgtgcttctggcactctctcccgcaactgccttggtctgcgcgttgatttggcttgttatggcattcggcttcaaggtgtcctcccttgccgcattaaccgccacaatcgccgcaccggtcgccgcatccttctttatgccgcacgtctcgtgggtttgggcgaccgtcgccattgctttgctggtgttgttccgccacaaaagtaatatcgtcaagctgctcgaaggcagagaaagcaaaatcggcggcagccgctga

SEQ ID NO: 5119 - DNA, 357 bp, Neisseria meningitidis
atggataaaatctttttgcacggcatgaaggcagatacgcttatcggcgtgtacggctgggaacgcgaacggttgcagaccctgattgtcgatttggacatcggtgttcccgagaaagcgggttcggacgacgatattgccaatacggtgcattatgccgaggtatgcgaaacgctgcgccgacatctgaaagaacaggatttcctgcttttggaagcgttggcggaatatattgccgatttggttttgggatatttcggcgcggtgtgggtgcgcgtgaaaatcgtcaagccgggtattttggaaggcgtgcgcgaggttggcgtggaaatcgagcgcggcaagcgtgaagattga

SEQ ID NO: 5120 - DNA, 537 bp, Neisseria meningitidis
gtggatttgagggaagtaaaattaggcggcgaaaccatttacgagggcggtttcgtcagtatcagcagggataaggtcaggttgcccaacggcaatgaagggcagcgtatcgtcatccgccatccgggtgcggcatgcgtgttggcggttacggacgaagggaaagtggttttggtgcggcagtggcgttatgcggcaaatcaggcgacattggaacttcctgcgggcaagctggatgtggcgggcgaggatatggcagcgtgtgcgctgcgagaattggcggaggaaacaccttataccgccgacagcgtacgcctgctttacagtttttatacggcggtcggtttttgcaacgaaaaaatgtatctgttcgaagcggaaggcgtgcgtttgggcagtacgcttgccaatgacgaagacgagattacggaaaccgtattgatgtcgaaagaagaagtccgtcaggcattggcaaacgatgaaattaaagacggcaagacattaatcggtttgcaatactggttgatgaaggattga

SEQ ID NO: 5121 - DNA, 360 bp, Neisseria meningitidis
atgctttccaacatcatccccctttccatcggtgcggcactcggtgcaacggcgcgttggctgctcaacctcgccgttcccgcatcaatacctcccgccacaggcaacctgtttgccaactggataggcgcttttcttatcggaatctttgccgaaaccgtcaaccacccgcaatggaagctgctgctgattaccggttttctcggcagcctgaccacgctttccggattttcgctggaaaccgtaaccctgctccaattgaaccgtcccgcttcagcacttgccaatattttcctgcacacggcaggttcgctgctgctgacctggctcgggctgaagataggggcggcagtcaaataa

SEQ ID NO: 5122 - DNA, 681 bp, Neisseria meningitidis
atgattttccaaacagtctggttttcagatatggtactgtcggtttcgtggattgtccttatcctgatactggcagcttccgcgccgtcggcattccgctcgcttgcccgctaccgttccgcccttcccctgtgtaccgtaattttttccgcagcatggtgtctgaacgcctctgccggcggcggacagcttgcccagatgaactaccacctgctcgccgtcaatttggttgcactgatgatgggcacttccgccgccctttggcttgccgcgctgctgatgctgccctactgcctgctgtttgccggttctgtcggcgcatatccgccgaacgctttggtgctgatactgcccgcgctgaccgtcaaccgcctgtcgcgtatgctggtcaaccgcctgccgcccaatattttcatctttattttcgtcaacggctttctcgcttccgccgccggcattctgctgaccgggctggtgctgaccggtattttggatgccgcaaacgcttttccgtccgaaatattgtggacgaccgccctgcccgtctttattctgctggcgtgggcggaagccttcctcagcggcatttcaactgccatatttgttgcactgaagccccattggattaacactttcgacgacaaccgctatcttaagtccgaccgcggcatatggcggtag

SEQ ID NO: 5123 - DNA, 3045 bp, Neisseria meningitidis; identical to SEQ ID NO: 489

SEQ ID NO: 5124 - DNA, 1263 bp, Neisseria meningitidis
atgtcaaacacacaaaaacagcttgcccttgccaaagcggcaaaaaaatccgtcaacacggcggatacggaagaaaaaaaccgcgcgctgcttgcgatggcggacagcttggaagcggcgacggcagatattttggcggcaaaccgtcaagacttggaagccgcggcaggcaacattcccgaaagcatgaccgaccgccttttgttggacggcaaacgcatttgcgcgatggcggacggcatcagggcggttgccgcgctgcccaaccccgtgggcgaaatactggaaacctcgactttgcccaacggcttggaaatcgtcaaaaagcgcgtggcgatgggcgttatcggcattatttacgaaagccgcccgaacgttacttccgatgcggcggctttggcactgaaaagcggcagcgcggtcgtactccgcagcggcaaagatgcattccaatccgcacgcgccatcgttgccgccctgaaaacggggttggcgcaaacccgcatcgaccccgacgcgctccaactgattgaagacaccgggcgcgaaagcagttacgaaatgatgagggcgaaagattatctagacctgctgattccgcgcggcggggcggggctgatacgggcggtggttgaaaatgccgtcgtgccggtcattgaaacgggaacgggcattgtccacatttatatcgacaaggacgcggattgggacaaggcgctccgtatcgtgtacaacgccaaaaccagccgtccgtccgtgtgcaactcgatggaagtgctgctggtacatgaagacattgctgccgacttcctgcccaagctcgaacggctgttggttcgcgaccgcatagaagccggactgccgcccatccgcttccgtttggatccgcaggcggcgcggcatatcggcggcgaagcggcgggtgcagacgatttcgataccgagtttttagactacatcctcgctgtgaaaaccgtcgcttcggtcgaagaggcggtctggcacatcgaaacccacagcacacaccattcagacggcatcgttaccgaaaaccgccacgctgcggactatttcacgactcatatcgattctgccgccgtgtatgtcaacgcgtccacgcgctttaccgacggcggcgaattcggcttgggttgcgaaatgggcatctccacgcaaaaactccacgcccggggcccgatgggtttgaaagagctgacgagttacaaatacatcgtacaaggcacgggacaggtcagggaataa

SEQ ID NO: 5125 - DNA, 1110 bp, Neisseria meningitidis; identical to SEQ ID NO: 1501

SEQ ID NO: 5126 - DNA, 1554 bp, Neisseria meningitidis
atgacacagaccaaccgcgttatcattttcgacaccaccctgcgcgacggcgaacaatcgcccggcgccgctatgaccaaagaggaaaaaatccgcgtcgcccgccagctggaaaaattgggtgtggacatcatcgaagcgggttttgccgctgccagcccgggcgatttcgaggcggtcaatgcgattgcgaaaaccattaccaaatcaacggtctgttcattgtcccgcgccatcgagcgggacatccgtcaggcgggtgaggccgttgcgcccgcgccgaaaaaacgcatccacaccttcatcgccaccagccccatccatatggagtacaaattgaagatgaagccgaagcaggtgattgaggcggcggtcaaagcggtgaaaatcgctcgtgaatacaccgacgatgtggaattttcctgcgaagacgcgttgcgttcggaaatcgatttccttgccgaaatctgcggcgcggtgattgaagcgggcgcgaccaccatcaatattcccgataccgtcggctattccatcccgtataaaaccgaagaatttttccgcgaactgattgccaaaacgcccaacggcggcaaagtcgtttggtcggcacactgccacaacgatttgggcttggcggttgccaattcgcttgccgcattaaaaggcggcgcgcgtcaggtggaatgtactgtcaacggcttgggcgaacgtgcaggcaatgcttcggttgaagaaatcgtgatggcgttgaaagtgcgccacgacttgttcggcttggaaaccggcatcgataccacgcaaatcgtgccttcgtccaaactggtgtccaccattacgggctatcccgtgcagcccaacaaagccattgtcggtgccaatgccttttcgcatgaatcgggcatccatcaggacggggtgctgaaacaccgcgaaacttacgagattatgtccgccgaatcggtcggctgggcaacaaaccgtttgagcttgggcaaattgtccggccgcaacgccttcaaaaccaagctggcggatttgggcatcgagttggaaagcgaagaggcactgaacgcggcatttgcacgcttcaaagaactcgccgacaaaaaacgcgaaatcttcgatgaagacctgcacgcactggtatccgacgaaatgggcagcatgaatgccgagagctacaaattcatctcccaaaaaatcagcaccgaaaccggagaagaaccgcgcgccgacatcgtgttcagcatcaaaggtgaagaaaaacgcgcttccgcaaccggttccggccccgtggatgcgattttcaaagcgattgaaagcgtggcgcaaagcggcgcggctttgcagatttattccgtcaacgccgtcacgcaaggtacggaaagccagggcgaaaccagcgtccgtctggcgcgcggcaaccgcgtcgtcaacggtcagggcgcggataccgacgttttggtcgccaccgccaaagcctacctttccgctttgagcaagctggaatttagtgccgccaaaccgaaagcgcagggcagcggtacgatttga

SEQ ID NO: 5127 - DNA, 663 bp, Neisseria meningitidis
atggattcccgaaaatttaccgaagcatccaaacggcggttgagcgaattgttggatgccaaaagcgaacaaggcaacacgatgcgttgcgacgaggttcaaggttttatgacggcgctgttgagcgggccggacaaattgacaccgctcgactggctgcccgaagtgttgggcgacgaatcgcaatttaccgccgccgaacgttccgaaatcgaacggctggttttggcaatggcgatggaaacaaccgccgcgatgtcggataaaaaactgcccgatttgtggctgtatgaaaacgaagacggcggcagcgatttttacacatggtgcaatgcttatctttacggtttggatattgtgccgaccgattggtttgaagccgtcgatgatgaagcgtttgaagagttgttttatcccatcatggcattgggcggtatttacgacgaagaggaaaacggcgctatccgtctgcaattcacagaaggcgagctggcggaactggaatccgagttgccttatgcattggcggatatctaccgctactggcaggcagtcatcaacaaaccgcaaaccgtccgcagggaaggcgaaaaaacaggcaggaacgatccctgtccgtgcggcagcggcagaaaatacaaggcgtgttgcggtaagaattga

SEQ ID NO: 5128 - DNA, 852 bp, Neisseria meningitidis; identical to SEQ ID NO: 1513

SEQ ID NO: 5129 - DNA, 1131 bp, Neisseria meningitidis
atgattaaaatcagcacccgcttcgatgccggctcggtcgtcgtcaaagacctgaccgatccttccaacatccgcctcgccctgcgtcccgacaacgcctccgattttgcacaatggttctacttccggctgcaaggcgcggcatatcaaaactgcatcatgcattttgaaaacgcggcagaagccgcctacccgaaaggctgggaaggctatcaggcgtgtgcctcatacgaccgccgcaactggttccgcgtaccgacttcctacgaaaacggcgtactgaccgtcaatcatactccgctgtccaacagcgtgtattacgcctatttcgaaccttactccgaagaacagcatttaaacctcctcggcgacgcgcaaggcagcggcctgtgccgcatcgacgacttgggcagcaccgtgcaagggcgcgacatcaatctgctgaccataggcaatcaggtcgaaagcgatttgaaaatctggattaccgcccgccagcatccgggagaaaccatggcggaatggtttatcgaggggctgctcggcagattactcgacccgcaagaccctaccgcccgcgccttgctcgaccgcgccacgttctatatcgtccccaatatgaaccccgacggttcggcactgggcaaccttcgtaccaacgccgccggcgcgaacctcaaccgcgagtgggaaaacccgacggtagaaaaaagcccggaagtgttcttcgtgcgcgaaaaaatgctggaaaccggagtggatttgtttttggacatccacggcgacgaagggctgccctttgtctttgtcgcaggtacggaaggcgtgccgaactacaatccgcgcatcgccgcgttggaagcgcagtttaaaaatgcccttttaaacgccagccccgatttccaagacgaatacggttacgaaaaagatgcgccgggcgaagcgaatatgaccttggcgaccaactgggtcggcaaccgtttcaactgccttgcctatacgctggaaatgccgttcaaagacaatgccaatctgcccgacgacgacttcggctggaacggtcagcgttctttacggctgggcgaagccgcgttgtccgctatcctcaacgtcatcggcgatttgcgctga

SEQ ID NO: 5130 - DNA, 897 bp, Neisseria meningitidis; identical to SEQ ID NO: 1519

SEQ ID NO: 5131 - DNA, 669 bp, Neisseria meningitidis
atgaaaaacctcgccatcttcgacctcgacaacaccctcatcaacaccgattccgaccacgcctggccgcaatacctcatcaaaaaaggcttggttgacgctgccgaaaccgaagcgcaaaacgaaaaattctaccgcgactaccaaaacggctgcctcgacatcgacgcattcctcaaattccaccttgccccgctcgctcgttacagcaaagaagagctggcagagtttcaccgcgaatttatggcggaatacatcatcccccacatctcgcctatgcagcgtatgctggtgcagagccaccaaatggcaggcgacgaaacccttgtgatttcctcaaccaacgagttcatcatcacccccgtctgccaccttttcggcatcaccaacatcatcggcacacaactcgaaaccggttctgacggccgctacaccggcaattacatcggcacgcccagcctcaaagaaggcaaaatcacccgcctgaaccaatggcttgccgaacgcggcgaaacgctccaaagctacggcaaaacctatttttacagcgactccaaaaacgacctgccgctgctgcgccttgtcagcgaacccgtcgccgtcaaccccgatgccgagctggaaaaagaagccaaagaaaaaggctggccggttttgaatttcaaatga

SEQ ID NO: 5132 - DNA, 669 bp, Neisseria meningitidis
gtgaaccagcttattttcgactttgccgcacacgactatccgagtttcgacaaattcctcggcacggaaaacgcggaactggtctatgtcctccgacacaaacacggacagtttatctatgtctggggtgaagaaggcgcgggcaaaagccatcttttgcaggcgtgggtcgcacaggcgctcgaagccggcaaaaacgccgcctatatcgatgccgcctccatgccgctgaccgatgccgcgttcgaggcggaatacctcgccgtcgatcaagtcgaaaaactgggcaacgaagaacaagccctgcttttttccatcttcaaccgcttccgcaacagcggcaaaggctttttgctgctcggttcggaatacacgccccagcagcttgtcatccgcgaagatttgcggacgcgtatggcgtactgcctcgtttacgaagtcaaacccttaaccgaccaagaaaaaatcgacgcgctcgccagtatggcggcggcacgccaagtaaccgtcgattccgaaattttcgaatacctgctcaaacactggcggcgcgatatggacagcctgatgatgatgctcgacacgctggacaactacgccgtcacgatgggcaaacgcatcaccctgccgcttttgcgccagcttttgaaacaacaggaaacccaatga

SEQ ID NO: 5133 - DNA, 552 bp, Neisseria meningitidis
ttgagcggcatcaacataaacctcaaaaacggcgattccctgctgatacgcggcccgagcggttgcggcaaaacctcgctgttgcgcgcgctggcggggctttggccgttcggcagcagcggcaaagtcagccgtccgccgcatcaagacatcctcttcctgccgcaacgcccgtacacggcacagggcagcctgcgcgacgcggtttgttaccccgacattgacaagcagcatcccgagttagccgaagccatgaacacctgccgcttgggttatctggttgataaattagataaaaccgacgactggcaacacaaactctccccgggcgaactgcaacgcgtcgccttcgtccgcgccctgctttccaagcccaaaatcgtcctgctcgacgaagccaccgccgctttggacgaaccgaccgaggccctgctctaccgcgcactgaaacaaaaactgcccgacagcatcatcatcagcatcggccaccgcagcacgctcaacgcgttccacaatatgcgcctcgatgtcggcaacgttgcctgcggttga

SEQ ID NO: 5134 - DNA, 709 bp, Neisseria meningitidis
atggatacttttttagataggctcaaatttctttggcctcatggggctaagccatctgacatctataacaaaatagaaatgtcggcttctggatttaatagagtttggaaagagggagctatcccaacagccgattacctagtaaaaattcagttgtgatttaaactggctgctgaccggaaaaggcttgccgtatctcgataaagccaggccggaaaacgccggagcattctctgtaagtagaaattctgatggaatcaccgacactatgggcaatcctgtcgacctgtccgagtttgtattcgtgccgcgctacaacgtagccgcagcagcagggtatggcgcaccagtcttcggcgaagaacctttattctgcttggctttccggaaatattggattgacaactatgtgaccaaacagccggaaaaactgtctgtaattaccgttaaaggcgattcaatggagggcgtgctcaatcatgaggattccattctcatcaaccacgccgaaactgacccgcgtgacggcctatatgtcttgcgtataggcaatgacctctttgtcaaacgtgtgcaacgtataccgggcaaactgcttgtaacgtctgaaaatccacgttacgcaccgtttgaaatagatttgagcaatgcccaagacgacatcgccatcataggccgtgttgaatggtatggccggagtattgattaa

SEQ ID NO: 5135 - skipped

SEQ ID NO: 5136 - DNA, 263 bp, Neisseria meningitidis
atgaaaaaaagcaagaaagcatgactgattggcatcgtgctgacattgtggctcgtcttaaaaaggcaggctggtctgtgagagcgttatctatcgaggctaatttagcaccaaatacattagggaaagctttagatgctccttatctgaaaggcgaaagaatcattgcagcagcgattggagtacccgcagaagaaatctggccatctcgttttgagaaacgaaaccataagccaaccttcccaagatctataaatagataa

SEQ ID NO: 5137 - DNA, 1986 bp, Neisseria meningitidis
atgaaaatatctgcatctgatattgcgaaattaggaattccgagcctaccaactgatagacaagggattgaataccatgccaagaaaaataattggcaacactgttttgagcaaaaaggaagaggccgtcctaaaaaactgtatgaaatcgcttccctccctgccgaaatccgagcagccatcatgaaacggcagtcggacgagctggcggagaagatgccgaaaatgctgcccaaagtcagaccggggacggcgatgtcggctcaagcactggctgaagcggccaagctgttgaacgagaaacaacggtcggtggcggatgcgcgatgtgcggtggtagcggcggtattggggattaaatacgaatacgattgctctgccaaggctgcggtggctcagtttttgggcttgctggcagaaggtaaattggacgcggtcacgcttgggaacttggaaaaggccaatgaccgcagccggacggcgaaggtcggcgaacgtactttagacggctggatttctgcttatttgaaagcggaaaacgcgacggagcggttggttgctttggctccgaagacgacgaaggcggtcaagccgattgaaagttacggatggttgccgatgtttatgcagtttcacaatattccgtccgcgccaaagctggcgcacagctaccgctggtttgtgcagtgggcggaagcggaaaatatgccggtcaatgatgtgcctaacttgagtatggtgcggcgcgtttgggaaaagctcccgttgattatgcaggagcgcggcaggaaaacgggggcggcttataaatcgctgctgccttatgtgaaacgtgattggggggctttgaagccgaacgatgtttggatcggcgacggccatagctttaaggcaaaggtggcgcatccggtacatggcagaccatttaagccggaagtgacggtgattattgatggttgtacgcggtttgtggtcgggttttcggtctctcttgctgaaagttgtgtggcggtatcggacgctatgcgtatcggggtcaagcattttggtttgccgattatctattactcggataacggcggcggccaaaccggcaagacgatagaccatgaaatcacgggtattacgtcccgaccgggtatccgccatgaaacgggtatcgcgggcaacccgcaagggcgcggcatcattgagcgatggtggaaagacaatctgattgagatggcgcgccagtatgagacgtttgcgggtgcagggatggacagcagcacgaagaacctgatgtaccgcaagatggaaagtgcgtttaacgctttggaaaaaggcaaggatttgacggaggaacaacagaaatatttgaaaaaactgccgagctggtcgcgttttatagcggatgtggtcaagtgtatcgacgaatacaacaaccgcccgcacggcgagctgccccgacatcctgacggcgggcattatacgcctaaggcttatcgggaaatgaggctggaacaggacggtatcgcgccggatatgttgtcggcgcaagagctggcgacgatgtttatgccgcaagaggtgcgaaaggtacagcgcggttggctggatttgtttaacaactcttatttctcaaccgagctggcggagtatcacaaagacgaggtacgggtcagctacgatttgagcgatgcgtcggcggtcaatgtgtttgatatggacggcaagtttattactaaggcgcaggccaacggcaatacccgcgaggctttcccgacggctcgtatcgaccaactggcggaaaaacgtcgaaaaggcaaaataaagcgggcggaaaatgcaatcaagctcgcaaacgcggaagtcaatcctgctctggaacaggctgcggtttgggacgagctgggacatttgggcggaaacgacatcgaggcggagtatgcggtattgccgaaaacgggcacagacgattttgtgttgtttgaggcggatagataa

SEQ ID NO: 5138 - DNA, 201 bp, Neisseria meningitidis
atgatggacaaacagcaaaatgcagcgttttcggccgagcttgttgaaaaattgaaactcaagcgagctcttgggcggattcaacgagctcaagcaaagattcaaggtgttcccgctgaacggaatcaggctcaaacgtttttgcctgcgcttgaaggaaactgcgaacctgctcaatcgaagtcggctcttgacgggtaa

SEQ ID NO: 5139 - DNA, 1173 bp, Neisseria meningitidis
atgaaacaaattaatcaagcattgcaacaaaaactggttgaatttaaagaaaaatcaggcatgaaccaaacccaactggcacgcggtatcggtacttcgccggcatccatcagtatgtatctgaacggcacttatgcggaaaaaggcggcaattatgaaaccatcgagccgaaaatcgaggcgtttttggagatgcaggacagtaaagcgcaacgcgaagagctggtgttgggttttgtatcgactaagacgacccgccgtattgcagaagtgatgcgcgatgcgcacgaaggcggcgaaacagtggtgatctacggtcaggcgggattgggcaagactcaggcggtcaaaaactactgcgagaaaaaccctgcggccatcttgattgaggctaatccgagctttacggctttggtcttgatgcgcaagttggcgactgcggcgaaggtatcggcgatgggcagcctgaatgatttgtttgagtctgtatctgaccgcctgcgcgattcgggccgtctgattgtggtcgatgaagcggaaaacctgcctttacgcgcccttgaaattgtacgccgtctgcacgacgagactggctgcggcttggtgttgagcggtatgccccgactggtggccaacctgcgcggtaagcatggcgaactggtacagctttacagccgcgtgtctgttgcgctgaatttgggcgaatctttgccggatgacgaactctttgagattgcgaaagcggctttgcctgatgcggtcaagcatctgctccctgatagtgtacaagcgttgattacggtcatcgggtttaatgaaacgctggagctggtgcgcctgatgggcggtacgacttatcctttgcggcagggttatacgaaaaacagtcaatcccgtgttgcatacttggaagagattatcggcagtgaggcggccggtcggctggtggaggcaatggctccgtgcaatctgtttataccccgttgcgagacggccttgtatgagttgcgaaaccgtaaaatccgcagtcagtttgaccggcagacggcaggcggtacccctgcttatgaggccgttaacgatttggccttggcacaccgcctaagcgaccgccatgtgtggcgaattttaaagcaggcggataaggaagcggagcaggagaatttgttttag

SEQ ID NO: 5140 - DNA, 522 bp, Neisseria meningitidis
atggaatgccatgcagatgtatggcattttattttggagaaaaatatgaaaaagttttattttgtgctgctggcgttgggtttggcagcgtgtgggcaagaacaatcgcagaaagctgatgcggagcagtatttttttgccaataaatatcaatttgcagatgagaaacaggctttttattttgaacgcgccgcccgtttccgtgtattgcaacaaggccttggcggggattttgagaggtttttaaaaggagaaatacctaatcaagaaaatcttgcaaagtatcgtgaaaatattactcaagcagtcgcttattatgcggacacgaatggagatgatgacccataccgcgtctgcaaacaggctgcgcaagatgcagaaatcctgatgaagagtatggtaacaagcggtggaggcggtacaactgatttagataaggaaagttatcaaaattaccgaaaatcaatgcaagaatgccgtaaaacaataacggaagctgaagccaatttgccgaaaaaataa

SEQ ID NO: 5141 - DNA, 546 bp, Neisseria meningitidis
atgagcaaaattatttgtctgactgccggacacagtaacaccgacccgggcgcagtcaacggaagcgaccgtgaggcggacttggcgcaggatatgcgcaacattgtggcttcaatcctgcgtaacgattacggcctgaccgttaaaaccgacggcacgggcaaaggcaatatgccgctgcgcgatgcggtcaagctgattcgcggctcggatgtggcgattgagttccacaccaatgcggcggcgaacaaaacggcgacaggcatcgaagccttgtccacgccgaaaaataaacgctggtgtcaggtgctgggcaaagccgttgccaagaaaaccggctggaaactgcgcggcgaagacggctttaagccggataacgcagggcaacattcgcgcctggcttatgcgcaggcaggcggcattgtgtttgagccttttttcatcagcaacgacactgatttggccttgtttaagacgaccaaatggggcatctgccgcgcgattgcggacgcgattgcgatggaattgggagcggcgaaggtatga

SEQ ID NO: 5142 - DNA, 237 bp, Neisseria meningitidis
atgcgtattttggatatttttaaaaacccggcgacaggcaatgtgtcgcactcgaaactgtgggcaaacgttgcctgcgcggctgggacgtttaagtttgtgatgttgcccgatccgtcggcggaaatttgggcggtgtatttgggcattgtcggcggctatgcggtggcgcgttcatttgtcagcgtgaagcgtcaggaggtcgagaatgaatctcgtgaaactgctggcgaataa

SEQ ID NO: 5143 - DNA, 306 bp, Neisseria meningitidis
atgtccttactcaagaccgtaaaaatgcaagcggcggttgcattgacggctttggctctcacggcctgcagctctacaaccgcgccctcggctacggaaattaaggttgtcgaaaaggcagtcatgccgaccccgcctgctgcattgatggtcgcgccggtacgcccgaatccgccgaaagacggcaagacggccacgctgttggaacacgccgctgagtttggtggctatgtggcggagttggaaaatcaaaatcaggcttggcgcgactgggcgggcaatcactcccgcaaagtcggaaactga

SEQ ID NO: 5144 - DNA, 171 bp, Neisseria meningitidis
atgtattttgaaatctataaagacgcaaaaggcgaataccgttggcgtttgaaagcagccaaccatgaaatcatcgctcagggcgaaggctacaccagcaagcaaaactgtcagcacgcagtcgatttgctgaaaagcactaccgccgctacccctgtaaaagaggtataa

SEQ ID NO: 5145 - DNA, 339 bp, Neisseria meningitidis
atgacctaccgtgaattagttgaacgtcagttggctgtgcgccatgccgatttggaattgggcttaagccgcgcacgcgagcaagagccgtttgtcattcatgtttccgatctgttggataaggcaggcattgagtacgcggtacgcatggataaggattttcagacgacgtttcaccttgaatatccaattacgaactatgacacctttaaacgtgcggtttggcaaactttgggggcgtattactgtgtttgtaatgatggtgatggactggagattgccagcaatcgccctgacggttacgccgtccgtatcgtattcggcgatgtgccggtttaa

SEQ ID NO: 5146 - DNA, 267 bp, Neisseria meningitidis
atggactttgaatttggtttcagaaccctgtggccgattgcgacggcggcattttggttttgggtcaacggcatttcaggccgcctgaaagaggcggacaagcgtatcgacgaccttaaagaggagttgcacgcggtcaagctctcttatcacaccaaggcggacgccaaggcagacagcactaatattgcggcggccttggagcgaattgaaaacaagttagaaaaagtaaacgaaaaactggacaggaaagcagacaaatcatga

SEQ ID NO: 5147 - DNA, 198 bp, Neisseria meningitidis
atgagcgacccgattttggatgccttggcgcgtattgaaaacaagactgatcaaacgctgaaaaatcagaaggaaatgcaggcggaaattgcgcaaattcgccaagacacgaaacgcacggccattacattcggcgcactgggcggcggcgtgattacggtcggctgggaattgcttaaagcgaaaatgggactgtaa

SEQ ID NO: 5148 - DNA, 507 bp, Neisseria meningitidis
atggctcacccgcaagaaatccgtgaaaagttacgccggctctatgtgagcggcgagcaaactttggaaacggcggccttgatgtgcgaaatcccgcagaccactgcgcgtgcgtggaaacgtgcggataaggaaaaaggcgacgactgggataagatgcgcgccgcttacactttggccggtggcggtattgaggatttgagccgtgcgatgttggccggttttatggtgcagtacaacagcacgatgacgatgctgcaggattcgagtaccgaagatttgccaccatccgaccgcgccaagctgttggccagcctggccgatgcgtttacgaaaaccgtatcggccaatgcgcgtgtgatgccggaaacgtcaaaactggcgacggctttggaattgattgagttcttgatggcgtttgtacaagaaaaacatcccaaacatttgcctgcctttgtggaggtattggagccgtttggggtggaagtggagaagaagtttggttag

SEQ ID NO: 5149 - DNA, 591 bp, Neisseria meningitidis
atgaactggttaaatagaggtattcaggaaaaaatcttacgagttttaagtgataattacccgaactgcctaaaagcaaccaaggtgtataactctcttttccctagtagttctttacctattacttctaacatccctgttgataaacaaggattgggcttggctttgactcttggttgtgaaattcaaagtcaacacctagcaactttacaatcagatgaattccaatattttttaaaaaatatttattacttagaagaatctggtttaattgaaattacttcgatagattcacttcataaaaattttgactgcaaaattaatcataagggcatagacttccttaccgatgatggcggcctatccgccattcttggtgttgtcacagtcaaactacacagcgacactattcaggctttaattgcggcaaaaatagaccaagcagagatttctgattcagaaaaaagctggttgaaaaaagaattagggaaaatcaaggacactgcattaagtacgcttacggaaaatgcaattaatgctatccctgccgccaccctcattactcttttaaaaaaatttgttggcctctaa

SEQ ID NO: 5150 - DNA, 1551 bp, Neisseria meningitidis
gtggacggcttcgatgcgtcgcccaaggctattgctgcacgccgtgccaaggtgtttgacccggtaggcggttacgagtatttcgtgaatacctacttcccccattatatccgctcgcctgagaaatccgaactgcatgcgtttttattcagccgtctgccggagattatccgctcccccaaaggggaaaatgaggcggtgggtgcgccgcgtggagagggtaagtcgacgaaggttactcagttgtttacgctgtggtgtattgtgaccggccaaaaacattatgctgttattgtgatggacagtatcgaccaggcatatccgatgctggaagccatcaaggcggaacttgaatttaacccgcgcttgaaaaccgactttccggaagtatgcgggcagggccgtgtatggcaggccggtacgattgtgacggccaatgacgttaaagtccaagtggccggtagcggtaaaaagctgcgcggtttgcgtcacggcccttaccgtcctgacttaactgttttggacgatattgagaatgacgagcaagtccgcaaccccgaacagcgcgacaagctcaatgcgtggctgactaagaccgtattgcctctgggcggtgtcggtcagaaatacgatgtgatttatatcggcacgattttgcattacgacagcgtacttaaccgcactttgaataacccgttttggcacggtattaagtttaaggcgatgaaacgctggcctgaccgcatggatttgtgggacaggtgggaggaacttttccgaaacgacggcgagacggtggccgaggcgttttatcaggcaaacaaagacgagatggagcgcggcgcggtcacttcttgggcggcgcgtggcgtactcgcgctgatgaaaatccgtgcgcgtgacggccatgcgacgtttgattcagaatatcaaaacgatccggtcagtggcgaagatgcgccgtttgccaagtcgatgaagttttggaacgacctgccgtccgatttggtgtatttcggtgcgctcgacccgtcactcggaaaggccggggcgagccgtgacccgtccgcgattatcattggcggttatcaacgtgtaaccggcaaactgtatgtcgtggaggctcagattaaaaaacgtctccctgatttgattattgaggacgttattcgattgcaccgtcaatatcgttgcaaactgtggtttgttgagactgttcaatttcaggaatttctgaaagacgagctggtcaagcgcagcgcggcgcgtggaatacctgtcccagcgcgggcggtcaaaccggtatcggacaagctgttgcggatcgagactttacagcctcacatggcgaacggtttgattctgttgaatgagagccaacaaacgctgatacagcagttccgccattttccaaaggctgatcatgatgatggtcctgatgccgtgcatatgctctggtcgggggcggtggccaattgtgtgccgatagaatggcaaagccctaccgataacgattttgatgacgagataaaaagtaaatggagccgataa

SEQ ID NO: 5151 - DNA, 1569 bp, Neisseria meningitidis
atggcaaaaaagaacaataaaactaaaatccaaaagcccgaagctgcattgcagacggacgtggctcaaattacggcgaccggtcgggttatcgccgagcatccgtccaattttattacgccgcaaaagatgcgggccctcttcgaggacgcagaaagcggcgacatccgcgcccaacacgagcttttcgcggacattgaggagcgcgacagcgacatcgcggcaaatatggggacgcgcaaacgcgcgctgctgacgctcaactggcgcgtcgccccgccgcgaaatgcgacgcccgaagaagaaaagctgtccgaccaagcctacgaaatgatggacagcctgcctaccctcgaagacctgattatggatttgatggacgcggtagggcacggattttctgcgttggaggtcgagtgggtattttcagacggcctttacctaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatagagctccacaacgcggcaaacggtacgacggcaaccagcaatccgtttttgcagatggccgactggtgcgaaaaatcggcggcgcggctgattttggggcaaacgctgaccagcggtgcggacggaaaatccagcaccaacgcgctgggcaatatccacaacgaggtacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctga

SEQ ID NO: 5152 - DNA, 1296 bp, Neisseria meningitidis; identical to SEQ ID NO: 3371

SEQ ID NO: 5153 - DNA, 416 bp, Neisseria meningitidis
atgattgatgtcaaaatagacaatatctttgtcgtcctaaaccaaatcgagcggcttggcaacgggatcgaaaaccgctacctgctgatgcgccgactgtccgaaaccatgcacacggcggtcaagctcaatttccgctacgcaggccgtccgaaatggttgggctaaaataccgcgacggcaagccgctttcggattcgggtcgtctgaaagacagtttttccacactgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtga

SEQ ID NO: 5154 - DNA, 1062 bp, Neisseria meningitidis; identical to SEQ ID NO: 3415

SEQ ID NO: 5155 - DNA, 966 bp, Neisseria meningitidis
atgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgtccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactggtaccttag

SEQ ID NO: 5156 - DNA, 483 bp, Neisseria meningitidis
atgctaccgcatactggcctttttctgttagggaaagttgcacttcaaatgcgaatccgccgccgtctgaaacaaggagtcatcatggcaaaaaccaacaacaaaccagaaaccgccgaaaccgccgccccgtcgtttgaagacatcaaagccgaattggacgccgtgcaggcagagcttgccgccgcccgaaacgatgtcgaaatgctgaccacagccttggaaaaagccgaagacgacaaaaaggcactgtccgccgaacttgccgaactcaaagtgcagcatacgcaacgtgccgccgacgctttggcggacagccgcgatgtgatgctcgtcagtaccggcgcagacggcaaagaattttggcgcggcggcctgctgtttgacggcggctggcgcgaagtgaagcgcgccgaagtcggcgaagcggtgtggaaggcaatctgcgccgagcctatgctgcaacgcaaggcggtcgagtaa

SEQ ID NO: 5157 - DNA, 423 bp, Neisseria meningitidis
atggcatacgcgacggttgaggatatggttgcgcgtttcggtgagctggaagtcttgcagctcaccgaccgcaacaacgaggggctgattgaccgcgaggtcgcacaaaccgcgctggtggacgccactgccgaaatcgacgcgtatctggggcggttcagacgaccttttgaggatctgccgcccatcttggtgcgcctttgctgcgacattgcccgctaccgtctgacggcggctcagggcgtgttgattaccgacgaaatccgcaaccgctacaaaatcgacgtgctcgacctgctgcgtgctatggccaaaggcgaagtgcagctgggcgtggatgatagcggcgaagaagtggccgcgggcgaagacggtattgtgtttgtaaacggtaaaaataaggtgttcgggcgtgatcactga

SEQ ID NO: 5158 - DNA, 594 bp, Neisseria meningitidis; identical to SEQ ID NO: 3429

SEQ ID NO: 5159 - DNA, 198 bp, Neisseria meningitidis
atgagcaaaatcaaagtaacggcggcagatggcctgcgtgtgccgaccgaacacaacccgcacgaatatatcggccaagagccggtggaggtggacggcaacagcctgtattaccgccgcatgattgatgacggcgatttggtggtggttgaggatgccgccccaaataccaaaacccgcaatactaagggagagtaa

SEQ ID NO: 5160 - DNA, 1410 bp, Neisseria meningitidis
atgccccatattgattttgacacgattccgggcagcatccgcgtgcccgggcagtatattgaatttaacacccgcaatgccgtacaaggtttgccgcaaaatccgcaaaaggtattgatggttgcacccatgctgaccgcgggcatacagcccgccttagagccggtgcaactatttagcgatgccgaggcggccgatttgttcggacaaggctcgctggcgcatttgatggtgcgccaagcatttgccaacaacccttatttggatttgaccgttatcggtattgccgaccacagcgcaggcgtgcaggcaaccgcaaccgttaccctttccggcacggccaccgcgccgggcgtggtggaaatcacgattggcggcaagcaggtaagcacggccgttaacaccggcgagaccgccgccacagtggcagaccgtctgaaaaccgccatcactgccgccgatgtaaccgttaccgcatccggcagcggcgcagccgttacgctgacggccaaacacaaaggcgagatcggcaacgagagcggcttaaccgtgagcaccggcaataccggcctaacttatcaagccaatgcctttaccggcggtgccaaaaatgcggacattgccacggccttgtccaaagtggcgggcaagcattatcacattatttgcagcccgtttagcgatgacgccaacgccaaagccttgagcaaccatattaccaacgtatccaacgccatcgagcagcgcggctgtatcggcgtattgggtatgagtgcggccttgagcacggccaccaccgctaccggcgaaatcaacgacggccgcatgacctgtgcttggtacaaaggtgcggtagagccaaacggcatcatcgccgcaggttatgcggcggtgttggcctttgaagaagaccctgccaagccgctgaacacgctggaaatcaaagggctggccgttacacctgatgcgcaatggccgctgtttgcagaatgcaacaatgcgctgtacaacggcttgaccccgctcacagtggtcaacaaccgcgtgcagattatgcgtgccgtatccacctataccaagtcggccaacaacaccgacgacccggcactactcgacattaccaccatccgcacgctggattatgtgcgccgcagcgttaaagagcgcattgccctgcgttttccgcgcgacaaattgagcgaccgcctgctgcccaaggttaagagcgagattttggacgtgctgattaagctcgaccaagccgaaatcatcgaaaacgccgaggccaacaaaggcaagctggtggtggcgcgtgcgcaaaacgaccccaaccgtgttaatgccattatccccgccgatgtggtcaacggcctgcacgtctttgccgggcgcattgatttgattttgtaa

SEQ ID NO: 5161 - DNA, 378 bp, Neisseria meningitidis
atgagcgacgctacctatgccgacgcggtgattatggagatgaacggccgcgatatcgagattgtgagcatcaagccgcaaaccactacaggccgcaagccggtcaaaacgatgaaccgcaacggccgagtcaacggttattgtgacggcgtaaccgaacacaaattaagcgttaccgccgccattccgatcgacggtacggaaatcgactgggacaacatcaccaaggcgaaaatcacgatttaccccatcaacgacgaagatcgccgcacttcctacctcgactgctttaccgtcgataccggcgagcaatatgaagtcgataacgaggcacgcatcgacattgagatgattgctttgcacaaaatcaaggagtaa

SEQ ID NO: 5162 - DNA, 366 bp, Neisseria meningitidis
gtgattaccgtcaaactgacccacgggctgacctacaatggcaaagtcgtatctgaattacgcctcaagccactgaccgtcggcggcgaactggcggcgttcgccctgattgatgacttgcccgagctgcccgaaaacgccacaaaagccgaactgctgcaacgcgacgtcctagagacgctgacctactggtcgcagcagattgaagcccaaggtatcccatccgacatcctgacggcgcagtggctgatggaaaacctctctaccgaagactaccataccgtgatggcggctcaggaggatttgcgcctaaaaccgtccgccgctacggcgagccccgatgcgccgtcggcggcggagcagtaa

SEQ ID NO: 5163 - DNA, 603 bp, Neisseria meningitidis; identical to SEQ ID NO: 4001

SEQ ID NO: 5164 - DNA, 2157 bp, Neisseria meningitidis
atgaaactgtcgttggtgttaaccgcccgagatgacggagcgagacggctactggctgatactcaacgacaattagatcgtaccgcgaaatcgcgggcgcaacttgaacggcaaagccatacttatgcgttgaccggcatccgctcagaaaaacagattcaacgcgaaatcatgctgacacaggctgcgtttaaccgtttggcgcgcagcggcaaggcatcacaaaatgatttggcacgggcggcggtcgctacgcgtaaccgaattcgcgagctgaacgcggaactgaaacagggcacgggatttgcggacaagatgggaaaaatcggaagattcggtgcagctgcggtggctggtggcgcggcagcgtatacggtgcttaagcctgctatggacaacagaaagcagcttgatgagaacatcaaccgcgtgtccagacaggcatttattgaggataacagtaaatcggcagcgtggattgcaactgaaggtgcgcaacagatcaaggatttggcacttgaacttgtcgagaaaaatggcgggacccacgataaggctttggatttaatcagcggcatgatgaccaccggtctgaattttgcccaaaccaagaatgaagcgcaggcggcatatgcttttgcacttgcctcagaaggcagtggcgaggatacggcaaaactgattaaaaccctgaaagatggcggcatgagcggtaaagacctgcaactcgggcttgagcacgtcttgcaatcgggtttagacggcactttcgaggtgcgggatatggttcgggagctgccgagcctgctctctgccgcgcaacaggcagggatgaatggtgtcggcggtttggactacctgctctcactcttacaatctgcggcgaataaatcgggcagtcctgccgaagcggcgactaatgtgcaaaatcttttgagtaaaactctgtcgcctgacacgataggtcgtctgaagaagatggcaaatccgaatgacccgaagaaaggtgtcgattggataggctcggttgtgcaaggcaagcaaaacggcgaaaacgcagtgcaggtgttgtcccgtcttgccgatgccatgctagtaaaggataagcaataccaagattataagaaacgcgcggctgcaggcgataagacggcggcggagcaggcaaatatgcttaagggcgcgcttttggcgcaactgctgcctgatttgcaggcaaaacaaggtttgctggctgcaacggatatgacgcaaatccgtgaatatatggcttcgttggctggcgtaacgttggataacggaaaaattgctaagaacaacgaggcgcgaatgttgtcggcagcggcgcaacaagagcaacaggaatcgctggcaatgttgcgggaaagtctgacgggaacattggtggatatggaaacctcgtttaaaaagctggcagcggaataccctaatgccactctagccctgcaagcattgacgacggcggcaacagcggcgtctgccgcaatgttattaaccgccggtggcggtaaaggtgcaggctttctgaaagatgtaggtagtaaagcgttgggatggggtaaggcttccgcaggcggcgtggcagcaggtgccacagcggcaggcggtaagttgctgtcatggggaaaatctgccggtagcgggctcatgaataatccagcgttagttaaacgggcgggtttgttaggtatgttgctgtattccgagtctttgggtgacggcacattgccaaagggtttgcgtggtaccaagacaactcctgaaatgattaatcgtctgaaaaacaacggtatccgatttgaacctgcgccgaagcgggaacaggcgcggggtggtgtccctcagtatttggctgctccgtcagcgcagcctaccgataagatgttgtctccgttgttttcaactcagacggcggcgtatcaggcagccattcagcagcagacggcggcgtatcaggcagcattggcgcaggatacggctgcagttacaacaggtttggcacaagtgcaaagtgcgatggcgtcggcaagtcagaccatcaataccaatgtgagcctgaatatcgacggacgtgttatcgcgaatgaggtatcgcggtatcaagtggccatgttcggccgtggagcgggtcaataa

SEQ ID NO: 5165 - DNA, 1332 bp, Neisseria meningitidis; identical to SEQ ID NO: 3411

SEQ ID NO: 5166 - DNA, 1146 bp, Neisseria meningitidis; identical to SEQ ID NO: 3377

SEQ ID NO: 5167 - DNA, 669 bp, Neisseria meningitidis; identical to SEQ ID NO: 3425

SEQ ID NO: 5168 - DNA, 348 bp, Neisseria meningitidis
atggacaaagagctaaaccccagcatcggcgactataccggccgcaccgtcgatacgctgcaaaatgccgtgtatatccgcttgatgacaccgttgggcagctggtgggcggataaaacgctcggctcgctgctgcatttgttgcagcgcgaaaaagacctgcaacgggtcagcctgttggccgagcaatatgccgatgaggcactgcaaccgattgttaagagcgggcgtgccgacaagattaccgtgcgcgcagagcagccgcacgacggccgcctgatcctgcatatccggatggatacggcggcgggcgggtttgattaccgccacgaagtgcccgtgatttaa

SEQ ID NO: 5169 - DNA, 1055 bp, Neisseria meningitidis
gtgtttgaaacgccgacatttgagcaaatccgcgagcgtatcctgcgcgataccaaaagcctgtggccggatgccgatatcagccccgacagcgaccattatgtgcacgccagccgtttggccagctgcgccgaagggcaatatgcgcatcaaagctggattgtgcggcagattttccctgataccgccgaccgcgagtatttggagcggcatgcctccatgcgcggcttgagccgccgcaatcctaccacggccagcggcacgctgaccgtaagcggtattgcgcaatccatgctttcagacgacctgcaagtgcgtatcggccagcgtttttaccgcactaccgcccgcgccgttatcggcagcggcggcacggcggaaataccggcaatcgccgacgagccgggcgcggccgccaatgtggcgacggcgaggcgcaactgatggccgcccccgccggtgtggccaccgaatgccgccttaccgtacaaggcggcaccgaccgagaaagcgatgcctcactgctggcgcgtctgttggaaatcatccgccgaccgcccgcaggcggcaaccgttacgactataaaaactgggcgttgagtgttgacggcgtaaccagcgcatatgtttatccgctgcgccgcggcttgggtacggtggatattgccattacctccgccgacggtgtgtcgtcggaagaaactgtgcgccgcgtacaggcttatatcgacgagatgcgcccggtaacggcaaaaaatgcgctggtactcaagccaaccgtaacggcggtgcctgttaccgtgcaagtcaagctcgacggtatcgacttggacgaggccaagcgccgcatacggacggccctaaaagaatatttcgacaccctgatccccggcgacggcctgactgtgtcgcaaatcgaggctgctatcagcaatgtggatggtgtgatcgaccgccgtctgactgcgccgacggccaaccgtgccgccgatacggttaaccgcatcgagtggtttaaagcgggcgcgattaatgtaacggagatgccgtcatga

SEQ ID NO: 5170 - DNA, 561 bp, Neisseria meningitidis; identical to SEQ ID NO: 3381

SEQ ID NO: 5171 - DNA, 1974 bp, Neisseria meningitidis
atgcaccccatcgaaacccccgataagaccttccacgacggcgacggcgtgtccgaattgggcaccatcctgcccgcgtggtggctcaaccaagtgcaatccgagctgctggccgtgctgactgcggccggtatccagccggataagtcgcagcctaatcaattactggcagcactaaataggctggctgtagttatcaccggcgaccaaaccgtcaacggccaaaaaacctttaccgcccaaacccaattccaaagcggcatccatttatccgccaaccagacgaactggaacggcggccacaaagcctacatcggcgcggatgccgacaacgcccacatcgtcttcggcgacgacaccctccgcctgcacggcgcaaacaaccgcatttcctacaacaaccacgacatcttccacaaagccaacaaaccgcgttttgccgaagacatccaaggcaaaccgaacacactgtccggatacggcatcggcaatttcaaagtcgaaacattccggggcgatttgaacaccctcaaaacagacggcatctattccctgccgacggcggtcggcagctccaacctgcccgttgaaaacaccgcctgccatatccaagtcatcgccggcacgaaacacggctggtgcaggcagttgggttatcccgcctacacgtccgacgtgtacgaacgccaccaaacgagcagcgcaaacgacaactggtccgcatggaaaaaactcaattcggacggcatccccgtcggcgcgatcgtatcctttcccaaagccgtacaaaaccccgcaggctatctcaaagccaacggcacgacctttgcacaaaacaccttccccgacctttaccgcgccttgggcaacagcaaccgcctgcccgatttaagccgtaccgacatcggcatcaccgcgtggtttccgtccgaccaaatcccgaccggctggctggcgtttgacgacatccgcacgcgcgtaaccgaaaccgcttatcccgagctgtaccgtctgctgaccggaaaatacggcagcatccaaaacgtcccgcaggcggaagaccgctttatccgcaacgcgggcaacagcttggcagtcggaacgaagcaggaagacgaaatcaaacggcacgtccacaaagtattttcacactggacaaaccacacagacgcggcagccctcggttacgaagaccgcaacgaaaggcagagaagcgcgctcgtatcgacttggacggacgaaaatttaaacgacaacggctttttaaccccgcgctcggacagcaaaatggcgacaggcggcgacgaaaaccgccccaaagccctggttttaaaactgtgcatcaaagccgccgacaccttgggcgaagccgtgttttggataaagtcccacggcgaaaccatcaacgcaggcgcgctggacgcgggcacgctggcgcaaggtttgcaagacaaagccgaccgagaccacacccacaccgccgcccaaatccaagggctggacgaaaaaatcagcaccgccgttgccgcgcaattcacacgccaaaccatcggcggcgtggatattgtcagattccccgacggcacaatgatacagaccggcagctacaggttcacacgaagcggcggccccatcgaaaacgaagtcgtcttccccgtcgcctttgccgacggcaacgtcaaatgcttcgtatccgaacgccattcggaacgcgttaccggcgatcgaaggcaacacaactggctgtttatccgcgcaaaaaaccacgccgccgccattatcaccaactggtacgaaggcagttgcgactggatggccatcggcaaagccgcctcgggaaacgccgccagctccccgataggccccgaaatacctgaaaccaacgaagaaccgcaaagagagagtggaagaacatcaaccggaccccgaaaccgccgccgccgagacggcttgctcgaggcactgcaagactag

SEQ ID NO: 5172 - DNA, 528 bp, Neisseria meningitidis
atgccccgccaatcctgccactcttcgtcattcccgccgctttcgtcattcccgcgaaagcgggaatccagaccccccgacgcaacaggaatctatcggaaaaaccgaaacccccgccaccgtcactcccgcgaaagcgggaatccagcccccaaacgcggcaggaatctatcagaaaaaacagaaacccccgccgccgtcattcccgcgcaggcgggaatccagaccccaaacgcggcaggaatctatcggaaaaaacagaaatccccgccgccgtcattcccgcgcaggcgggaatccagaccccaaacgcggcaggaatctatcggaaaaaaccgaccccccgccaccgtcattcccgcgcaggcgggaatccagaccccaaacgcggcaggaatctatcggaaacggctgaaaccgaacggactggattcccgcctgcgcgggaatgacggcggcaggggtttcgggattcccgccttcgcgggaatgacggaaagtggcgggaataacgaaaggcgggaatga

SEQ ID NO: 5173 - DNA, 150 bp, Neisseria meningitidis
atgcaaaaacgaaacacaggcaaaaccccgaaacaactcgttaccatacgcctgtccgccgatgtggtcgaaaaattccgcgccggcggcaagggctggcagacgcgcatcaacgaggttttgcgccaatatatcgcccaattgaaataa

SEQ ID NO: 5174 - DNA, 288 bp, Neisseria meningitidis
atgaagattgaatttgactccgaaaaaaatcaacgcaatatcgaagagcggaatttgccctttgaatcagtcgggcaaatacgctggacaacggccgttattgtgcccgatgtccgctttgattaccccgaaccgcgttatgttgccgctgcttatctaggcgatacgcaacgcctgcacattgtctgttttacgccgataaaagacggcatccgtgtcatcagttttcgcaaagcgaataaaagagaggttaaaaaatatgcaacgtcaatccttaacaaacgctga

SEQ ID NO: 5175 - DNA, 606 bp, Neisseria meningitidis; identical to SEQ ID NO: 3431

SEQ ID NO: 5176 - DNA, 297 bp, Neisseria meningitidis
atggacgctaaacatcggctgaaaaaatacgtttaccacctgttggtagccatcgaccaactgttcaacgccctaaccggcggcgcggcggacgaaaccctctcaagccgcacctatcgccgcgcgcggctcgcccaaaagcccaaaacccgctggaagattttatataccctgatcaacggcgtgtttttcgaccgccaccactgccggcaggcgtatatcagcgaactgaaaggcaggcagcacgacgcgcggttcaaccaaagccgcgccgccggggaaaaggggacgcgatga

SEQ ID NO: 5177 - DNA, 224 bp, Neisseria meningitidis
atgaactacttcggcatggtagagtttctgcgcctgatggcaatggtgcggccgccatttgtcttcttctccggcacccgcagcgaactgcctgcttatcttgacctcgtggcagaactgcgcctgaccggatgggagcgttttgcaggcagccaaaccttgactgtgagcagcacatcaacagcaattcaagctacgacgaccacctgatttataagttctga

SEQ ID NO: 5178 - DNA, 1144 bp, Neisseria meningitidis
atgcagaaatggcaaaccgagctttattccacaccgctttggctttgtctgacaccgaaaagcgcggtcaaagtcttgctgctgattacggcgatgattacgctggtgttaaccgaaatgcggctgaatgtgttgagtacctttatgtccaaagggctttacgactcgatgcaggatttgaaatgcttcggcattttggatgtttgctgcaatgaacgcgggcgtggtgctgatacgggcgtttaacaacgtcgtcaacgacttcctcgatcaaggcttggcgattaaatggtcggagcggctcaacgaagtgctgacagcacgctggcttgccgacaaaaactactaccgcctgcaaatgcgccgccacgcgccggacaacatcgaccagcgtatccaacaggacgcgcaggaatttatcgcttcgaccatcgaatttgtgcgcggcatggtcaattcggtcgttacttctctggaatttgccgttgttttgcggggcttggctggcatcctgaccgtgttcggcttcgacattccgcacggcatcgtttggtttgtctatatatttgtgattttggcgacctttatcgccatgtggataggcaaccctttgattcgttacaattatgaaaacgaaaaactcaacggcgactaccgttattccctcatccgcgtgcgcgaccacgccgaaagcgtggcgttttacagcggcgaaaaacacgaacacgaccagctttctgaccgttttaaagccattatccgcaaccgctggcgtattgcgcgacaaagcgtctgcctgagcggctttaatgatatgttcaccaacggcatcaagctcttccccattattttgcaagcgccgcgcctgtttgccggacaaatcaaaatcggcgacatccagcagaccgtccaagccttcgcgcgactgcaaaacgcgctttctttcttccggatgttctacaacaaattcaccgcctaccgcgcccgattggagcgtctgtacggctttttgctgagtaccgaagaacaacacagcgcgcggcaacccgagattagcgaagtttcagacggcattgcactggaatgtaaggcggcggcagcttttgcacgaattggcggcagcttttgcaccgccgaagcgtag

SEQ ID NO: 5179 - DNA, 198 bp, Neisseria meningitidis
atgcgaatcttgatacttgcaagccgcaccgcccaaaatcgggcagccggtttcaatatccgaacaaggttcgggttctgtattttgcagaacccgaaccttttattcaaatttaaacttaattccggcgtggttgtatggtatagtggattaacaaaaatcaggacaaggcgacgaagccgcagacagtacaaatag

SEQ ID NO: 5180 - DNA, 648 bp, Neisseria meningitidis; identical to SEQ ID NO: 1853

SEQ ID NO: 5181 - DNA, 372 bp, Neisseria meningitidis; identical to SEQ ID NO: 3471

SEQ ID NO: 5182 - DNA, 672 bp, Neisseria meningitidis
atgaaaaccgtttccaccgccgttgtccttgccgccgctgccgtttcactgaccggctgtgcgaccgaatcctcacgcagtctcgaggtagagaaagtcgcctcctacaatacgcaatatcacggtgttcgtaccccgatttccgtcggaacattcgacaaccgctccagcttccaaaaaggcattttctccgacggggaagaccgtttgggcagccaggcaaaaaccattctagtaacgcacctgcaacagaccaaccgcttcaacgtactgaaccgcaccaatttgaacgcattaaaacaggaatccggcatttccggcaaagcgcataacctgaaaggcgcagattatgtcgttaccggcgatgtaaccgaattcggacgcagagatgtcggcgatcatcagctcttcggcattttgggtcgcggcaaatcgcaaatcgcctatgcaaaagtggctctgaatatcgtcaacgtcaatacttccgaaatcgtctattccgcacagggcgcgggcgaatacgcactttccaaccgtgaaatcatcggtttcggcggcacttccggctacgatgcgactttgaacggcaaagttttagacttggcaatccgcgaagccgtcaacagcctggttcaggctgttgacaacggcgcatggcaacccaaccgttaa

SEQ ID NO: 5183 - DNA, 720 bp, Neisseria meningitidis
atggcgacactgtccgacaaaaccatcttagtaaccggcgcatcgcaaggtctgggcgaacaggtcgccaaagcctatgcggcggcaggcgcaaccgtgattttggttgcccgtcatcagaaaaaactggaaaaagtgtatgacgcgattgtcgaagccggataccccgaaccattcgccatctgctttgaccttattagcgcggaagaaaaagaatttgaacatttcgccgccaccattgccgaagccacgcaaggcaaactggacggcatcgtccactgcgccggctatttttacgccctctcgccgctggatttccaaaccgtcgccgaatgggtcaaccaataccgcatcaacaccgtcgcacctatggggctgacccgcgccctgttcccgctgctgaagcagtcgcccgacgcgtccgtcatcttcgtcggcgaaagccacggcgaaacacccaaagcctactggggcggcttcggcgcgtccaaagccgcgttgaactacctgtgcaaagtcgccgccgacgaatgggaacgcttcggcaacctgcgcgccaacgtcctcgtccccggccccatcaattccccgcaacgcatcaaatcccatccgggcgaagccaaaagcgaacgcaaaagctacggggacgtgctgcccgcatttgtctggtgggcaagtgccgaaagcaaagggcggagtggcgaaatcgtttacctctaa

SEQ ID NO: 5184 - DNA, 1314 bp, Neisseria meningitidis; identical to SEQ ID NO: 3997

SEQ ID NO: 5185 - DNA, 207 bp, Neisseria meningitidis
atgaaagcagtcagggatatagccttatggctggcagtaacggtttggatcaactttttccccgacagttaccgctatgataccgttccacagggacggtacggatactggcatgcagaccatccgtggtatccctatgcgcgctttctgctgcctttatttttagcctgtatccttttctaccgtcattttcggaaacggaaatag

SEQ ID NO: 5186 - DNA, 873 bp, Neisseria meningitidis
gtgaaaggactcgactattgccgccaaaaagcagaagaaagccgctccagttttttgtcgggcttccgtttcctgactcaggaaaaacgggatgcggtaacggttttatatgctttttgccgcgaattggacgatgtggttgacgaatgttccaaccccgatgttgcacaggcgacattgaactggtggcgcggcgatttggacaaggtattcggcggcgcgatgccggaacaccccgtcaatcaggccttgcggcaagttaaggaaaccttcaagctgccgaaatatgaactggaagccttaatcgacgggatgcagatggatttggttcaagcccgttacggcagttttgaagaattgaaactgtattgccaccgcgtcgcaggcgtggtcggctgcctgattgcgcggattttggggttttcagacgaccaaacgctggaatacgccgacaagatgggacttgcgctgcaactgaccaacatcatccgcgatgtcggcgaagacgcgcgcagggggcggatttacctgccgatggaggaaatgcggcggtttgacgtacccgcaagcgtgattttgcaatgcagcccgacgggcaattttgccgaattgatggcgttccaaatcaaacgcgcccgcgaaacctaccgcgaagccgtatcgctgctgcctgatgccgataaaaaagcccaaaaagtcggactggtcatggcggcggtttattacgagctattgaacgaaatcgaccgagacggcgcacaaaacgtcctcaaatacaaaatcgccctcccttcgccgcgcaaaaaacgcattgccctgaaaacctggttattcggattcaaaccgcgccccggcacgccggaacgggcataa

SEQ ID NO: 5187 - DNA, 1863 bp, Neisseria meningitidis
atggctcttttgcagatttcagaaccgggtatgtccgccgccccgcaccggcaccgtttggcggcaggcatcgatttgggtacgaccaacagcttggtcgccaccgtccgcagcggcagtgccgcctgcctgcccgatgccgaagggcgcgttaccctgccttccgtcgtccgctatctggaaaacggcggcattgaagtcggcaaaaccgccctgtccgcccaaaaaaccgacccgctgaacaccgtcagctccgccaaacgccttatcgggcggacgcttgccgatctgcatcaaaatacgcactacctgccttaccgtttcggcgacaatcaacgcgttatcgaactgcatacgcggcagggggtgaaaacgcctgtcgaagtgtcggcggaaatcctcaaaacccttaaatcgcgcgccgaagaaaccttgggcggcgatttggtcggcgtggtgattaccgtccccgcctatttcgacgatgcccaacgccaggccaccaaagatgccgcgcgtctggcgggtttgaacgtattgcgcctgctcaacgaacccaccgccgccgcaatcgcctacgggctggacaacgcctcggaaggcacgtttgtcgtgtacgacttagggggcggcacattcgacgtatccgtattgcaactgaccaaaggactgtttgaagtcaaagccaccggcggcaacagcgcgttgggcggcgacgatttcgaccaccgcctgttctgccgcctgctcgaacaaaacggactctcccaactcaacgaacaagacagccaactcctgctctcgctcgtccgcgccgccaaagaacaattaaccacgcaaaccgaagcgcgcattcaggcgacgctttcagacggcatggcaatcgacacaagcatcagtcgcgccgagttccacaacctgacgcagcatttggtgatgaaaacgctcgaaccggtcacacaggcgttgaaagatgccggtgtcggtaaaaacgaagtcaaaggcgtgattatggtcggcggttcgacccgtatgctgcacgtccaacaggcagtcgccaccttcttcggacaaaccccgctgaacaacctcaaccccgacgaagtcgtcgcgctcggcgccgccatacaggcaaacgtcctcgcaggcaacaaaaccgacggcgaatggctgctgctggacgttacgcccttgtcgctcggtttggaaacctacggcggcttggcggaaaaaatcatcccgcgcaattccaccatccccaccgcgcgcgcgcaggactttaccaccttcaaagacggtcagaccgcgatgacgatacacgtcgtacaaggcgaacgcgaactggttgccgactgccgcagccttgccaaattcaccctgcgcggcattccgcctatggcggcgggtgcggcgcgtatccgcgtaaccttccaaatcgatgcggatgggctgctgtccgtttccgcccaagaacaaagcaccggcgtacaggcgcaaatcgaagtcaaaccctcctacggcttggacgacgacaccatcacccaaatgctcaaagacagcatgagcaatgccgccgaagatatggcggcacgcgcccgtgccgaagccgtagtcgaagccgaaagcctgaccgatgccgtcaacgccgccctcgagttggacagcgatttgctggatgccgaagaattgcaacagattcggcaaggcatcgccgatttgcaaggccgtctgaaagacggaaaagccgaagacatccgtgccgccgccgccaaactcggcagcatcaccgacaatttcgccgccaaacgcatgaaccgcaacatccaacgcgcgctgacaggccagagtgtcgataatatttga

SEQ ID NO: 5188 - DNA, 657 bp, Neisseria meningitidis
atggaaaagtcaggcattgtctatctgatgaaaaccgtcatcaagggcgtgtataaaatcggcatttcggatgtaagcaattttgaaggcagaatgcgccatttggaaaacaacggttatgcgaacgttgccggattggaacgcatcctcgccgtcaaaaccgacaattacaaagaaaaagaaaacctgctccatgaaattttcagcaaaagcaggataggcgataccgaattgttcgccgtggacgaaaaccttgtgaaacgtttgtttttatcgcttcgcggcgaaatcgtgttcccgaaaaacgaaacggcggaatcggaatttgaaaaaagcgtccacgaacgcaggcaggaagggaatgccgggtcaggccgcaaacaactgcttgatttggtacggcgcggacaccgggaatacccttacgcgctgccccggcttttggcgggcgcggcattctacaagccgaaaaaatcgaaaatccgcctttttaaagaagcatatttcggcaaaagcggcacgaggctgaccgacgaaattgcagacggcatccatatttacacctgtttttcgcgggcggatttggaaaaagcctattccgaatatttggaacttttcaaatccgaatcggatgccgaaggcagaaagccgcagtaa

SEQ ID NO: 5189 - DNA, 762 bp, Neisseria meningitidis
atgatgggcgattccgtcatttattatgtagaacaggcagacgaaccggtaaaccgtgccgacgaacgcgcccgtaaaacattcaaatatttttggcgcgagcttttttgggaacgccgccgcattatttccgccttggattttgccatggtcaaagtcccttttttccaagacggcgaagacggcgaaatttgcgaacatatgtggatcgacgatatttattttgacggtctttatatttacggtgtgctgaacaatgaacccggcgaactgaccaatgtcgaacaaggcgaaagcgtttgcgttccggttgacgacatcagcgactggatgttcgtgtgcaacggcatcccctacggcggctttaccatacaggcaatgcgcgggcagatgacggaagaggagcgcaccgaacacgatgccgcatggggaatcgatttcggcgatcccgggcagatattgctggtgtatgaagaaaaagaacatcccgaaaatctggaagagcatccgatgtgccggaactgtattgacgattttcggcaacagttgtcccaaaactcggattatctgcgggaacaggacgaagacggctatacgccgcttcatcatgaagccatcgcaggaaatgcacttatggttcaagccatgcttgaatacggcgcaaatcctgcctcaacgacatcggaaggctataccgccctcgattttgcctgcctgacgggctggcaaaatgttgccgacctgctcgaaccgcgacattag

SEQ ID NO: 5190 - DNA, 342 bp, Neisseria meningitidis
atgcccaaaatcaccgtacttccacacacgacattatgccccgagggtgcagtcatcgataacgcacccgaaggtaaaaccgtccttgacgtgctgctcgaccatgatatcgaagtcgatcacgcctgcgaaaaatcctgcgcctgcacaacctgccacgtgattatccgcaaaggtttcgacagcctagaagagccgaccgaattggaagaagacctgctcgatcaggcttggggtttggaagccgattcgcgcctgagttgtcaggcggttgtcgccggcgaggatttgattgtggaaatccccaaatacaccatcaaccacgcgcgcgaagaacactga

SEQ ID NO: 5191 - DNA, 144 bp, Neisseria meningitidis
atgcaccggtatttatcggttttgcagccggaaaaaccgccggcgggttatagtggattaaatttaaaccagtacagcgttgcctcgccttgccgtactatctgtactgtctgcggctcgccgccttgtcctgatttttgttaa

SEQ ID NO: 5192 - DNA, 684 bp, Neisseria meningitidis
atgacccgatgcggcatccgggacggcttgtgttttttcctgcccgcctgccggattttcccatccttgcgtgaaaccgaaagagacggcggcgcggcggacaagctcgagatagcgtccttcaagctccggacaggcggcggacacgctttctaccgtaaccgtgaaaccgccgcccgacccggcaaggcgttccgcaatttgcgtgtagatgagccaacgttgggcgcgcaacattgccgaatcgcaaccggcagccgctttatccaaggcaatcaggtcgcgccggttttggtggtgaaggcaaaccgttactctggagaggatatgttgcccgtccaatatttgatacagtttgcgtatcagcagaatcaggcggtcaaactcctccatctccgacagggaatcaggatggtcggaagcggtataaaccagtttggacaattttgcggcaaacatattgttcatcaatcttccttgtcggttgaaaccccgctcttcggggcggtagaatcagatttgtttgggagggacaactcctcccagatcaggacgacacataggctggtgcttgatgtgttgtccggcgagttgaaacattcagcaatcctcaaggggcggcagttttgccgaaacatattctacacggcttcaatgccggacgataaaaggaaattcatatga

SEQ ID NO: 5193 - DNA, 198 bp, Neisseria meningitidis
atgaaatggaccgacacccagcgcatcgccgaagaactctatgacctgcacggcgaaaccatcgatcccagaaccgtgcgctttacccaactgcgcgacctgattatggcattgcccgaatttgacgacgaccccgcccgttgcggcgaacgcatcctcgaagccgtgcagcaggcatggatagacgaggcggaataa

SEQ ID NO: 5194 - DNA, 402 bp, Neisseria meningitidis
atgaaagacaagcacgattcttccgccatgcggctggacaaatggctttgggcggcacgttttttcaagacccgttcccttgcgcaaaagcacatcgaactgggtagggttcaagtaaacggctcgaaggtcaaaaacagtaaaaccatagacatcggcgatattatcgacctgacgctcaattcccttccctataaaatcaaggttaaaggtttgaaccaccaacgccgcccggcatccgaggcgcggcttctgtatgaagaggacgcgaaaacggcaacattgagggaagagcgcaaacagctcgaccaattcagccgcatcacttccgcctatcccgacggcagaccgaccaagcgcgaccgccgccaactggacaggctgaaaaaaggagactggtaa

SEQ ID NO: 5195 - DNA, 960 bp, Neisseria meningitidis
atgaaacctgtttttttggattttgaacaacccatagccgaactgaccaacaaaatcgatgagctgcgtttcgtccaagacgagtctgccgtcgatatttcggacgaaatacaccgtttgcagaaaaaaagcaacgacctgaccaaatcgattttcagcaaactcacacccgcccaaatttcacaggtttcccggcatccgcagcgtccctatactttggattacattgaggcactgtttaccgattttgaagaactgcacggcgaccgccactttgccgacgattatgcgattgtcggcggattggcgcgtttcaacggacaaagcgtgatggtcgtcgggcatcagaaagggcgcgacaccaaagaaaaaatccgccgcaacttcggtatgccccgtcctgaaggctaccgcaaagccctgcgcctgatgaagacggcagaaaaattcggcttgcccgtaatgacctttatcgatacgccgggcgcgtatcccggcatcggcgcggaagaacgcgggcagtcggaagccatcggcaaaaacctgtacgaactgacgcgcctgcgcgttcctgttttgtgtaccgtcatcggcgaaggcggttcaggcggtgcgttggcggtcgccctaggcgattacgtcaatatgctgcaatactcgacctattctgttatctcccccgaaggctgcgcgtctattttgtggaaaaccgccgaaaaggcggcggatgcggctcaggctttgggcattactgctgaccgcctgcaaaagctggacttggtcgataccgtcatcaaagaaccattgggcggcgcgcatcgggatttcgggcaaaccatgaaaaacgtaaaagccgttttggaaaaacaactgcacgaagcgcaaagcatcccgcttgccgatttgctttcgcgccgtttcgaccgcattatggcttacggcaaattttcggaacaataa

SEQ ID NO: 5196 - DNA, 1281 bp, Neisseria meningitidis
ttgaaggattgttttcctcaaggtctgaatggaaaaaaaacagcggtggcattaagcggcggcttggattccgtcgttttgctgcatctgcttgtccgcgccggaaaaaagggcggttttattccggatgcattgcatatccatcacggcttgagtccccgtgccgacgattgggcagatttctgccaaaactattgcgatatgctcggggtggggctggaaacggttaaggtctgcgtggaaaaaaacggtttgggcatcgaggcggcggcaaggcaaaagcgttatgccgcgtttgccgaaaaaggctttgacgttttggcgttggcgcaccacagggacgatcaaatcgaaacctttatgctggcggtcgcgcgcggcggcggtttgcgcgctttggcggctatgcccgccgtccgcccttttggggaaaaaggcatcatctggcggcccttgctgcctttttcacgccaagatatatgggattatgcccaaaaacacggtttgccgaatatcgaggatgaaagcaataccgatacggcttatttgcgaaaccgcttccggcaccgtattttgcccgaactttcggcgcagattccccatttcgggcggcatgtgctgaacaatgtccgcgctttgcaggaagatttggctttgttggacgaggtcgtcgttcaggactgccgttgggtttgcggggccggttatttcgatacggcgcggtggctgacgttttccccgcgccggaaaacccatattttgcggcattttctgaaggaaaacggcattcccgtgccgaatcagaatgcccttgccgacattgcccgggttttgacggaggcaaaaaccggacgttggaacttgcaaggctttgaattgcatcattatgcaggcaggctgtttgtgttccgactggaaaaaacggataaactgcggtttttgaaagacaggcagataagcggaaatttaagggaaatattgacggggcagggatttgtgttgaagcggcatccgtttgggcttcctgagcatcttttggagcaggacggaattttgaggacggtagcggcatcggatacgttggccatgggcggcatccataaggatgtgaaaaaaatccttcaggggaaacgggttttgcctgtcctgcgcccaatttggccgcttgttgccgacagcggaaaccgtccattggcgttggcaaactgttgtgcggatttccaatactcggtttcagacggcattttgcccgtccatcctgactttcccattttattttga

SEQ ID NO: 5197 - DNA, 612 bp, Neisseria meningitidis
atgccgtctgaagaagtccgtaaattgacggcggttttgccggaagacgggtttttttccgtttcagacggcatattgaagaaaatcagcagcctgacttgtgcggatgatgtgcttgcgctgattgatattccagatgcgggtgctttgccggccggcggcgattgcgtggttttggacggcgtgcaagacccgggcaatgtcggcacggtgttgcgaagcgcggcggcggcgggaatcggcgcggtcattttgggcaaaggttgtgcggacgcgtggtcgcccaaagtgctgcgagccggaatgggcgcgcatttcttgtcggagatttatccgcaggcggatttggaaatatggttggtgcgctataaaggccgtgtgtttgccaccgccttgcgcgaggaaaagcaggcggttttgtacggcgaagatttgtgcgaaccgacagcctgggtgtttggcaacgaaggcgcgggggtcggtaaagcagttttagatagggcggacaagtgtgtcaggataccgatgcacgatgcaaccgagtctttaaatgtcgcgatggcggcgacaatctgcctgtttgaacaaatgcgccaacgggcggcgtattga

SEQ ID NO: 5198 - DNA, 237 bp, Neisseria meningitidis
atgtatcgcttctatgctgctgtcgccgtttttttatgcgggtgctttgaagcccaagaaggcggcattgcggaaggacgggcagtggaaactcatctgattgtccaatgccgtggcggcggcggttttggcttgggtgtggtggaaatggttttgacagatattgctcaaaatcgtgctaatggaatccgaacaaataaagaatttggtaaaaaatttgttaaatcaacgaattaa

SEQ ID NO: 5199 - DNA, 366 bp, Neisseria meningitidis
gtgtggggacgctatgaaaaattgcgaattttttatgacccgacaagggcaatctatgatagcggtgcagattacttaactagggaaaaacatagattagtcgtaattgcaaatagtgcttgggggctattgcttaatttatcttgttattatgacgaggttttggaaaagcggaaaataccgttcggcaaacaggaaattgatgacgatatggacaaagtgtccgcccttaagcggaagtttaaagatatttctgaaatcaaagtaggggatggttgggaatacccgttcaattatgagcagggaatgaaagaattagatgaagtgctattgaaatacattcccttttttgaagaagaacgataa

SEQ ID NO: 5200 - DNA, 306 bp, Neisseria meningitidis
atgcgcgtatctaaaataattggaagtatgttgcttgttacagcggttcagaccgtattttcggcaaatgtttacgcgtgccgccataatggtaaaaccagttacagccaaactccgggaaaacattgtaccaacgcgggtttggggcgggaccgggtgtacagttcggttagaccggcagtaaaagacagggcggaagacgcaggggtcggcgattattcggacacggtgagggacgaacacgtccaaaatccgaaaggaaatgcacagaaagacggttcggctgccggcatcaagccgcactga

SEQ ID NO: 5201 - DNA, 1377 bp, Neisseria meningitidis; identical to SEQ ID NO: 867

SEQ ID NO: 5202 - DNA, 1053 bp, Neisseria meningitidis
atgaccgtatcccccgtcgccttgcgccgtaagaccgagtgcaagcctcatcccaccgcgcgctattggaaaaaatgcgatgtcgaagccctgttcggacttcccttcctcgacctcatttaccaagccgccgaaatccaccgccaaaatttcaacccgcgcgaaatccagctttccacgctgttgtccatcaaaaccggcggttgtcccgaagactgcgcctattgtccgcaatcggcgcaccacaataccaatctgggcaaagagcagatgatggatgtggatgaaatcgtcgaaaaagccaaaatcgccaaatcgcgcggcgcaagccggttttgtatgggcgcggcgtggcgcggccctaaacccaaagacgtggagacggtttccgcaatcatcaaagccgtcaagggcttgggtatggaaacctgcggcacgttcggtatgctcgaagaaggtatggcggaagacttgaaagaggcgggcttggattattacaaccacaacctcgacaccgaccccgaccgctacaacgacatcatccacacccgccaacacgaagaccgaatggacaccttgggcaaagtccgcaacgccggtttgaaagtctgctgcggcggcatcgtcgggatgaacgaaacccgcgccgaacgtgccgggctgattgccagtctcgccaatctcgacccgcagcccgaaagcgtgccgattaaccggttggtcaaagtggaaggcacgccgcttgccgatgccgaagatttggactggacggaatttgtccgcaccatcgccgtggcgcggattacgatgccgcaaagttatgtccggctgtcggcagggcgcagcaatatgcctgaagcaatgcaggcgatgtgctttatggcgggcgcgaactcgattttttacggcgacaagctgctgaccacgggcaatcctgatgaggacggcgacagaatcctgatggaaaagctcaacctgtatcccttgcagtttgaaccggaaggcgaggtcgccgaagtggaaaaagcctctgggattaaagtggattattga

SEQ ID NO: 5203 - DNA, 636 bp, Neisseria meningitidis
ttgaacatcaaatattcgggcatcgaaaacaggtttgaaaccgccatcctgaagaaaaacggcgtaagatccggcttcgtctccttcgcccccaaccttgccgccgtcaaactgaacgattatgccaaagttagaaaacggattaccaaaaccaaacagaaagccgacatcgtcattgtgatgttccacggcggcgcggaagggaaacaggcggaacacctgccgttcgataccgaaatcttctatggggaaaacaggggcaacgtcgttgagtttgcgcggcttgccgtcgattccggcgcggatgtcgtattcgggcaggggccgcacgttactcgcgccgtcgaactttaccgcgaccgcttcatctcctacagcggcggcaactttgccacctacggcgcaatcaacacctccggcatcagcggcatcgcccccatttttaaaattatcaccgacaaacaggggcggttcgtttccggcaacattatccccatcactcaagtcggcgataaaatccccaaaatcgaccccgagaaaaccgttatcgggcggattatttatctgaaccgcagcgatttccccaaggggaacgggctggatgtctcgcccgacggcagcatcacgcgccggtaa

SEQ ID NO: 5204 - DNA, 156 bp, Neisseria meningitidis
atgtcgcccacgccgataatggaaacggtatcggctgtcttttcgtcaggcgcatcctgtccgtccacatcgccggtatttgaaacgggcgcggggtttgaaccgtcaatcggcagcacggggattccgttccggcaggatgcgccgagggcttga

SEQ ID NO: 5205 - DNA, 144 bp, Neisseria meningitidis
atgcatagcatattttgggggtttgcacattttttcggcgtaccgccttcgtcaaacagcgtgccttcgaggttgccgacggtaatgtccgcgtcttgcaaggcagattcgacgtttttcagaatattggtatcgggcaggtaa

SEQ ID NO: 5206 - DNA, 1860 bp, Neisseria meningitidis
atgcctgaataccgctccaaaacctccacccacggccgcaatatggcgggcgcacgtgcattgtggcgcgccaccggcgtgatggaaaccgacttcggcaagcccatcatcgccgttgccaactccttcacccaattcgtgcccggccatgtccacctgcacaatatgggccagctggttgcccgcgaaatcgaaaaagccggcgcaatcgccaaagaattcaacaccatcgccatcgacgacggcatcgctatgggacacagcggcatgctgtactccctgcccagccgcgatttgattgccgactctatcgaatatatggtcaacgcccactgcgccgacgcgctggtgtgcatttccaactgcgacaaaatcaccccgggcatgctgattgccgcgatgcgcctgaacatccccaccatcttcgtctccggcggcccgatggaagcgggcaaggttatcggcgtggcaaacatccagcccgaacgccgtttggacttgattgacgcgatgattgaatcggcggacgacaatgtcagcaaccggcaagtcgaggaagtcgaacaaaacgcctgcccgacctgcggctcgtgttcgggtatgtttacggcaaactcgatgaactgcctgaccgaagcactcggcctttccctgcccggcaacggttcgtatttggcgacccacgccggccgcaaagaattgttcctcgaagccggccgtatgattgtcgaaatcaccaaacgctattacgagcaaaacgatgaaaccgtgttaccgcgcagcattgccaccaaaaaagcgtttgaaaacgctatgacgatggatattgcgatgggcggcagcaccaataccattttgcacctgttggccgttgccaacgaagccggtgtcgatttcaaaatggcagacatcgaccgcttaagccgcgtcgtgccctgcatctgcaaaaccgcacccaacaaccacgactactatatggaagacgtgcatcgcgccggcggtatcttcgccatcctgaaagaactggacaaagcgggcaaactgcacaccgacgtgcacaccatccacgcgccgacgctgaaagacgcgattgaacaatgggacgtgaccaatcccgaaaacacccgtgccatcgaacgcttcaaagccgcgccgggcggcgtacgcaccacccaagcgttctcgcaaaaccgtatgtggaaaaccctcgacctcgaccgcgaaaaaggctgtatccgcgacgtggcacacgcctactcgcaagacggcggtttggcggtcttgttcggcaacatcgccgagcgcggctgcgtggtaaaaaccgcaggcgtggacgagagcatcctcaaattcaccggccgcgcccgcgtgtttgaaagccaagaagacgcagtagaaggcattttgggcaaccaaatcgtcgctggcgacatcgtcatcatccgctacgaaggcccgaaaggcggcccgggcatgcaggaaatgctgtatccgacttcctacctgaaatctaaaggcctcggcaaagcctgcgctctcttaaccgacggacgcttctccggcggcacatcaggtttgtccatcggacacgcctcgcccgaagcggcggaaggtggcgcgatcggtttggtacacgaaggcgataccgtcgaaatcgacatccccaaccgcagcatccaccttgccatttccgatgaagagcttgccgcacgccgtgccgaaatggaagcgcgcggcagcaaagcatggaagcctaaaaaccgcgaccgctacgtctccgccgcattaagagcttacggcgcgatggcgacttccgccgacaaaggcgcggtgcgcgacgtagcgcaaatcgaaagataa

SEQ ID NO: 5207 - DNA, 1770 bp, Neisseria meningitidis
atgaccgtacagaccaagacaaaaggtttggcgtggcaagaaaaaccgctatccgacaacgaacgtctgaaaaccgaaagcaattttttacgcggcacgattttggacgatttgaaagacccgctcacgggcggcttcaaaggcgacaacttccaactcatccgcttccacggtatgtatgagcaggacgaccgcgacatccgcgccgaacgcgccgaggcaaaactcgagcccttgaaatttatgcttttgcgctgccggctgccgggcgggatcatcaaaccgtcccaatggatagaactggacaaatttgcccgggaaaacagtcattaccgctccatccggctgaccaaccggcaaaccttccaatttcacggcgtgccgaaagccaagttgcagacgatgcaccgcctcttgcacaaactgggtttggattccatcgccacggcggcggatatgaaccgcaacgtgctttgcacgtccaacccgatcgagtccgaactgcaccggcaggcttacgaatacgcgaaaaagatttccgaacacctgctgccgcgcacgcgcggttatctggatgtgtgggtggacggcaaaaaagttcaaagttccgacgacttccttcaagaagacgagccgattttgggcaaaacctatctgccgcgaaaattcaaaaccgcagtcgtcatcccgcccttgaacgatgtggactgctacggcaacgatttggatttcgtcgccgtttcagacggtaacggacagcttgccggcttcaatgttttggcaggcggcgggctttcgatggaacacggcaacaccaaaacctatccgaacatttcactggaactgggtttcgtgcctccggaacacgcgctgaaggccgccgaagcggtggtaaccacgcagcgcgacttcggcaaccgcagcgaccgcaaaaacgcccgcacccgctacaccattcaaaatatgggcttggacaacttccgcgcggaagttgaacgccgtatgggtatgccgttcgaacccgtacgcccgttcaaatttaccgggcgcggcgaccgcatcggctgggtgaaaggcatagacggcaactggcatttaacccttttcatcgaaagcgggcgtttggttgacgaaggcgggaaacagcttctgaccggcgtgttggaaatcgccaaaatccacaaaggcgatttccgcatcaccgccaaccaaaacctcatcgtggcaaatgtcgccgaagcagacaaagcaaaaatcgaagaatttgcccgaacatacggattaatccgcaacgatgtcagcaagctgcgtgaaaatgcgatgtcctgcgtttcctttccgacctgcccgctggcaatggcggaagccgaacgcgtgctgccggacttcatcggcgagctggataagattatggcgaaacacggcacgtcggacgactacatcgttacccgcattaccggctgcccgaacggctgcggacgggcgatgttggcggaaatcggactggtcggcaaagccgtcggacgctacaacctccatatcggcggcgaccgtgaaggcgtacgcatcccccgtctttacaaagaaaacatcaccctgcccgaaatccttgccgaattggacgacctgatcggcaaatgggcggcagaacgcaatatcggcgaaggtttcggcgatttcgccatacggacgggcatcgtcaaacccgtattaaatgcacccgttgatttttgggacgcatccaaagccgtcgcgattgcccgcgcctga

SEQ ID NO: 5208 - DNA, 1815 bp, Neisseria meningitidis
atgagtgaacacgatatgcagaacacaaatccgccattaccgcctctgccgcccgaaatcacgcagctcctgtcggggctggacgcggcacaatgggcgtggctgtccggctacgcttgggcaaaagcaggaaacggggcatctgcaggactgcccgcgcttcagacggcattgccggcggcagaacctttttccgtaaccgtcctttccgcctcgcaaaccggcaatgcgaaatccgttgccgacaaagcggcggacagcctggaagccgccggcatccaagtcagtcgcgccgaactgaaagactataaggcgaaaaacatcgccggcgaacgccgcctgctgctggttacctccacccaaggcgaaggcgaaccgccgaaagaagccgtcgtgctgcacaaactgctgaacggcaaaaaagccccgaaattggacaaactccaatttgccgtactgggtttgggcgacagttcctatccgaatttctgtcaggcaggtaaagatttcgaccggcgttttgaagaattgggcgcaaaacggctgctcgaacgcgttgatgcggatttggactttaccgcctccgcaaacgcctggacagataatatcgccgcactcttaaaagaagaagccgcaaaaaaccgggcaacgcccgcgccgcagacaacgccccccgccggccttcagacggcaccggatggcaggtactgcaaggcagccccctttcccgccgccctgctggccaatcagaaaatcaccgcccgccaatccgataaagacgtgcgccacatcgaaatcgatttgagcggttcggatttgcactacctcccgggcgacgcgctcggcgtttggtttgacaacgatccggcactggtcagggaaatcctagacctgctcggcatcgatccggcaacggaaatacaggcgggcggaaagatgatgccggttgcgcgcgcactttcatctcatttcgaactcacgcaaaacactccggctttcgtcaaaggctatgccgcgttcgcccattatgaagaactcgataaaatcattgccgataacgccgttttgcaggatttcgtgcaaaacacgcctattgtcgatgtgctgcaccgcttcccggcaagcctgacggcagaacaattcatccgtttactgcgtccgcttgcaccccgtttgtattcgatttcttcagcacaggcggaagtgggcgatgaagtgcatttaactgtcggcgtggttcgttttgaacacgaaggccgcgccagaacgggcggcgcatcgggtttccttgccgaccggctggaagaggacggcacggtgcgcgtgtttgtggaacgcaacgacggcttcaggctgcccgaagacagccgcaagccgattgtgatgatcggctcgggcaccggcgtcgcaccgttccgcgctttcgtccaacaacgtgccgcagaaaatgcggaaggcaaaaactggctgattttcggcaatccgcattttgcccgtgattttctctatcaaaccgaatggcagcagtttgccaaagacggcttcctgcacaggtacgatttcgcctggtcccgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagacgtggaagccgccttgctggatgtgattatcggggcaggacatttggacgaagagggcgcagaagaatatttggatatgctgcgcgaagaaaaacgctatcagcgtgatgtttattga

SEQ ID NO: 5209 - DNA, 1287 bp, Neisseria meningitidis
atgacggcacaacaccaaaccccgctccgcttcattaccgccggcagcgtcgatgacggcaaaagcaccctgatcggacgactgctctacgacagcaaagccctgctgtccgaccaaatcaaaaccttggaatccggcaaaagcaaaggtttgaaagaagccatagacttctccatcctgaccgacggactggaagccgaacgcgaacagggcattacgatcgatgtggcataccgctatttttccacggcgaaacggaaattcatcatcgccgacacgccggggcacgaacaatacacgcgcaatatggttacgggcgcaagcaccgcttcggcggcagtcgtgctggttgacgcatcccaactggatttcggcgcgcagcccttgcagcttctgccgcagaccaaacgccattccgccatcctccgccaactcaactgcccgcatattgtggtggcggtcaacaaaatggacctgctggattacagcgaagacaaattcaacgccattgtggaggcataccgccgacttgccgaacagctcggtttgaaagacgcgcatttcgtaccgatgtccgcactcttgggcgacaacattgtttaccccggcggcaatatgccttggtataaaggcgaacccttattgtccattttggaaaccctgccgggggcggacgaagtcagccgcaccgccgacgatttttatttccccgtgcaactggtcgtccgccaagatgccgacaaggccgatgatttccgaggctatcaggggcgcatcgaacgcggttcggtcgccgtcgggcaaaccgtccgcatcgaaccgaacgggctgaccgccgaagtgtccgaaatcatcacgccgaaaggggaagtggcgcaggcttttgccggcgaggcggcaaccctccggctggaccgcgacatcgatgtttcgcgcggcgacctttttgtcgataaaaattccccgctcgccccgcaaaaacatctggaagccacgctttgctggtttgacgaacgtccgctcaacaccgcgcgcaaatacctgctcaagcacggcacgcaaaccgtgccggcaaaagtcggggaaattgaaagcgttttggatgtccgcacgctggaacaagaggccggcgcggaatccttgaagatgaacgacatcgccaaagtccgcatcaaccttcaaaaacccgttacggcaacgccttatgcggaaaacaccgccgccggttcgtttatcctgatagacgaagcgacatacggcactgttgcggcaggtatgattttatga

SEQ ID NO: 5210 - DNA, 924 bp, Neisseria meningitidis
atgacgaaaaccgaaccgaacaacgcccaactcgactggttggaatccgaatccatccacatcatccgcgaagtggcggcagaatgcgaaaaccccgccctgctcttttccggcggcaaagattccgtggtcctgctcgccctcgcctgcaaagccttccggctgggcagccggccggtgaaactgcccttcccgctggtgcatatcgacacgggacacaactaccccgaagtgattgccttccgcgacgcgcaggcggcaaaactcaatgcccgcctgatagtggggcgcgtggaagactccattgccaaaggcacggtggtcttacgcaaagaaaccgattcgcgcaatgcggcacaggcggttaccttgttggaaaccatcgaggcaaacggcttcgacgcgcttatgggcggcgcgcggcgcgacgaagaaaaagcccgcgccaaagaacggattttctcgttccgcgacgagttcggacaatgggatccgaaggcgcaacgccccgagctgtggtcgctgtacaacaccaggctgcacaaaggcgaaaatatgcgcgtcttcccgatttccaactggacggaactcgacatctggcaatacatcgcccgcgaaaacctcgagctgccgccgatttattacagccacaggcgcgaagtggtcagacgcagggggctgctggtccctgtaacgccgctcaccccgaaaatgccgtctgaaacctccgaaatccttgatgtccgcttccgcaccgtcggcgacatcagctgcacctgcccggtagaaagcaccgcgtccacgccgacggagattatcagagaaacagcggttgccgacatttccgaacgcagcgcgacccggctggacgatcaggcaagcgaggcggcaatggaaaaacgcaaaaaagaaggctatttctaa

SEQ ID NO: 5211 - DNA, 741 bp, Neisseria meningitidis
atggaaacgacactgttcaaacccgccctgtggcagataccgcatatcggatccggcggcgaaaccgcccttgcggaaaaaacggaaaccctcaaacaacgcctgcaccggattgtcggcagccaccgggatgcacggtttgccagcagccttgcggcagaagatatggtgattaccgaccttatcgccggcgaaaacctcaatatcggcatttttaccttggatacggggctgctccacacggaaaccctgaacctgctggacaggctcggacgcgcatatccccatttgcggataaagcgtttccggccggttcgagaagatgccgaccgttatgtggaaagcaaaggcaggtttgccttttacgacagcgttgaagcgcgccgcgaatgctgccgcatccgaaaaaccgaaccgctcaaccgcgccattgcaggcgcggacgcctggcttaccgggcaacgccgcgaacaatccgccacacgcacggaactgccgtttgccgaatacgatgccggacggggcatcggcaaatacaacccgattttcgactggtcggaacacgacgtgtgggcatacatcctcgccaacaatgtgccttacaacgatttgtaccggcaaggatttcccagcataggctgcgacccctgcacccgccccgtcaaggcgggcgaagacatccgcgccgggcggtggtggtgggaaggcagaaacagcaaagaatgcgggctgcacaaataa

SEQ ID NO: 5212 - DNA, 1452 bp, Neisseria meningitidis
gtgaattatttccctattttcgccaacctcgccggccgccccgtattggtcgtaggcggcggcgcggtcgccgcacgcaaaatcagcctgctgctgaaggcgggcgcagaggtcagggttgccgcaaaacacctgaatgccgaactctccgcgttggcggcggaaaacaaaatcctgtggcttgccgaagaatttcgtgccgaacacatccgcacggttttcctcatcattgcggcaagcagcgaccaagccctcaaccggcgcgttttccatcttgccgaaagctgccaaaagccggtcaacgtggtggacgaccgcgaccattgcagcttcatcttcccgtcggttatcgaccgcaacccggttcagattgccgtttccagctccggcagcgcgcccgtcctcgcccgactgctgcgtgaaaggctggaagccctgctgccgccgtctttgggcgatatggcggaaatttcaggaaggtggcgcgatgccgtcaagggcaaactgaaatccgttaccgaacgccgccgcttttgggaaaagcagtttaacggacgtttcgccgccctcgtcaaaaaccggcaaaacacccttgccgaacgggaattggcaggccaattggaacaaagtcgtcaaaatgatcaaggcggctccgtctcgctggtcggcgcgggtcccggcgatgcggggctgctgacgctcaaagggctgcaggaaatccagcaggcagacgtggtgctttacgacgcgctggtttcagacggcatactgtccctcgtccgccgcgatgcggaacggatttttgtcggcaagcgcgcccggggcgagcgcaccccgcaagaggacaccaatgcgcttatggtcaggctggcccgcgaaggcaggcgcgtggtgcgtttgaaaggcggagaccctttcgtgttcggacgcggcggcgaagaattggaaaccttggcacgccatcagattccgttttcggtcgtccccggcattaccgccgccgtcggcgcgaccgcctatgccggcatcccgctcacgcaccgcgattatgcccaaagtgcggttttcgtaaccggccaccgcaaggcggatgcgcccgacatcgaatggcagaccctcgcccgcagccgccagaccttggtgatttatatgggtgcgctcaaagccgccctgattgccgaacggctgcaacagcacggacgctcgcccgacacgccggcagccgttatcagccaaggcacgctgccggctcaaaaaaccgcaaccggcacgctcgccaaccttgccgaactcgccgaaaccgcgccgaatccggcattgattgtcataggcgaagtggtggggctgcacgaaaaactcgcctggttcggtgaaaacggcgaaggagaaaaccgggtcgggcagacgtatcccgcattgggcggactgaatgccggacaacgggcggcataa

SEQ ID NO: 5213 - DNA, 159 bp, Neisseria meningitidis
atgccgtctgaagcccttttcgcccttcggacggcatcccctcaccacgcaaacggtctgaatgcccgaaacggcttcaggccgtttttcttccgaaaccgttataaaacggaaaaccgccgcatccgcagccgcccccatatagctttcagcttctaa

SEQ ID NO: 5214 - DNA, 657 bp, Neisseria meningitidis; identical to SEQ ID NO: 1603

SEQ ID NO: 5215 - DNA, 891 bp, Neisseria meningitidis
atgtttcccgtttttcatctttcaggcgagagccgccgccagatgcttcagacggcattgcgttttccccatgttttcaaagcccgtgcggaagattcgcacaaagggactttcggcacgctcgccgtagtcggcggatcggcagggatgagcggcgcgcccgtattggcggcatcggcggcaatgtatctcggctgcggcaaagtgtgggcgggtttcaatcaggatacgctaccttttgccgttattgccggttttcccgagattatgctggatacggcggacagtttggccaaacgtcaagatataaacgcctgggttgtcggttgtggattgggtacaggtagggcggcggtcggaacgcttgccggaattttgacggaacacacggacaagcccgtcgttttggatgcggatgcgctgaacatattatcaaccgatgccgaaacccgaaatctggcgcgcgggtgtaaaaacctgattttaacgccacaccccgccgaagccgcgcgcctgcttggaacgacggttgcgcaggttcaggcggatcggacggcggcagtgaggaagataggggcaattttcggcgcaaccgtggttttaaaggggcacaaaacattggttgcctcacccgatacggaaatctatgtcaacgaaagcggcaacgcgggattggcaacggcgggcagtggcgacgtattgggcggcatcatcggcagtctgctcgcacagggcgtgccggtttttgaagccgcctgcgcgggcgcgtggctgcacggcgcggcggcggatgtcataaaagaatcggcaggcattgcggcagggctgttggcaggggaaatcgctccggcggcaaggtggctgcgcaaccggataactaaaagtatgtaa

SEQ ID NO: 5216 - skipped

SEQ ID NO: 5217 - DNA, 198 bp, Neisseria meningitidis; identical to SEQ ID NO: 5179

SEQ ID NO: 5218 - DNA, 648 bp, Neisseria meningitidis; identical to SEQ ID NO: 1853

SEQ ID NO: 5219 - DNA, 372 bp, Neisseria meningitidis; identical to SEQ ID NO: 3471

SEQ ID NO: 5220 - DNA, 672 bp, Neisseria meningitidis; identical to SEQ ID NO: 5182

SEQ ID NO: 5221 - DNA, 720 bp, Neisseria meningitidis; identical to SEQ ID NO: 5183

SEQ ID NO: 5222 - DNA, 1314 bp, Neisseria meningitidis; identical to SEQ ID NO: 3997

SEQ ID NO: 5223 - DNA, 192 bp, Neisseria meningitidis
ttgatccaaaccgttactgccagccataaggctatatccctgactgctttcatttacttctgctcctgtttaaattcccagcaattccatttcaaagcgcgaacgccaacgggattgcgcggttacgatgcagactttcagacgatggttgaaaccccgtccggcggggctgtgggaatcgggtttgcctga

SEQ ID NO: 5224 - DNA, 873 bp, Neisseria meningitidis; identical to SEQ ID NO: 5186

SEQ ID NO: 5225 - DNA, 1863 bp, Neisseria meningitidis; identical to SEQ ID NO: 5187

SEQ ID NO: 5226 - DNA, 657 bp, Neisseria meningitidis; identical to SEQ ID NO: 5188

SEQ ID NO: 5227 - DNA, 762 bp, Neisseria meningitidis; identical to SEQ ID NO: 5189

SEQ ID NO: 5228 - DNA, 342 bp, Neisseria meningitidis; identical to SEQ ID NO: 5190

SEQ ID NO: 5229 - DNA, 144 bp, Neisseria meningitidis; identical to SEQ ID NO: 5191

SEQ ID NO: 5230 - DNA, 684 bp, Neisseria meningitidis; identical to SEQ ID NO: 5192

SEQ ID NO: 5231 - DNA, 198 bp, Neisseria meningitidis; identical to SEQ ID NO: 5193

SEQ ID NO: 5232 - DNA, 402 bp, Neisseria meningitidis; identical to SEQ ID NO: 5194

SEQ ID NO: 5233 - DNA, 960 bp, Neisseria meningitidis; identical to SEQ ID NO: 5195

SEQ ID NO: 5234 - DNA, 1281 bp, Neisseria meningitidis; identical to SEQ ID NO: 5196

SEQ ID NO: 5235 - DNA, 612 bp, Neisseria meningitidis; identical to SEQ ID NO: 5197

SEQ ID NO: 5236 - DNA, 237 bp, Neisseria meningitidis; identical to SEQ ID NO: 5198

SEQ ID NO: 5237 - DNA, 366 bp, Neisseria meningitidis; identical to SEQ ID NO: 5199

SEQ ID NO: 5238 - DNA, 306 bp, Neisseria meningitidis; identical to SEQ ID NO: 5200

SEQ ID NO: 5239 - DNA, 1377 bp, Neisseria meningitidis; identical to SEQ ID NO: 867

SEQ ID NO: 5240 - DNA, 1053 bp, Neisseria meningitidis; identical to SEQ ID NO: 5202

SEQ ID NO: 5241 - DNA, 636 bp, Neisseria meningitidis; identical to SEQ ID NO: 5203

SEQ ID NO: 5242 - DNA, 156 bp, Neisseria meningitidis; identical to SEQ ID NO: 5204

SEQ ID NO: 5243 - DNA, 144 bp, Neisseria meningitidis; identical to SEQ ID NO: 5205

SEQ ID NO: 5244 - DNA, 1860 bp, Neisseria meningitidis; identical to SEQ ID NO: 5206

SEQ ID NO: 5245 - DNA, 1770 bp, Neisseria meningitidis; identical to SEQ ID NO: 5207

SEQ ID NO: 5246 - DNA, 1815 bp, Neisseria meningitidis; identical to SEQ ID NO: 5208

SEQ ID NO: 5247 - DNA, 1287 bp, Neisseria meningitidis; identical to SEQ ID NO: 5209

SEQ ID NO: 5248 - DNA, 924 bp, Neisseria meningitidis; identical to SEQ ID NO: 5210

SEQ ID NO: 5249 - DNA, 741 bp, Neisseria meningitidis; identical to SEQ ID NO: 5211

SEQ ID NO: 5250 - DNA, 1452 bp, Neisseria meningitidis; identical to SEQ ID NO: 5212

SEQ ID NO: 5251 - DNA, 159 bp, Neisseria meningitidis; identical to SEQ ID NO: 5213

SEQ ID NO: 5252 - DNA, 657 bp, Neisseria meningitidis; identical to SEQ ID NO: 1603

SEQ ID NO: 5253 - DNA, 891 bp, Neisseria meningitidis; identical to SEQ ID NO: 5215

SEQ ID NO: 5254 - skipped

SEQ ID NO: 5255 - DNA, 1812 bp, Neisseria meningitidis; identical to SEQ ID NO: 1597

SEQ ID NO: 5256 - DNA, 2376 bp, Neisseria meningitidis
atgaataaaaatattaaatctttaaatttacgggaaaaagacccgtttttaagtcgtgaaaaacagcgttatgaacatcctttgcccagtcgggaatggataatcgaattgttggagcgcaaaggtgtgccttcaaaaatcgaatcgcttgcgcgcgagctgtcgattacggaagacgagtatgtcttttttgaacgccgtctgaaggcgatggcgcgggacggtcaggttttaatcaaccgtcggggcgcggtttgcgcggcggacaaattggatttggtcaaatgccgcgtcgaggcgcataaggacggtttcggttttgccgtgccgctcacgcccgccaaagacggtgattttgttttgtatgaacgccagatgcgcggcattatgcacggcgatattgtcactgttcgtcctgccggcatggaccgtaggggccgccgcgaagggacagttctggatattgtcgaacgcgcgcaaagcaaagtggtcggccgtttctatatggataggggcgtggcgattttggagccggaagacaagcgtctgaaccaaagcatcgtattggaaccggacggcgtggcgcgtttcaaacctgaatccggtcaggtcatcgtcggcgaaattgaggtttatcctgagcaaaaccggccggcagtggcaaaaatcatcgaagttttgggcgattatgccgacagcggcatggagattgaaattgccgtgcgcaagcatcatttgccgcaccaattcagtgaagcgtgtgccaaagctgcgaaaaaaattcccgtccatgtacgcaaaagcgatttgaaaggccgcgtcgatttgcgcgacctgcctttggtaacgatagacggcgaaacggcgcgcgatttcgacgacgcggtgtttgccgaaaaagtcggacgcaattaccgtctggtcgtggcgattgcggatgtcagccattatgtccgccctgacgatgtgattgatgcagatgctcaagaacgcagtaccagcgtatatttcccgcgccgtgtgattccgatgctgccggaaaacctgtctaacggcatttgctcgctcaatcccgatgtcgagcgtttgtgtatggtgtgcgatatggtcgttacctatgcgggcaatatcaaagaataccgcttctaccccgccgtaatgcgctctcatgcccgcctgacctacaaccaagtttggaaatggatttcagacggcatcgaccatccgtacaaagcccaaatcgacaccctttacaaactcttcaaaatccttcagaaaaagcgtttcgaacgcggcgcggtggagtttgaaagcgtcgaaacccagatgattttcgatgacaacggcaaaatcgaaaaaatcgtccccgttgtccgcaacgatgcccacaagctgattgaagaatgtatgctggcggcgaatgtttgcgcagcggatttcctgttgaaaaacaagcatacggctttgttccgcaaccatttgggccccacgcccgaaaaactcgccaccctgcgcgagcagctcggtctgttggggcttcaacttggcggcggcgacaacccgtcgccgaaagactatgccgcgcttgtcgaacaattcaaaggcagacctgatgccgaattgctgcaagtcatgatgttgcgctccatgcagcaggcggtttacgaaccgcattgcgacggacactttggtcttgcctacgaagcatacgcccacttcacctcgcccatccgccgctatcccgacctgaccgtacaccgcgccatcaaagccgtgttgaatcagcaaacctacacgccaaaaaaaagctggcaggctttgggcgtgcatacctcgttctgtgagcgccgtgccgacgacgccagccgcgacgtggaaaactggctgaaaacctattatatgcgcgataaggtcggcgaagtattcgaaggtaaaatctccggcatgaccagttttggtatctttgtaacactggacggcatccacattgacggcttggtgcatatcagcgatttgggcgaagactatttcaacttccgccccgaaatcatggcaatcgaaggcgaacgcagcggcatccgtttcaacatgggggacagggttgccgtccgggtcgcccgtgccgatttggatgacggaaaaatcgattttgtcctgattgccggggggagcggcagggggcggaaagttaaatcatccgcgtctgccaaaccggcagggacggcggggaaagggaagccgaaaaccgccgccgagaaaaaaacagcccgaggcggcaaagtaaggggaaggggcgcgtctgccgccgcagaatcgaggaaaaaggcaaagaaaccggttccgattaaggtaaaaaaacggaaaggcaaatcataa

SEQ ID NO: 5257 - DNA, 1464 bp, Neisseria meningitidis
atgcgtatcgtagaaaaagcctatactttcgacgatgttttgttggttcccgcacattcgaccgtgctgccgcgagacgttaaacttcaaaccaagctcacccgcgaaatcacactcaacctccccctgctttccgccgcgatggacactgttaccgaggcgcgcctcgccatttcgatggcacaagaaggcggcatcggcatcatccataaaaacatgccgcccgaaatgcaggcgcgcgccgtttccaaagtgaaacgccacgaaagcggcgtggtcaaagaccccgtaaccgttgcaccgacaacgctcatccgcgaagtcttggaaatgcgtgcgcagcgcaaacgcaaaatgtccggcctgcccgtcgttgaaaacggcaaagtcgtcggcatcgtaaccaaccgcgacctgcgttttgaaaaccgcgtcgatttgcccgtttccgccattatgaccccgcgcgaacgtctggttaccgtccccgaaggcacaagcatagacgaagcgcgcgaactgatgcacacgcacaaagtcgagcgcgttttggttctgaacgaaaaagacgaactcaaaggtctgattaccgtcaaagatattttaaaaaccaccgagtttcccaatgccaacaaagactccgaaggccgtctgcgcgtcggtgcggcagtcggcaccggcggcgacaccgaagagcgcgtcaaagccttggttgaggccggcgtggacgtgattgtcgtcgataccgcccacgggcacagccaaggcgtgatcgaccgcgtgcgttgggtcaaagaaacctatccgcacatccaagtcatcggcggcaacatcgccactgccaaagccgctttggatttggtcgccgccggcgcggatgccgtcaaagtcggtatcggtccgggatcgatttgcaccacccgtatcgtggcaggtgtcggcgtgccgcaactgaccgccattcacaacgttgccgaagccctcaaaggcacgggcgttccgctgattgccgatggcggcatccgcttctccggcgacatcgccaaagccctcgccgcaggcgcgtacagcgtcatgctcggcggtatgtttgcaggcacggaagaagcgccgggcgaaatcgaactctaccaaggccgctcatacaaatcctatcgcggtatgggttccttgggcgcgatgagccaaggttctgccgaccgctacttccaagacaaaaccgacagcaccgacaaatacgtccccgaaggcatcgaaggccgcgttccttacaaaggcccgattgtgaacatcatccaccaactgaccggcggactgcgctccagcatggggtatttgggttgcgccaatattgccgaaatgcacgaaaaagcagaatttgtggaaatcacttccgcaggtatgagcgaatcgcacgttcacgacgttcaaattaccaaagaagcaccgaactaccatcgctga

SEQ ID NO: 5258 - DNA, 462 bp, Neisseria meningitidis
atgaatattattatggactcaacaagaaaatttgggattttatgggaagaaaactctgaatgtaatggttttatttatggaaaaattcagataataataggagagaatatatatcctaagatatgcccatatggatattttacgctaaatgcagtttttaatagtttgaagtcatcctttgaagagaagtattatgcaggtggaaacaatggtttagattttggagagcaactatttgatatagataaatataattctctggaattatgcaatatattttctattgatactacatatatgagtggagggggtaattgtgaaatagattgtttagtattagaaatgggatattctggtgaggaagagagacttttttatagttttgacaatgggaaaaactttaaagaaatcaggtataagaaaggtacagttgaatctgttatttttcaattgaatctataa

SEQ ID NO: 5259 - DNA, 2559 bp, Neisseria meningitidis
atgcctgcaaacctgtcttcagcactggaaaccttcaaacagcagcgcgatgccgccgaagcgcattatttgaaagccaaccgcgtgtcggtatttttcagagaatacacggcggcagtcgaaaccttactggcggcattgtgggcagagtattttcaaaacagcgcgttatgcctgatggcggtaggcggcttcggacgcggcgaactgtatccctgttcggatgtggatttggcggttgtctcccctgccccgctttcagacggcattcaggaacagattgcccggtttgttcaaaccctgtgggactgcaaactgatgccgtctgtaaaaagcggcagcgttgatgaactatgtgaaagcgtgcgcaatgatattacgggggacacagcgtttttagaggctaggtttttgtttggcaaccgccaaacggtggataaactggcggaaaaaatgaacgcgcagcgcaatgtggcggcgtttgtcgaggcaaaactggtggagatggaacaccgccacgccaaatcgcaaggttcgggggcagtattggagccgaatatcaaaagctgtccgggcggtctgcgcgatatccacaccctgctttggatagcgaaggcgcaaggcttggcgaccgacctgcccgacctgctcaaacagcggattttgacgcgtgccgaagccggtatgctttcgcacggctaccgccgcctcgcccacatccgcatccatctgcatttaaacgccaagcgcgccgaagaccgcctgctgttcgatttgcagccgcaagtcgccgaaagcatgggttatgaaggcttgaacctccgccgccaaagcgaagaactgatgcgcgtgttttaccgcgcgattaaaaccgtcaaacaactgggcggcatcctcacgcctatgctgcaaagccgcgtttcctccaccccgttgcgcgttaccctgcggattgacgacgactacatccaagtcaacaaccaaatcgccgcgcggcacaccgatatttttttcagacggcccgaacacattttcaaaatcgtcgaaatcatgcagcagcgcaacgacattaccgcgctcgaaccgcaaaccctgcgcgcctggtggggcgcgacgcgcaaaatcaaccgcagcttctaccaaaatcccgaaaaccgccgccgcttcgccggttttttccgcaacggcaacgggctgacccagaccctgcgctttctcaacctctacggcgtgttgggccgctacctgcccgcgtgggaaaaaatcatcggcctgctccaacacgacctgttccacatctatcccgtggacgaccacatcctcaccgtcgtccgcaacgtccgccgccttgccttggatatgcacagccacgagctgccctacgcctctgcactgatgcagtcctttgaaaaacaagacatcctctaccttgccgcctttttccatgacatcgccaaaggacgcggcggcgaccatgccatacaaggcatcgcagacgcgcgccaatttgccgctgaccacttcctgaccggagaagaaagcgacctgctcgcctggctggtcgaaaaccacctgctgatgtctgccgtcgcccaaaaagaagacatccaagaccccagcgtactcgatgccttctgcaaacgcgtgcaaacccacgaacgcctcagcgcgctctaccttctgaccatttccgacatacgcggcaccaatcccaagctgtggaacgcatggcgcgccagcctgctggaaagcctcttccatgccgccggacgctaccttacaggcaacggcggcaacccgcacaccctcttcggccgccgccggcaggaagccgccgacttactcacccgcgccgccgtccccgaaaaacagcagaaaaaactatggaacgcgctcggttccgcctacttcgcccgccaccagtcccgcgaaatcctgtggcacgccgccaacctagtccacgactttgaaacccccatcgtccgcagccgcatcctgcccaaaagcgacagctttcaagtcatggttttcatgcccaacggcccgcgcctgttcgcccgcctctgccgcatcttcagccgccacggcttcgacatcctcgccgcccgcgccttcatcaccgaacacgactacatcctcgacaccttcatcgtgcaaatcccctcgcagcacgcccccgaagactaccccgacatccaaagcgcgctcgaagccgaactcaacagctttatccacggacacaccgttgccgaaacccaaagccgcagccgccgcatcagccgccgcagccgctatatgccgatcgcaccgagcatcaccatcacccccgaagaagactatcccgactggtattccgtcgaaatcaccgccgtcaaccgccccttcctgctcgccgatatggcggaagtctttttcgcccacaacgtcagcctgcgctatgccaaaatctccacactggatgaacgcgccgaagacagttttaccgtttttagccccgacctgaaaaacccaaaaatccagtcctcattgaagcagacgctgctggaacaattatcataa

SEQ ID NO: 5260 - DNA, 321 bp, Neisseria meningitidis
atgatgggcaacaaattgactctgcctgccgaactgcctgacgaacaggatttgcgggcggtattggcatacaatatgcggcttttccgcgtgaacaagggttggtcgcaagaagaattggcgcggcaatgcggtttggacaggacttatgtgtcggcagtcgagcgcaaacgctggaacatcgccctgtcgaatatcgaaaaaatggcggcggctttgggcgtggcggcgtatcagttgctgctgccgccgcaggaacggttgaagctgatgaccaattccgccgatacccgacaaatgccgtctgaaagcggtatttga

SEQ ID NO: 5261 - DNA, 147 bp, Neisseria meningitidis
atgaaattcagggtgcttgtttgctgtttcccaatctgtcttgattttatctctttcctcttgatgtgtgtgtgtttgggtgtggctgccgccaccccttttttttggcttttatgtgaagtaaaatccgtaacagcaaatgcttaa

SEQ ID NO: 5262 - DNA, 474 bp, Neisseria meningitidis
atgaaaggcgaccgtttggttatccgcgagctgaacaaaaacttaggcttgctgctggtaaccatcaaccaatatttccttcacgcccgtattttgaaaaactggggctttgaagaactgggcgaacatttcttcaaacagtccatcgttgaaatgaaagctgccgacgatttgatcgagcgcattctgttcctcgaaggtctgccgaacctgcaagaactgggcaagcttctgattggcgagtccaccgaagaaatcatcgcctgcgatttgaccaaagaacaggaaaaacacgaagccctgcttgccgccatcgccacagcagaagcgcaacaggattacgtcagccgcgatttgttggaaaaacaaaaagacaccaacgaagaacatatagactggctggagacccagcaagagcttatcggcaaaatcggtctgccgaactacctgcaaacagcggcgcaagaggactaa

SEQ ID NO: 5263 - DNA, 465 bp, Neisseria meningitidis
atgcaaggcaatcaagctgttgttgattatatgaacgaattgctgtctggcgagctggcggcacgcgaccaatactttatccactcccgcctctactccgaatggggctacaccaaactttttgaacgtctcaaccacgagatggaagaagaaaccacacacgccgaagacttcatccgccgcatcctgatgctgggcggtacgccgaaaatggcacgcgccgaactgaatatcggcacggacgtggtttcctgcctcaaagccgacctgcaaaccgaatatgaagtacgtgatgcgttgaaaaaaggcatcaaactgtgcgaagaggctcaagactatgttacgcgcgacctgatggttgcccaactgaaagataccgaagaagaccacgcccactggctggaacagcagcttcgcctgatcgagttaattggcgaaggcaactactaccaaagccaactgtaa

SEQ ID NO: 5264 - DNA, 204 bp, Neisseria meningitidis
atgcgtgcattgtatgcaaaagctgtcggcatgacaaattttctatttaaaatacaaacaattatcaaaagaaatagggcgtattccccgatgccttccaaatcagtatgctgtttcttatcggtttttttgctgctaaaactaagaatccatctcatccataaagaacatttacacttattaaccatagcaaaaaacaaatag

SEQ ID NO: 5265 - DNA, 204 bp, Neisseria meningitidis
atgccgtctgaggggctttcagacggcatgcctgcccggacagacgctgcttggagcggctgtcggtttgaaggtgtgtttaatgcgaagggcaatctgtcgtatgatgtgtttgcggcaggggctttgaagaagcccggtattttaggacgaagcgcgcggctgccggggtcaatatccgctatttattccaaaccttattaa

SEQ ID NO: 5266 - DNA, 468 bp, Neisseria meningitidis
atgaagatagaaaatatcgatattatttcgccggaactgttcccgcaggaaacattcaatgaaaccgaagcattcggcgctttggtatggttgtgggcagtttcgcctatttatcagcatgccggcgtacaagaagccgccgtcaatatcttgccggtattgaaaaacgggcaatttgccttgttcagcagcaacggacaccccgtcgcctactgcacttgggcttatttcgatgaagaaaccgaatggcaatatctccaatccaatgatgttctgcgccactcggaaaactggtgcagtggaaacagaatgtggcttatcaactggttcgcacctttcggcgacagccgtatgatgaaaagaattctggtgcatctgtttccgaaacgtgaaataaggtggctgtaccaccgggggagtgaaaaaggaaaacggattatgaggtttccagcgttgtcgaaacaataa

SEQ ID NO: 5267 - DNA, 243 bp, Neisseria meningitidis
atgaaatatatcgtatcaatctctttggctatgggattggctgcctgttcgtttgggggattcaaacctccgcccgatgactcggtatactggaagtattcccgtatagaacaagaatatccggcaatgatgagtaaaaatatcaatttacgcatatattcttatgaagaatatagcaaacaaatagatgatctttttgctaaggaaaaaaagactggaaagagtgcggctatgacccaatag

SEQ ID NO: 5268 - DNA, 339 bp, Neisseria meningitidis; identical to SEQ ID NO: 3709

SEQ ID NO: 5269 - DNA, 363 bp, Neisseria meningitidis
atgaaatatatcgtatcaatctctctggctatgggattggctgcctgttcgtttgggggattcaaacctccgcccgatgactcggcattttggagattgacaaattacgccaaactttatccgggattaacctcagcgacacttgaccaatacccacctgaagagagacgaagacaactgcatgattcttttgctagagaaaaaaaagactggaaagagtgcggctatgacccaataggtgggggcggtgggagtgaagcagatgcctgcatgagaaaaagaggttggtatcgtgtaggtaacgacatttatcccgaaaacaaaaaatacgaatggcctcgagaagaaggaaaaacaaaatga

SEQ ID NO: 5270 - DNA, 6822 bp, Neisseria meningitidis
atgaacaagcgatgctacaaggttatcttcaacaagaaacgcagttgtatgatggctgtagcagagaatgttcatcgtgacggcaagagtatgcaggatagtgaggcggcttcggttcgagtgaccggtgccgcttctgtttcttctgcccgggcagccttcggtttccgtatggctgccttttctgtcatgttggctttgggtgttgctgcgttttcccctgcccctgcttccggcatcattgccgacaaatccgcccctaaaaaccaacaagccgttattcttcagacagcaaacggtttgccgcaagtcaatattcaaactccgtcatcccaaggcgtttctgttaaccgattcaagcagttcgatgttgatgaaaaaggcgtaatactaaacaacagccgcagcaatacgcaaacgcaactcggtggatggattcaaggcaatccccatctggcacgcggcgaagcgcgggtaattgtgaaccagattgacagcagtaatccttcgttgttgaacggttatatcgaagtcggcggcaaacgcgccgaagtagtcgttgccaatccgtcgggcatccgtgtgaatggcggcggattgattaatgccgcttcggttacgctgacttcgggcgttcctgttttgaataacggcaatctgacgggctttgatgtttcttcgggtaaagtcgtgattgggggcaaaggtttggatacctctgatgccgattacacccgtatccttagtcgtgctgctgaaatcaatgcgggcgtttggggtaaagatgtcaaggtggtttcgggtaagaacaaattggattttgacggctctcttgccaaaacagcttctgcgccatcttcttcggattctgttactcctaccgttgccatcgacaccgccacactgggtgggatgtacgcagacaaaatcactttaatcagcaccgacaacggcgccgtaatccgcaacaagggtcggatttttgccgcaacaggcggcgttacgttaagcgcagacggcaaattgagcaacagcggttcgattgatgctgccgaaatcaccatttccgctcaaaccgttgataaccgccaaggctttatccgcagcggcaaaggcagtgtattgaaggtttcagacggcataaataatcaagcaggcttaatcggctcggccggtttgctggatattcgcgatacaggcaaaagcagcctgcatatcaataacacagacggcacgattattgcgggcaaagatgtttccttacaggcaaaatcactggacaacgacggcatattaaccgccgcacgcgatgtttccgtttctcttcatgatgattttgccggcaaacgcgatattgaagccggacgcacactcacgttctccacccaaggccgtctgaaaaacacccgcatcatacaggcaggcgataccgtatccctgaccgccgcccaaatcgacaacactgtctccggtaaaatccaatccggaaaccgcaccgggttaaacggcaaaaacggcatcaccaacaggggtttaatcaacagcaacggtataacgctgctgcaaaccgaagccaagtcggacaatgccggcacgggcagaatttacggcagccgtgtggcagttgaggcagataccttgttgaaccgggaagaaacggtcaacggcgaaaccaaagcggcggtaattgcagcgcgggagcggttggatattggagcgcgggaaattgagaaccgagaggcggcattattgtccagctccggcgatcttcatatcggttctgcattgaatggaagccgacaggtgcaaggagcaaatacatcactgcacaaccgcagtgcggcaatcgaatcatcaggcaatatccgtatcgctacaaaagatttgcagaataccaatgagcatctgcgtttccatacggaagaaacccatcgcgaacaccgtatcgaatatcaggcggaaggcagaacagaacgctatccggaaggttctcaaaaagagttgggctgggaaatatttgaagatgagtctttacatatgcggactccggacggcagcccccactctgtctggtacaaatacgattacgaacgaatcaccgccgagagcaaaattaccgaatccaagcccggtcaaatcatcagtggcggcaatttggttttagatgccgccaagctgaaaaatcataacagccggattattgccggcggcagattgatcgtcggtacgcccgaatccgcattggacaatgatgaaactttgggaacaaaaaccataaccgataaaggggacttgcaccgttaccaccgtcatcacaagaaagggcgggattctacgggatacagtcggtctccctacgaaccggcccccgaagtcagctccatccgtatgggtatttcagcctataaaggctatgcgccccaacaggcatctgatatacccggcactgttgtacccgttgttgctgaaaacggcatccatcctacatttactctgccgaacagcagcttgtttgccattgcgccaaacaacaaaggctatttgattgaaaccgaccctgcctttaccgactaccgcaaatggctgggcagcggctatatgcttgccgcactgcaacaagacccgaaccatatccacaagcgtttgggcgacggctattacgagcagaaactggtaaacgaacaaatcgccaagctgacaggctaccgccgcttggacggttataccaatgacgaagagcaattcaaggctttgatggataacggcattaccatagccaaagaattgcagcttactccgggtattgccctgtctgccgaacaggttgcccgtctgacttccgacattgtttggctggaaaacgagaccgttaccctgcccgacgggacaactcaaaccgtattgaaacccaaagtctatgtccgcgcacgccccaaagatatgaacggacaaggggcgttgctgtccggcagcgttgttgatatcggcagcggcgccattgaaaaccggggcggcttaattgccgggcgcgaagcactaattttaaacgcacagaatattaaaaatctgcaaggtgatttgcagggcaaaaacatcttcgccgcagcaggcagcgacattacgaataccggcagcatcggcgcagaaaacgccctgctgctcaaagcgagtaacaatatagaaagccgcagcgagacccgcagcaatcagaatgagcaaggctcggtacgcaatatcggccgggtggcaggcatttatctgaccggcaggcagaatggaagcgtcttgctggatgcaggcaacaatatcgtcctgacggcttccgaattgaccaatcaatctgaagacggtcaaaccgtactgaatgccggcggcgacatccgctcggatacgacgggcatttcccgcaatcagaacactatctttgattccgacaactatgtgattcgcaaagaacaaaacgaagtcggcagcaccatccgcacccggggcaatctcagtctgaatgcaaaaggagacatccgtatccgtgcagcagaggtcggcagcgaacaaggccgtctgaaactggcagccggacgggatatcaaagtcgaagccggcaaagcccataccgaaaccgaagatgccctgaaatacaccggtagaagcgggggcggcatcaaacagaagatgacccgccatctcaagaaccaaaacggacaagccgtatccggcacgctggacggcaaagaaatcattctggtttcaggacgcgatattaccgttactggcagcaatatcattgcagacaaccataccattctctcggcaaaaaacaatatcgtccttaaagcagccgaaacacgcagccgcagtgccgaaatgaacaaaaaagaaaaatccggactgatgggcagcggcggcatcggctttacggcgggcagcaaaaaagacacgcaaaccaaccgatccgagaccgtcagccacacagaaagcgtcgtcggcagcctgaacggcaataccctgatttcggcaggaaaacattacacccaaaccggttcgaccatatcctcgccccaaggcgatgtcggcatttcctccggaaaaatcagcatcgatgccgcacaaaaccgttacagccaagagagtaagcaggtttacgaacaaaaaggcgtaaccgtcgccattagcgttccggttgtgaataccgtaatgggcgcggttgacgccgtaaaagcagtccaaaccgtcggcaaaagcaaaaacagccgggtcaatgccatggctgctgccaacgccttgaataaaggagtagattccggcgtggcactctataatgccgcccgaaatcccaaaaaagcagccggtcagggcatcagtgtctccgttacctacggcgaacagaagaacacctccgaaagccgcatcaaaggcacgcaggtgcaagagggcaaaatcaccggcggcggcaaagtttccctgactgcttcaggcgcaggcaaagactcccgcatcacgattaccggctccgatgtgtacggcggcaaaggaacacgcctcaaagcagaaaatgccgttcagattgaagccgcccgccaaacgcatcaggaacgcagcgaaaacaaatccgcaggctttaatgccggagtcgccatcgccatcaacaaaggcatcagtttcggcttcacagccggagcaaactacggcaaaggttacggcaacggcgacgaaaccgcctaccgcaacagccatatcggcagcaaagacagccaaaccgctattgaaagcggtggcgataccgtcatcaaaggcgggcagcttaaaggcaaaggcgttggcgtaacggcagagagtctgcatatcgaaagtttgcaggataccgccgtgtttaaaggcaaacaggaaaatgtttccgcccaagttacggtaggctacggctttagtgtcggtggcagctataaccgctcgaaaagcagctcggattatgcatccgtcaacgagcaaagcggtatctttgcaggaggagacggctatcggattcgcgtaaacggcaaaaccggattggtcggcgccgctgttgtttcagatgccgacaaatcaaaaaacctgctgaaaacaagcgaaatctggcataaagatattcaaaaccatgcttcggcggctgcttccgccttgggcttgagcggcggtttttcatacagcccgaagcctaccagcggacagtattccaccaaaaaagaagcagaaatcggtaaaatcggcggcaaaccggtcagcctgatgcgttttgaccaggtttcggcgaaagacgacgagttgaacgaaaaatatcgaagtgagcgtattgaaaaaggggaaacctttaaagaggcaaatttaaatcaaaacaacgccggcggcttgaaattcggtttgaagcaaaacgatatacacagcaacgacaaatacgccttggcaaaaatgggtttgggcaatctgttgggcaatgccaaagaatcagaaagccgccaatccattacccgctccgtcatcagtgagggagattggcaaattgcttccgcgcagggcaggaaaaatattgccggtattgaaaaaggcacttcatccgcacataaggcattggcaaaagcagaccgcgaaggcttgctgaaagaagtcgaactcaatagggatgttgccaaagagtttatcaatgagacgctgatcggcggcattgcagacgaagcctaccgcagccagtttattgcagaacaccgcctgatgacctttaaaatggatgaaaacggcgagccgattgaagataagcagcttgaagaggatataaataaacagtttgacaactcagtaaagttgaaaaaagaatttgcctcatttaaagattattgggaagcctataaagccattgggggaaatatctacgaattgcgcgaagtatccgaccaggaacggaaaaatctgaaaactgcccgttacaccgacccggagaccggcaaaaccgttgaaaaaatcgttgtcggcgtcaacggcattttcaataatatacaagcagccgccaaatttgccgcccaacaatatgtggggcgtttcaatcccgagaaaaaccgatatgaacgcacctatgaaaatgtttatttcctgcacaatccggaaaccaatgggcggggcttttcaaaattgcccgaaatcgccgttgcggcctttcataaaatgctcgaaggggcaaaaataggcaataagaccgttatcggcttgagcaattcaggcttggctttaggcaatatcatggaagactacgggaaggataaaaacggcctgtttgtcggctcgcacagccgtggaaccctggtggtcgacaatgtactcaataccttgaatacccaagccaatcgggataagaaaattttatccaataccgaactgaaaatggtcggccctgccgccaacgttgtccgggcagataaaaggctgtttcaactgcagcagggggtaacgacacccagaacggcagatttcgcccgtcagtccatccaaatagaaaaccacgaattagaccttatcggcatgctgattggcagaaatccggcaacagtcggaaccaatacccggcaaaaaagccaatggcaggctataagggatattataggggattacacctcgccgcataattgctacggtatggctaataaacaatgtgtaacagatggttatcgagaccctgaaaataaacaaacccaaagtccgacaggtgtatttgaaagaggagtgtccaacgaaatcgaaattatgtaccgtcctgtacgcatttatgatctgcaacatccgaaaggaaaaacaaaatga

SEQ ID NO: 5271 - DNA, 159 bp, Neisseria meningitidis
atggatcaacagccgttattgaaattgccgaattcccacataataatttggcgaatggatgggttagggaagattttttcccaattgaaaaataacgataacctgtttattgaagcctatttacgcccggttaactttcatagtaactcttttgaataa

SEQ ID NO: 5272 - DNA, 984 bp, Neisseria meningitidis
atgagtgaaatcaaaaccgacgaccccaaacgcggcatcaaactcagaggcgcggacaaaaccgcgcgcatccccatcaaagtcgtcccccttcaggaaaaactgaaaaagcccgaatggatacgcgccaaactcccatcgcgcaaattctttgaaatcaaagacattttgcgcgaacaaaagatgcacaccgtttgcgaggaagcctcctgccccaacatcggcgaatgcttcagcaaaggcacggcgaccttcatgattatgggtgacatctgcacccgccgctgcccgttctgcgacgtgggacacggtcggcccaatatgctcgaccccgacgaaccgagaaacctcgccgaatccgtcaaagccatgaacctgcgttacgtcgtcatcacctccgtcgaccgcgacgacctgcgcgacggcggcgcacagcatttcgccgactgcatcaaagccatccgcgaaaccagcccgaacaccaaaatcgaaatcctcgtccccgacttccgaggacgcttggacatcgcactcaaaatccttgccgaaaccccgcccgacgtgatgaaccacaacctagaaacccatccgagcctgtacagaaaagcccgtcccggtgccaattatcaacattctttagacttattaaaacgttataaagaaatgatgccgcacatcccgaccaaatccggcatcatggtcggcttgggcgaaacagacgaagacgtgcgtgaaattatgcgcgatatgcgggcgcacaatatcgaaatgattaccatcggacagtacctccagccttcagacggacacctgcccgtcctgcgctacgttacgcccgagcagttcaaaatctttgaaaaagaagcatacgaactgggcttcagcaatgccgccatcggcgcgatggtacgttccagctaccacgccgacgaacaggcggcggaagccttgagggaaagccacggcggttgcgggcatcattaa

SEQ ID NO: 5273 - DNA, 624 bp, Neisseria meningitidis
atgaaaatcatacacaaaggtttggtcgaatatctgccgacttttgaagcgatgaaaacctttaatgccggacggaatgccgacaccgaagacgaactgtgggtcgtcgaacacccgcccgtgttcacacaaggactggcgggaaaacccgaacacctgctgattcgcgacgacattcccgtcgtccaaatcgaccggggcgggcagattacctatcacgggcccgggcaattggtcgtttatacgatgattgatttcaaacggcgcaaaaccagtgttagaaacatcgtttccgcgcttgaaaacagcatcatcgccacattggcagaatacggcatcgaagcggcggcagaccccaaacgccccggcgtttatgtcggagaacgcaaaatcgcctcactggggctgcgtatcaaaaacggctccgtctatcacgggcttgcgctcaacgtcaatatggatttaagcccgtttacccacatcaacccctgcggctacgccggtatggaaatgacgcaaatcgcggattttgtccaaccctgccccacgccggacgaagtcgccgccaaactcaccgcacaccttgaaacacaattcacaccgaaagcagacaacaatgagtga

SEQ ID NO: 5274 - DNA, 276 bp, Neisseria meningitidis
atgaccgaacaaaaaaacaaaacatccctcatcgaatttccctgcaccttcccattgaaagtaatgggcgcggtgcatcccgagttcgagcaggcggttttagacaccgtccgcctccacgcccccgacacgcaggcgcaccacatcaccacgcgtccgagcagcaaaggcaactatactggcgccaccgtacaggtaaaggttgaaaaccaagaacaattggacaacatctaccgtgcgctgacttcgcacgaactggtcaaagtggtactttga

SEQ ID NO: 5275 - DNA, 1071 bp, Neisseria meningitidis; identical to SEQ ID NO: 783

SEQ ID NO: 5276 - DNA, 948 bp, Neisseria meningitidis; identical to SEQ ID NO: 2437

SEQ ID NO: 5277 - DNA, 408 bp, Neisseria meningitidis
atgactgtatggtttgttgccgctgttgccgtcttaatcatcgaattattgacgggaacggtttatcttttggttgtcagcgcggctttggcgggttcgggcattgcttacgggctgaccggcagtacgcctgccgccgtcttgaccgccgctctgctttccgcgctgggtatttggttcgtacacgccaaaaccgccgttagaaaagttgaaacggattcatatcaggatttggatgccggacaatatgtcgaaatcctccgacacacaggcggcaaccgttacgaagttttttatcgcggtacgcactggcaggctcaaaatacggggcaagaagagcttgaaccaggaactcgcgccctcattgtccgcaaggaaggcaaccttcttattatcacacacccttaa

SEQ ID NO: 5278 - DNA, 660 bp, Neisseria meningitidis
atggacacttggcacgatgcactcggcggcgaaaaacagcagccgtattttcaggaaattttaaatgcagtcaggcaggaacgtttgtcgggacaaatcatctatccgccggcggcggatgtgttcaacgcattccgcctgacagcgttcgaccgggtcaaagccgtcattctcggacaagatccgtatcacggggcagggcaggcgcacggtttggcattttccgtccggcagggtatccgcataccgccgtctttactcaatatctacaaggagttggaaaccgacatcgaaggcttttccattcccgcgcacggctgtctgacagcgtgggcggagcagggcgtattgcttctgaacacggttttgacggtgcgtgcaggacaggcgcattcgcacgcccttttaggctgggaacgctttaccgataccgttatcaggcagcttgcgacacaccgcaagcaccttgtcttcatgttgtggggtgggtatgcacaacaaaaagggaggctgatagacagtcaaaatcatttgatattgaccgcaccgcatccgtctcctctgtcggcatatcgcggttttttcggctgccgccatttttcacaggcaaacagctatttgagccggcacggtatcgatccgataaactggaagctgtga

SEQ ID NO: 5279 - DNA, 2512 bp, Neisseria meningitidis
atggcaatcaaaaaaaaatcagctttatgcatcactttgggcgggctgcgacgagttgcgcggcggtatggatgcgagcctttataaagaactatgtgcttacgctattgtttttaaaatatgtttctgataagcataagtacggcggcggcatgattgagctgcacgccggtacgacttttgacgacatcgtcaaactcaaaaacaccgccgacatcggcgaccgcctgaataagattatcgcccaaattgccgaagccaacgacttaaaaggcgtgatcgacgttaccgacttcaacgacgaagacaaactgggtaaaggtaaggagatgatcgaccgtttgagcaggcttgtcggcatttttaaaaagctcaacctttcttccaaccaagccgaagacgacgatttgttaggtgatgcctacgaatacctgatgcgccattttgcgaccgagtcaggcaaatccaaagggcagttttacacgcctgccgaagtctcccgcattatggcgaagattatcggaatcagcgcagattgccgtccagcaccagcgtttatgacccgacctgcggctcgggttcgctgttgctcaaagccgccgcccaagccggcagccaaatcagcctttacggtcaggaaaaagatgtggcaaccgcgtcccttgcccgtatgaatatgattttgcacaacaacgaaaccgccgaaatcaacaccgggaacaccttgtccgattcgtctttccgtgatgaaaacgacgggcttaagaccttcgattttgccgttgccaatccgccttatcccgcccgaaaaaaacggcgattacgcctttttgctgcatctgctcaaaagcctgaaaccaagcggcaaaggtgcgattattcttccgcacggtgtgctgtttcgcggcaatgccgaagcgcgtattcgcacggaattgcttaaccttgaccttattaaaggcattatcgggctgcctgccaacctgttttacggcacgggcattcctgcctgcatcatcgtcatcgacaaagaacacgcccaaaccgcccaatttgccgaagagggaacaaaccaagttatcagcggcggcagcgtgtttatgattgacgcatcgcgcggcttcattaaagacggcaacaaaaaccgtctgcgtgagcaagacattcacaaaatcatcgacactttcacaaacctcgttacagccgtatggtgcatttaagcgaaatcgcagcacaagattacaaccttaatctgcctcgctatatcgacagcggagaagtcgaagacctgcaaaatctcgccgcctatctatctttatggcggcatacctgcgcacgatatggacgcattggaagcctattggcaagttttaggccgtatgaaaaacgagttgtttgccgaacacgatggccactttaccactatacaacggaatcgattgcaaatctttcccactctcaacagcttaaaatcctgcgggattggtgtggaatttagggctaatctagtacagccccaaatttaatccactataaaatcgaaagcagccaaatcaaagcccatatattggcgcaccccgattacgccgccttcaaagccggacacctagcaaagtttgccgcgtggcacactcaaaacgaccttgccgccatccaaccgggcaggcttatccggaaatggagcgaaagcctgctggacgcgttcaaacccggcagcctgattgaagaatacgatttctaccaaatcctgacggactactgggcggaaaccctgcaagacgatgtttatctcatcgcccaagatggctggaaggcggttaaaaacctggccgaaatcaccaaagaaagcgatgaagccgcgaacctgaccgtcgtctttgaggaaaccgaaaccgacaaaaaaggcaaagccaaaaccaagcgcatcagcaaaaaataccgcagcgaagtcatcgcccccgagctggttgcccgccgctacttttcagacggcatcgccaagctggaagaaaaacaaagcgagctggaacgcctaagccaagaattggaaaaccacatagaagaacacggcggcgaagagggtgcgctgaacgacgtattggatgcaaaaggcaaactttccgccaaacttctgaaaaccgcattggaagaaagcggcatagaagaaggcgaacgggctgttttacaaaccacccaaacactgatgacgcaggaaaaagccgcgaaagacgcagtcaaaacccaaatcgaagccctgaaccttgccgtattcaaacaatttggccgactttccgaagccgaaatcaagcagcttgccgttcaagacaaatggcttgccgatttacaaagccgaatcgaaaatcgcttggaaaacagtattcagcagcttatcagccgcttgaacacgctggaagaccgctaccgcagcccgatggccgagcttgcccgagaagtggaaaagtggcaaagcaaagtcaatgcccaccttgaaaatatgggttttggaggctga

SEQ ID NO: 5280 - DNA, 402 bp, Neisseria meningitidis
atgatgaaaaagcagcggcatatcctgtgtgtcggctgcctgtatattatattgaaggtcaacgtatttcccaataccggctggatggaagcgtcgaaagggatgcagggcatgtcgttcagtaccttcggatacgcggatgctccgggctatacattcagccgcattggccatactttaattttcctacttggaaagaccacagggacacgtacaactgtttccgatagttcgcataatgtatattatgttaaattatatatttgtgcaaataactccaaggcattaagctgttgtttgatgctttgccagtttgggagaaagttgtccatatgcgccataaaacgggcgttgcgatggcgttcgagcaaatgggtcagttcgtggacgacgacgtattaa

SEQ ID NO: 5281 - DNA, 516 bp, Neisseria meningitidis
atgaaatcaaaactcctcttaatcctaatcaacttttccctgatttcaagcccattgggtgcgaatgcggccaaaatctacacctgcacaatcaacggagaaaccgtttacaccaccaagccgtccaaaagctgccactcaaccgatttgcccccaatcggcaactacagcagcgaacgctatatcccgccccaaacgcccgaaccggtatcatcaccgtcaaacggcggacaggttgtcaaatataaagccccggtcaaaacagtatccaagccggcaaaatccaatacgccgccgccgcaacaagcaccctcaaacaacagcagacgctccattctcgaaacagaattgagcaacgaacgcaaagcattggttgaagcccaaaaaatgttatcacaagcacgtctggcaaagggcggcaacatcaaccatcaagaaataaatgcattacaaagcaatgtattggacaggcagcaaaatattcaagccctgcaaagggaactggggcgtatgtaa

SEQ ID NO: 5282 - DNA, 1923 bp, Neisseria meningitidis
atgattgaaatcaaaaacctcaccctgcaacgcggtttgaaagtcctgctcgacaaagccaacgctaccgtcaatcccggtcagcgcgtcggtttgatcggcaaaaacggaacgggcaaatcgagcctgtttgccttaatcaagggtgaaatcactcaggacggcggcgatgtctcgattccgaaaaactggcggctcgcttccgtttcccaagaaacgcccgatttggatatttccgctttggattacgttttgcagggcgatgccgagttgcaggcttttcagacggcattgaggcaggcagaagcgcaaaatgacggcatgaagcaggcggaatatcatgctaaattggaagaaatcgacgcttataccgcgccggcgcgtgcggcaaaattgttgaacgggctgggtttttcgcaagaagaacacagccgccccgtcaaatccttttccggcggctggcgtatgcgcctgaatcttgcgcaagccctgatttgccgcgccgatttgctcttgcttgacgaaccgaccaaccacttggatttggaaaccgtcttgtggctggaaaaccaccttgcttctttaccctgcacgcaaatcatcatttcccatgaccgcgattttctcaacgcggaaactacccaaaccattgaattatcgcagcaaaaactcacgcaatacggcggcaattacgatttttaccaaaacgaacgtgcgcagcgtctcgcgcaacaacaagctgcctatgtcaaacagcaggcgcaaatcaaacatttgcaatcctttatcgaccgcttcaaagccaaagccaccaaagccgttcaagcgcaaagccgcatgaaggctttggcgaagctcgaacgcatcgctcccgcgcatctggacagcgagttttcctttgagttttaccatcccgaccatctgcccaatcctttgttaaagctagaacacgcagatttgggttacgaaggcaaaactgttttgcacgacattaccctgtcgctggaaagcggcgcgcgctatggtttattgggtgtcaacggcagcggtaaatctacctttatcaaagctttggcaggcacaatcgatttactctccggcagcatcgtccgttccgaaaaactcaatatcggctattttgcccaacaccaactcgataccatccgctccgaccaaaaccctgtttggcatattcagcagctttctcccgaagtacgcgaacaagaaatccgaaatttcctcggaggcttcaattttgtcggcgatatggcgttgcagaaaaccgaaccattttccggcggagaaaaagcccgactcgctcttgccatgattatctggcaaaagccgaacctgctgctgcttgacgagccgaccaaccatttggatttggatatgcgccacgccttgacgctcgctctgcaaagtttccaaggcgccttaatcgtcgtatcgcacgatcgcagcctgcttgaagccacgaccgacagcttcctcctgatcgataaaggccgtctgaagaacttcgacggcgatttgaacgactaccgccaatggcgtttggcacaggaaaacgccgccgtcgcgcccgcagcatccgcacaaagccaaagccgcaaagacaccaagcgcatcgaagcgcaaatccgtcaggaaaaagcccgacgcggcaagccgatacagcagaaaatagaccgtgccgaaaaagaaatggcgcagctttccgaaattcagacggcatgtgaagcatttttagcacaagaagaagcttacttcgaggaaaacaaagaaaaattgcaggacaccttatccgagctggcaaaagtcaaaacacaacttgcccaaatcgaagaggtttggctggcttgccaagaagaattggaacagattgaaactgaaatcgagaaacagtttgccgagcgataa

SEQ ID NO: 5283 - DNA, 396 bp, Neisseria meningitidis
atgatgcggcaacggggtaaaaaaatgttgtttgaagaaaatccgatagacggacagtttgcggaatatgaatgcggtgcgggcggaatccggctggcggggcaaagtttccataaacccgtgcttgtacataaggattcggtctgcctgtcgcaatgccgaaccttgtccgatctgactccggaaaacctgttgtccgacgtcaaacctgttgactatccggaaatattgattatcgggacgggcgcggctcaggagtttatccatcccaaaatcatggcggatttttcccgaatcggaatcagcgtggaatgcatgaataccgattcggcattcaggacattggttttcctgcactcggaagggcgcagggcttgggcttggcttcagccgtaa

SEQ ID NO: 5284 - DNA, 1308 bp, Neisseria meningitidis
atgaagccagtaaacatcggtcttttaggtttgggtacggtcggcggcggtacggctgccgtgttgcgggacaacgcggaggaaatttcccgtcgcttggggcgcgaaatccgtatttctgccgtgtgcgatttgagtgaagaaaaagcccgacaaacctgcccgtccgcagcctttgtcaaagatccgttcgaactggtcgcacgtgaagacgtcgatgtcgtcgtcgaattgttcggcggtaccggcattgccaaagatgcggtgttgaaagccattgaaaacggcaaacacatcgttaccgccaacaaaaaactgctcgccgaatacggcaacgaaatcttcccgctggcggaaaaacaaaacgtcatcgtccaatttgaagcggcagtagcgggcggtatcccaatcatcaaagccctgcgcgaaggtttggcggcaaacaggattaaatccatcgccggcattattaacggcaccagcaacttcatcctctccgaaatgcgcgaaaaaggcagcgcgtttgccgatgtactgaaagaagcgcaggcattgggttatgccgaagccgatccgaccttcgacatcgaaggcaacgatgcgggccataaaatcaccatcatgagcgcactggcattcggcacgccgatgaacttttccgcctgctacctcgaaggcatcagcaaactcgacagccgcgacatcaaatacgccgaagaacttggctatcgcatcaaactgttgggcattacccgcaaaaccggcaaaggcatcgagctgcgcgtccaccctaccctgattcccgaaagccgcctcttggcaaacgtcaacggcgtgatgaacgccgtgcgcgtcaacgccgatatggttggcgaaaccttatattacggcgcgggcgcgggcgcattgccgaccgcttccgccgtggttgccgatatcatcgacatcgcccgcctggttgaagccgataccgcccaccgcgtaccgcatctggcgttccaacccgcgcaagtccaagcgcaaaccatcctgcctatggacgaaattaccagcagctactacctgcgcgtccaagccaaagacgaaccgggcacgctggggcaaatcgccgcgctgttggcacaagaaaacgtgtccatcgaagcactgattcaaaaaggcgtgattgatcagaccactgccgaaatcgtgattctgacccacagcacggtcgaaaaacacatcaagtcggcaatcgcagccatcgaagcactggattgcgtggaaaaaccgattaccatgatccgcatggaaagcctgcatgactga

SEQ ID NO: 5285 - DNA, 435 bp, Neisseria meningitidis; identical to SEQ ID NO: 2461

SEQ ID NO: 5286 - DNA, 270 bp, Neisseria meningitidis
gtgaacaagtctgaattgatcgaagcgattgctcaagaagccgacatttccaaagccgccgcacaaaaagctttggatgccactaccaatgcagtaaccaccgccctgaaacaaggcgacaccgttactttggtcggtttcggtactttctacgtgggcgaacgtgcggaacgccaaggccgcaaccccaaaaccggcgagcctctgaccattgccgccgccaaaacgcctaaattccgcgccggcaaagctttgaaagacgcactgtaa

SEQ ID NO: 5287 - DNA, 2463 bp, Neisseria meningitidis
atgacacaaaaagaaaagcattttgaggaatatgccgccttggcaacccttcctttgcgggatgtcgtcgtttacccgcatatggttctgccgctgtttgtcggcagaccgaaatccatcgccgcactggaaaacgccattacccgcgaggagccggttttcctgttggcgcaaaccgatgcggcggtagaagaaccgattgccgccgacctgtatcagaccggtacggtcgcacaagtcctgcaagtgttgaaactacccgacggcacggtaaaagtattggtcgaagggctgtatcgcggacgtgttctgaccattgaagacacgggcggtctgttcgtttcccatatagagacggtcgtggaagaagacacgggcggcaataccgacctcgaagccgtgcgccgcaccctgttggcgcagtttgaacaatacgccaaactcaataaaaaaatccccgccgaaattatcggcagcatcaacggcattgccgaaaacagccggctaaccgatacggtcgcagcgcatttgcagttgaaactggcgcaacgccaacagattttggaaattcccgaaatcggcaaacggatggaattcctgctggcacagctggaatccgaactcgacattatgcaggccgaaaaacgcatacgcggacgcgtcaaacgccaaatggaaaaatcccagcgcgaatattatctgaacgaacagattaaagcgatacacaaagaactgggcgaagaagacgaaaacggcgaactggatgccttggaagcagatatcaaaaaggcgggtatgaccaaagaagcggaagaaaaatgcctgtccgaactgaaaaagctcaaaatgatgccaccgatgtctgcggaatccaccgtcgtacgcaactacatcgacactttgctcgagctgccgtggaagaaaaaatcccgcgtcagcaaagacatcgccaaagccggactggtgctggatgccgaccactacggcctggaaaaagtcaaagaacggattttggaatacctcgccgtccaaaaacgtatggacaaactcaaaggcccgattctgtgcctggtcggccctccgggcgtgggcaaaacctctttgggcgaatccatcgccaaagcaacggggcggaaatatgtccgcatggctttgggcggcgtgcgcgacgaaagcgaaatcaggggacaccgccgcacctatatcggctctatgcccggtaagattttgcagaatatggcaaaagccggcgtgaaaaaccccttgttcctgctcgacgaaatcgacaaattgggtaacgacttccgaggcgatcccgccagcgcgttgctcgaagtgctcgatcccgaacaaaacaacaagtttgccgatcattatgcggaagtggattacgatttgagtgatgtgatgtttatcgccacatccaatagtctgaatattccgactccgttgctcgaccgtatggaaatcatccgtctgtccggctataccgaagacgaaaaaatcaatatcgcgatgcagtacctcgtaccgaagcaaatgaagcgcaacggtgtaaaagaaggggaattggcaatcgaagaaagcgcggtgcgcgatattatccgttattacacccgagaggcgggcgtgcgttcgctcgaccgcgaaattgccaaaatctgccgcaaggtggtgatgcagattaccttggacgaagataagaagaggttgtctgaaaccaagaaaaccagcaaagccaaacctaaagcggttaaagtaaatgagaaaaatctgcacgactatttgggtgtgcgccgcttcgattacggcgttgccgaaagcgaaaaccgtatcgggcaggttaccggtttggcgtggacggaagtcggcggcgaattgctgaccgtcgaagccgcagcattgccgggtaagggcgtgattcagtgcaccggccagttgggcgatgtgatgaaggaatccgtgtccgcagcgtggtcggttgtccgctcccgtgcggaatcagtgggtttggctcctgatttttacgagaaaaaagacatccacatccacgttcccgaaggcgcgacgccgaaagacggccctagtgcgggtattgcgatgaccttggcggcggtatctgcctttaccaaaatcccggtacgcgccgatgtggcgatgacgggcgaaattaccctgcgcggcgaagttttgcccatcggcggtttgaaggaaaaactgttggccgccttgcgcggcggcatcaaacacgtcctgattccgaaagacaacgtcaaagacttggaagaaatccctgaaaacgtgaaaaccggcctgaccatccatccggtcaaatggatagacgaggtattggctctgggtttggaaagccagcctgagccttgggcagaaccttctggtgcggaagcggcggcggaatccgcttcaaaaccaaaaccccgcagcagggcaaccaaacattga

SEQ ID NO: 5288 - DNA, 921 bp, Neisseria meningitidis
atgaagaagagggttcgcaaacctgccgccgtccgttccgatgcggatatcgccgcccttttccatgcccaccgtatgaagcaggcgcagcagagccgtattctgaatatgcttgccgttgaaatccgccccggttttgtgttggacaacaaacgcgcgcccgatatacgctccgctttgctcgacgtgtacggagaggcggacggcaaaccgtttttcctgccgctcaatctgctgctggggtttatgggtgcgcacgagtggcataagaaaggggttgccgttccgcagctgggcggcagcatacacgttcctttcggcgtattctcgccgttgcgcggcgaatacctcgacctgctcgcccatgcgccgtcaacgggttttcagacggcattcgatatcgggacaggctccggcgtgcttgccgccattttggcgaaacagggcattccttccgtcatcggcacggataccaatccgaaagccgtcgcctgcgcccgtgccaatattgcccgtttgggctttgaaaaacaggttgagatacgggaaaccgatctgtttcccgaagggtttgccgatctgattgtctgcaatccgccctggcttcccgccaagccgacttccgccgtcgaatccgcgttatacgaccccgaatctgcgatgctggctgcgtttttgcgggatgcgccgaaacatctgaatcccgacggagaaatccgcctgatcatttccgatcttgccgaacatctgcacctgcgtccatccgattttctggataaggcatttgctcaggcgggtttgcgtgttgccgatatgatgaaaaccaagccgaagcacaaaaaagccgcgaatccgagcgatccgcttgcttttgcgcgaacccgggaaaccactttcctataccgtttgaaaaaggcataa

SEQ ID NO: 5289 - DNA, 1746 bp, Neisseria meningitidis
atggaacggcagacagatgaatttgcccaagcggcggcaagggcggcaatccgttttttggaacactatgcgggttccggcgacgaagtgcttgcaaactgcaccgaacgcctgtttcaggcattgcaaaacggtcattcgtttatccgtttgagcggtggcgaggctgacgcgctgtcggcactcgcacccgttgtcggaacatccgccgcgcctttgattttggaaggcagaaggctgtttttgggcaggatgtggcagttggaatacgatttggctgccgagataaaacgcttggcggcagccggcacatccgcccccgacgcggcaggcgcgaggcaaaacctcgcaaaatggtttcaaggcacgggcagcgaagggcagcgcgatgccgccgccttggcactgttgcagtcttttatggtgattaccggcgggccgggaacgggcaaaacgacaacggttgccaaactgctggcgctgatttgcggtgaagacgaaaatcttcccaacatcgcgcttgccgcaccgacgggcaaagcggcggcacatatggcgcgcgcgctgcaccgtgcaatcaacggttttgacgcgccggaggccgtccgccgccatttgctcaaactggaagggcaaaccgtccaccgactgctgaagctgcgcccgcccaaaatgcaggcggcgttcaaccctgtttacccgctgccgtttgacgtattggttatcgatgaagcctctatgctggatacggcattgatgctgcaacttttaaaagcggtcaaaaccggcgcgcgcgtgattctgctgggggatgaaaaccagctcccgtccgtcggaataggggcggtgctgtccgttttgtcacaaaaaaccgttttggacggagaaacgcaccaaaggctggccggcttccttccggaacacggtttcagcgtcagcgcaaatccacccgtgttggcgcaaaacaccgcccatctgtcgttcagccaccgcttcggcgacaacagcggcatcggctgccttgcccgtgccgccgtatcgggcgatgaaggggcgtgggcattgtttgaccggtttccggacgaactggaacattcggaatgcagtccgaacgctcgagtcgaaaggttgtaccgggcacacaaagcctattggcaggcggtaaaagacggcaatatcgaagccgcatacgcgggcatttcggatatcgtggttctggcagcttggcggcaggatgcggaagacttcaacgaagcctattgccgccatgtacgccgcaaaatgaacataccggaacatttggcatattttgccggagagccgattatgatcaggcagaacgactacgcgcttgaactgttcaacggcgacatcggactgattatggaagatgtcggacggcagggcagccttgccgcctattttgccgatgcggacggatttaaaaaggtagcggtaagctgcctgcccgaatttgaacccgcattcgccatgaccgtccacaaaagccaaggttcggaataccgggaagtatggctgctgccgccttccgccgcaccttcggacgaaggggacgatgcattgtccggattgagtaaggagctgttatataccgccattacccgcgcgagagagaagttcgtattcttcggcggggaagaagccttccggcaagctgccgccaccgtcaaaacgcgtcagacggcattgggcagtatgctcgagcgggtattttcacaagaataa

SEQ ID NO: 5290 - DNA, 696 bp, Neisseria meningitidis
atgagtgagttgattttgaaatgcgaaggcgtgggcaaacgctatcgggacggcggtttggacgttcgggtgctgcacggcttggatttggaaatccacgcaggggaaagcaccggcatcatcggttcttcgggcagcggcaaatcgacgctgctgcatattttgggcgggctggatatgccgtctgaaggcagggtgctgctgatgggcgaggatttgcgtaccttaaaccagcggcgtttgggcgatttacgtaaccgccatctcggtttcgtgtaccagttccaccatcttctgcctgaattttcggcactggaaaatgtgatgatgccgcttctgatcggcaaaaaaagccgtgaagaggctgcggaggcggcaatggcgatgctggaaaaggtcggactgaaacaccgttcgacgcaccgcgcgggcgaactttcaggcggtgagcggcagcgtgccgccattgcacgcgccttggttacccaacccaaatgcctgcttgccgacgaaccgaccggcaatctcgatcgtgcgaacgccaggaatgttttggatatgatgctggaactgaaaacagaattgggaacggggctggtggtcgtaacgcacgacgacgaactcgccggccgcttcgagcgcgtgatggtcatgaaagacggcagcctgcaccccaaacagggcgcaaacgcctaa

SEQ ID NO: 5291 - DNA, 1248 bp, Neisseria meningitidis
atgttttctctagaggcttggataggcttgaggtatctcagggcgaaaaagcgcaacggctttatgtcgtttatcacgatggtttcgattgccggaatcgccttgggcgtaaccgcgctgattgtcgtcttgtcggttatgaacggctttcagaaagaaatacgcgggcagctcctgaatgtcgcgccgcacgccgaaatcggctatatcgataatacggatacggattggcgcaacctgcttcggtttaccgaaaaccgcaaaggtattttggctgccgcgccctatgtttccaatcaggcattgctggccaatgcgggcgaaatcaggggcgtgcagatgcgcggcattttgccgtctgaagaacgcaaagtggtggaatacggcgacaaaatgccggcaggcaaatttgaagatctgattccgggcgagtttgacattatcctcggtgtcggcttggcggaggctttgggggcggaagtcggcaataaagttaccgtcatcacgccggagggcaatgttacgcccgccggagtcgtaccgaggttgaaacagtttaccgtggtcggtctggttaagacgggcgtttacgaagtggacaactcattggcaatgacgcatatccaagacgcgcgcgtgctgtaccgtttggataaggaagttgcggggctgcggctgaagctcgccgatccgcaaaacgctcccgccttgacggcaacactgattccggaggcgcaaagggacgcggtttgggtgcgcgattggacgtacagcaaccgcagctattttgaagcggtcgaactggaaaaacggatgatgttcatcatcctgacgctgattatcgctgtggcggcgttcaaccttgtctcttccctggtgatggcggttacggaaaagcaggcggacattgcgattttgcggactttgggtctttcccctgctggcgtgatgaagatttttatggtgcagggcgcgttttcaggctttttcggcacgctggcgggtgtggtctgcggcgtgcttttgggttggaacgtcggcagggtcgtggcgttttttgaaaacctgctcggtgtccacctcatcaattcgcaggtttattttatcgactacctgcccagcgatgtcgatatgggcgacgttgccctgattgcctgcatttctttgggactgtctttcgttgccacgctctacccgagccggcgcgcgtcaaaaacccaaccggcggaggctttgcgttatgagtga

SEQ ID NO: 5292 - DNA, 279 bp, Neisseria meningitidis
atgaatatccgaactgcttttgctttgtgcgccatcgccttatccgccgctgcggctgcctacgccaaagaaatcaaaatcgatgccaacaacacgccttattccgaagccgacgcgcaaaagctggcggcaacggcagtcggtatgggtgttaaggaacctatcagcctgaacggcggcagcggcagcattaccgtgtccggcagcagcgcgacgcagtgcgtgttcaaagtcggcaacggaggcgcattgcagattcaagggctaaactgcaagtaa

SEQ ID NO: 5293 - DNA, 621 bp, Neisseria meningitidis
atgatgagccacaaaaaacaagatgccttccaaggattgatcgacgcgctgaaggttttacccaacgtcgggccgaaatcggcacagcggatagcgtatcatttgctccaacacaagcgcaaagaggctgaaaaactggtggatgccttgcagacggcattgaagcaggtttaccattgcgcgatgtgcaacacgttttgcgaaggcggattgtgcgatatttgtgccgatgaaacacgcgacgggcggcggctgatggtggtgcatatgcctgccgacgtgtcgaatatggaagcggcaaactgccacgacgggctgtatttcgtcctgatggggcaaatcaatacggcattgggaatggacgtatccgccatcgcattggacaggctggcgcaacggctgggcggcggggaagtcgaagaaatcattattgcaaccgcttttaccgcagaaggcaatgcgacggcgtatgtcctgtccgagttttttaaaaacctgccttacaaagtcagcaggctgtcgcagggcattcccttgggcggcgaattggaatatgtcgatgcgggaacgctggcgcaggcggtgtacgaacgccgcctgattaaagaaggcggggcataa

SEQ ID NO: 5294 - DNA, 1539 bp, Neisseria meningitidis; identical to SEQ ID NO: 1817

SEQ ID NO: 5295 - DNA, 375 bp, Neisseria meningitidis
atgatagtccttcacggcatcccaaattgcgatacggtcaaaaaagccaaaaaccggcttgccggatacggcttggagtttgaatttcgggattttaaaaaacagaggccgtctgaagcggaaatctgctcgtggctggaacaagtgcctttggcaaccctgctcaacaaacgcgggacaagctggcgcaaactcgatgccgaaacacagcaaaaagtgctgtcctcgacggcggaggccgtcaaactgatgtccgaaatgccgagcctgatcaagcgtcccgtattggagtgcggcggcaaggtttacgccggcttcagcgaagaaacctacgacggcatcttcaaccggcaagccccgtgcagacagggataa

SEQ ID NO: 5296 - DNA, 1629 bp, Neisseria meningitidis
atgatttctaccaacggcatcaccatgcagttcggcgcaaagccgctgtttgaaaacgtatccgtcaaattcggcgaaggcaaccgttacggcttgatcggcgccaacggctcaggcaaatccaccttcatgaaaatcctcggcggcgatttggaacagacggccggcgaagtggcgattgaaaacggcgtgcgtttgggtaaattgcgccaagaccagtttgcctacgaagacatgcgcgtgctggacgtggtgatgatggggcataccgaaatgtgggcggcgatgaccgaacgtgatgcgatttacgccaatcccgaagccaccgaagacgactacatgaaagccgccgaactggaagccaagttcgccgaatacgacggctacaccgccgaagcgcgtgccgccgaactgttgagcggcgtgggcatttccgaagatttgcacaatgcgaaaatggcggaagtcgccccgggcttcaaactgcgcgtattgctggcgcaggcgctgttctccaagccggatgtattgctcttggacgaaccgaccaataacttggacattaataccatccgctggttggaaggcgtgttgaaccaatacgactccacgatgattatcatcagccacgaccgccactttttgaacgaagtctgcacgcatatggcggatttggactacaacaccatcaccatctatccgggcaactacgacgactacatgctcgcctccgcccaatcgcgcgaacgcgccctgaaagacaatgccaaagccaaagagaaactgcaagagctgcaagagttcgtcgcccgcttctctgccaacaaatccaaagcccgtcaggcaaccagccgtctgaaacaggccgacaaaatcaaatcggagatggtcgaagtcaaaccttccacccgtcaaaacccgtatatccgttttgaagccgatgaaaaagccaagctgcaccgtcaggctgtggaagttgaaaaactggcgaaacgctttgaaacccagttgtttaaaaacctgaacttcatccttgaagcgggacaacgcctcgccatcatcggcccgaacggcgcgggcaaatccaccctgctgaaactcttggccggcgcgtacaaccccgaatattcagacggcctgttgccggacgaaggcaccatcaaatgggcggaaaaagccagtgtcggctactatccgcaagaccatgaaaacgacttcgacgtcgatatggacctgagcgaatggatgcgccaatgggggcaggaaggcgacgacgaacaagtcatccgcggcactttggggcgtttgctcttcggcagtaacgatgtcgtgaaaaaagtgaaggttctctccggtggtgaaaaaggccgtatgctttacggcaaactgttgctgttgaaacccaatgtcttagtcatggacgaaccgaccaaccatatggacatggaaagcatcgaatccttgaacatggcactggaaaaatacaacggcacgctgatttttgtctcccacgaccgtcagttcgtttcctccttggcaacccaaatcatcgaactggacggcaaaggcggatatgaacactacttgggcgattacgaaagttacttggagaaaaaaggcgtagcataa

SEQ ID NO: 5297 - DNA, 1254 bp, Neisseria meningitidis
atgcagacttatctcgtcggcggtgccgtccgcgattatcttttgggcttgcccgtcaaagaccgcgattgggtggtcgtcggcgcagacgcacaaaccatgctggcgcaaggcttccagccggtcggcaaagattttcccgtgtttctccatcccgaaacacacgaagaatacgccctcgcccgcaccgagcgcaaaaccgccaaaggttacgtcggtttcagtttccacgccgacaaagacgttacgctggagcaggatttgatgcgccgcgacctgaccatcaacgcgatggcgcaagatgcggacggcaagattatcgaccctttcggcggacaacgggatttggcggcaggcattttgcgccacgtttccccagcctttgccgaagaccccgtccgcatcctgcgtactgcccgctttgccgcgcgttacaagtttgaaatcgccgaagaaaccataaagctgatgcggcagatggtggaaaacggcgaagcggacgcattggttgccgaacgcgtctggcaggagtttgcgaaaggtttgatggaaaaaaatccgcgcaaaatgattgaagtgttgcgcgaatgcggcgcgctcaaagtcttgctgcccgaagtcaatgccctcttcggcgtgccgcaacgcgccgactaccatcccgaaatcgacagcggcatccataccctgatgacgctgcaacgcgccgccgatatgggcttgagcctgcccgaacgctatgccgccctgctgcacgacttgggcaaagccaaaacaccgtccgacatcctgccgcgccaccacggacacgacctcgccggtgtcgaacccgtgcgcgaagtcaatcagcggctgcgtgcgccgaaacattgcgccgagcttgccgaattggtttgccgttggcacattattttccaccaagtcggacagcttaaaagccaaaccattctgaacgttttgaaaaaaaccgacgctttcagacgacccgaacgctttcagacggcattgaacgtctgcattgccgacacgcaaggccgtctgaaccgcgaacacacgccctacccgcaacgcgcgcactggctcgccttactcgaagccgccaatcaggcggattcgggcaaaatcgccgccgaatgccgcgcacagggaaaagcgcaccttatcgccgaacaaatcgaccgggcgcggctggcacaaatcgccccattgcaaaaagcgtttcgagcggcgcaagacaaaacagaaaaacattaa

SEQ ID NO: 5298 - DNA, 309 bp, Neisseria meningitidis
atgaccctgaaaaccgatttattgcctaaaatcaacaacgaagattatcaacgcctcatcctcaaacacagtgcggaatttagcggtggcgaaatccgcctgttgaacgaaatcctcgaaaaattcaatttcgacgttgttcaggcgcaggcattggcgcaagccgtcatgcagcaaatccgcttcgaccccaacgcctaccacatcgacagcgacgacgaagacaccaccggcatctgcccccactgcatcaacccgcctatgccgcccctgcgcgactatctcgtttggcgcgaaacccgcggataa

SEQ ID NO: 5299 - DNA, 1032 bp, Neisseria meningitidis
atgctgcaaaccgacaacctgaccgccgcgcaaccgcaacgcatcgttgccgcccaaaccgcctccgcacaggaagaactgctcgaacgcgccctccgccccaaaacgctggacgactacatcgggcaagacaaagccaaagaacagcttgccattttcatccaagccgccaaaaaacgcggcgaagcactcgaccacgttttgctcttcggcccgcccggactgggcaaaaccacactggcgcacatcatcgccaaagaattgggcgtaaatttgcgccaaaccagcggccccgtcctcgaacgcgcaggcgacctcgccgcccttttgaccaaccttgatccgcacgatgtattgttcatcgacgaaatccaccgcctcagccctgttgtcgaagaaatcctctatcccgcgctcgaagactaccggctcgacattatgataggcgaaggacccgccgcccgttccgtcaaaatcgacctgccgcccttcacgctcatcggcgcgaccacccgcgccggtatgctgaccaatccgttgcgcgaccgcttcggcatcgtctcccgccttgagttttacgaaaaccgagaccttaccaccatcgtcagccgttcggcacaactgttgcagctcgatatgtccgaagaaggcgcggaagaaatcgccaaacgcagccgcggtacgccgcgcatcgccaaccgcctgttgcgacgcgtgcgcgatttcgccgacgtgaaaaacaacggcacaatcgacggcggcatcgccgatgccgctttaagtatgctggacgtggacgcgcaggggctggacgtgatggacaggaaatttctcgaagccgttttgcacaaattcggcggcggcccggtcggtttggacaatgttgccgccgccatcggcgaatctacagacaccatcgaagacgttatcgaaccctaccttatccaacaaggcttcctgcaacgcaccccgcgcggcaggatggcgaccgaacgcgcctacctgcatttcgggctgcccgtcgaaaaataa

SEQ ID NO: 5300 - DNA, 729 bp, Neisseria meningitidis
atgactacttaccgtatcgcacccagcattttatcggcagactttgcccgcctcggagaagaggtggaaagcgtcattgcggcaggtgcagatctgatccattttgacgtgatggacaaccattatgtgccgaacctgaccttcggccctatggtttgcgcggcgttgaagccttatgcaagcgtgccgattgatgtgcatctgatggtcgaacccgttgacgacctgattcagtcgtttgccaaagcaggagcatcaatcatcacgttccatcccgaggcgagccgccatatcgaccgcagcttgagcctgattcgtgatatgggctgtcaggcggggctggtgttgaatccggcaacgcccgtatatctgttggaaaacgtattggacaggctggatatggttttgctgatgtcggtcaaccccggattcggcggacaaagcttcatcccgcacacccttgaaaaaatccgccgggtgcgggcgatgctggatcggtacgaagcacaaagcgggcggcacatcgccatcgaagtggacggcggcatcaaaaccgacaatattgccgccgttgcccgagctggtgcggatacctttgttgccggttctgcgattttcggcaaaccagactataaggcggtgattgatgcgatgagggcggaactggaaaaaagcggcaggctgaaccttgcgccaatgattgaaatagaaatgccgtctgaaaattag

SEQ ID NO: 5301 - DNA, 336 bp, Neisseria meningitidis
atggaagaaccggtgttggatttccaattcgtccaccgcaaaatccataccggacaaatagcggctttcgacataatcgcgcgcctcgttccgattaaaaacatccgaggaaatgatttcgacgacagaccggcggcggctgtgttcggaatgcataaccttcaaacgcgccctgtcgcccgccattttgaaggcggtgcggattttacgcagctcattgtgctgactttgggtcagcccgagtcggcgtatgtcgcagttcggttgaaaatcgttcggggggatataagccgtggcggcgtgggaaagctgacaggaaagcaaagccatacttaa

SEQ ID NO: 5302 - DNA, 864 bp, Neisseria meningitidis
atggaattgaacgaatttctcgataaagcctatgccgttttgcggcgtttggatgccgtgcttccgcccgaacccgggcatacggattggaacgcgcttgccttccgctggcagagtgcgggcaaaaaaggttttttggaacacttgcccgatccgcacacctttcccttggtaaggctggcgggagtcggcaggcaaaccgaattgctggtgcgtaataccgaacagttcattgtcggcagacccgcgaacaatgtattgatgagcggcgcgcgcggaacaggcaaatcctcgctggtcaaagccctgctacacgaatatgcggataagggattgcgcctgatcgaagtcgataaaagcgatttaatcggcctgccttacctgttgacgcttttgaaggaatgtccggaaaaatttatcgtattttgcgacgatttgtcgtttgaaagcggcgatgaaacctataaggcattgaaaaccgcgttagacggcggtctgtctcaacgttgcgccaacgttttggtttacgcgacttccaacagacggcacctgatgcccgaatattttgacgagaatgccggtacgacggggatgcggggggaaatccatcagaaagaagcggtggaagaaaaaatatccctgtccgaccgattcggattgtggctcagtttttatccgttcgatcaaaacgattatctggcggcggtgcaaaattggctggaagatttcggcgtgccgtatgatgaaaccgcacagatggcggcattgcagtgggcgcagacgcggggcagccgttcgggacgttccgcgtggcagtttgcctgcgactgggcgggcaggctgccgaaacaacgggcgttgtga

SEQ ID NO: 5303 - DNA, 705 bp, Neisseria meningitidis
atgctgtctgaaggcatttcagacggcatttttcgcggggagatgctacaatttgcaccatttttaccgacacagggaaacaggattatgtttacaggcattgttcaaggattgggaaaactgacggcaatccaccgcccgtcggaggcatttcacacttatgtcgtcgagcttccgcaagaggcggcggacaatctgcaacgcggcgcatcggtcgccaataacggctgctgcctgacgattaccgaaatcgaaggaaaccgcgtcagtttcgatttaatggcggaaactttggcaaaaaccaatttggggctgctgaaggaaggcgattgcgtcaacatcgaacgggcggcgcgtttcggagacgaaatcggcggacacgtcatgagcggacacattatggcaaccgtgcctattgtcgaaatcgaacgggacgggttcaaccgcacggtttggttttcgctcccgcatgaactcaaaccctatatcctgaccaaagggttcgtcggcttggacggttgcagcctgaccataggcaaagtcgaagacggccgtttcaatgtccatctgattcccgaaactttggaacggacgctgttcggcagcagaaaggtcggcgacaggatcaacatcgaaatcgatccgaatacgcaggcaatcgtcgataccgtcgaacggctgatggcgcaaagatatgcaaagtga

SEQ ID NO: 5304 - DNA, 578 bp, Neisseria meningitidis
atgaaaacttttgccctgatactggccggcggtcaggcgagccgtatgggaggcgaggacaaagggcttgctcttttgggggtaaggcactgatagaccatgtcatcgacagggtcaggccgcaggtcagccatatcgccatcagcaccaaccggaatttggaagaatatgctcgaagaagtccgcatatttttcccgatgcgcggcagtggcagcatttcggcccgctttcggcattgtgtaccgcagccaacgatttgcagttggcggctgctgactggcttttggttgtgccgtgcgatatgccgtatctgccggacgatttggtggcgaggtttgaaaccgtgtcgaaacgcacaccgttgtgcaatgcgtattatgtggaaacgccgataacgatgcactacaacattatgtatatccgcccgcagattctgcaaagcgcgattccctatctgttttcgggtatgaaaacattaagaagctggttgcagcagcaaagggcgcggccggtcagattcgagtttgacgggcattttgccgacttgaacacgcaaatcgatttgcaggagggataa

SEQ ID NO: 5305 - DNA, 1773 bp, Neisseria meningitidis; identical to SEQ ID NO: 2637

SEQ ID NO: 5306 - DNA, 657 bp, Neisseria meningitidis
atgactattaaaattattctgatagacgaccataccctcttccgcagcggcattaaagcccttttgtcgcgccaacacggttttgaagtcatcggcgaagccgcagacggcctctcgggtatcaaaatgatcagtcggctgcaacccgatgtcgtcctgcttgaccttgatatgcccggtatgaacggacgcgaagcactctcccaaatcatcagcatcaatccgcagcaggcagtgattatgctgaccgtttccgaagacagcgacgatttgaccgaatgtatgcgcatcggcgcgcgcggctacctgctgaaaaacatcaacgccgactttctgctcgaaagcatacgcaaagccgctgaaggcgataatgtattctcgcccgagatgaccgccaaactcgtcaaaagcctgatttccccccaacctgcccaagggacgcaggcactctcctcacttacccctcgtgaactggaaatcttgggctatctcgccgcaggacacagcaacaaaatcatcgcccgccacctcgatcttgccgaatccaccgtcaaagtccacgttcaaaacctgctccgcaaactcaacctcagcagccgggtgcaggccgccgtttacgccatccggcacaacgtcccccaacctgtgccggaatag

SEQ ID NO: 5307 - DNA, 966 bp, Neisseria meningitidis
atgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccctttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 5308 - DNA, 1035 bp, Neisseria meningitidis
atgagtacttcattgagttaccgcgatgcaggtgtcgatatcgacgcaggcgaccaactggtcgaaaacatcaaaccgtttgccaaacgcacgatgcgcccggaagtattgggggatttgggcggttttggcgcattggtcgaaatcggcaagaaatatcaaaatcccgtattggtcagcggtacggacggcgtgggtaccaagctcaagcttgcctttgattgggataaacatgatacggtcggcatcgaccttgttgcaatgagtgtcaacgatattttggttcaaggggctgagcccttgtttttcttggactattttgcctgcggtaaattggatgttccgcgcgcgaccgatgttattaaaggcattgcccaaggttgcgaagaatccggttgcgccctgattggcggggaaactgccgaaatgccgggtatgtatcccgtcggagaatacgatttggcgggttttgccgtcggcgtggtggaaaaagagaatgtcattaccggccgcagcatcggcgtaggcgatgtggtattgggtttggcttccaacggcgcacattcaaacggctattcccttatccgtaaaatcatcgaacgcgacaatcccgatctggatgccgagtttgataatggcaaaaccttgcgggaggctgttattgcgccgacccgtctgtatgtgaaaccgattcttgccgctttggaaaaatttaccattaaaggtatggcacacattaccggcggcggcattaccgaaaacgtgccgcgcgtgttgcctgaaaacacggttgcacaaatcgatgctaaatcgtgggaattgcccaagctcttccaatggcttcaaaaggcgggcaatgtggaaacccaagaaatgtaccgaacctttaactgcggcatcggcatggtcgttattgttgctgccgaagatgccgatgcggttcagggtctcttgggtgaacaaggtgaaacagtttaccgtttaggtttgatccgtgagcgtcagggagacgagcatcaaacccaggttgcctga

SEQ ID NO: 5309 - DNA, 678 bp, Neisseria meningitidis
atgcctgctgctttgattaaggattttctgctgactcagggtttgaagctgccgcttgacgaggttcgggcggcgtatctgacggcgcagacggtaatggatatggggacggcttcgatagaccgttcggttttgtggcgcagtgatgagggttggaaacttgccgattacctgtcgtgcgacaatgtccgcgaagatgcactgaaacggcttttcatggctttggattcggtgttttcgcgctcgacaggcgtgcggagtgcggcggtctatgccttgatgccatctgaaaaccaggctttccaactgatatgcctgtcccgacagggcgaggttttggaaaacctgtgggatttggatgaagcggcaggcaaggtttcgctggcttgccgttcggcgcaaagcggttggatgaatgttgcctcggatgtacgccgttggttggatttgggggagctttcgggagaacgcaatcatgcttcggcggcgcaaatttccattccggtctgcacggaaagtggcggtgtgttgggcgtggttcatgtggaatttgaatgcgcagagtgtgcgggtacggcagcacaggtggaatgggtggctcttgccttggctttgtccgaacctttgaaactgctgttgggtatgtctgccggaaaagatgggagtgaagatgtctga

SEQ ID NO: 5310 - DNA, 594 bp, Neisseria meningitidis
atgtctgaaatgttgaaccatgtggcatcctgccgcctgccgaccgaatggggcgtatttacgatgcacggctttgaagaggcaaacgggcaggaacacgtcgcgctgaccgtcggtaatttttcagacggcaatccggttctgacgcgcatccactccgaatgcctgacgggcgatgcgctgttctcgagaaaatgcgactgcggacctcaacttgaagcggccatgagggcggtacagacagaggggcgcggcatcatcgtctatctgcgtcaggaaggacgcggcatcgggctgattaacaaaatccgcgcctatcatctgcaagaccaaggtatggatacggttgaagccaatttggcactcgggctgcccgtcgatgcccgcgatttccgtttggcgcaatctatctacgaatatctgggcatccgctcggtcaaactgctgaccaacaaccccgaaaaaatccaaaccctgaaagatgcggggattaacgtggtcgaacgcatccccctgcacgtcggggaaaaccttgaaaacaaacgctacctccaaaccaaagcagacaagctgggacatctgatgtcggaataa

SEQ ID NO: 5311 - DNA, 1011 bp, Neisseria meningitidis
atgattttctccatcatcgtccctatttacaatgtggaaaatacctccgctgctgcgtggattccgtgcttgccgaaaattttgccgattatgaaatgattttggtcgatgacggttcgccggacggctgcgggaagatttgcgacgaatatgcaggcaaatatccgcatataaaagtgattcatcaagaaaacggcgggctgtcggatgcccgcaacgccggtatccgggcggcaaaaggcgattacctaatctttttggacagcgacgattattgggccgataccaaccgttcaaaaaacgcggggggggattctctttgatttacaacaacttgcagacaaaaaggttgatttgatcctgcatccctcgtccttcaattaccgcgacatccccaaaggggcggacttttcggataatgattttgtccgccattttgaaacgctggtggaggggcggtactatatcgccaacgcgtggacaaagattgtcaggcgggaaatcatcattaaaaacaatctgtttttcccaaaaggatacattcacgaggatttcccgtacagtttgcaattggcgcgttttatcaagacttttgccttttacgataaccctttttaccagtaccgcgttctcggcggctctatcagccacaacatcaaatacaaaaatttcagcgatgtgctgacgcatctcgactggggtgtggattttttagtcgaaaacaaaaattcccccatctacggcggtttgcaaaaatttgtcttcgacaatatcggctatctgaggtctatattggtaaggctttatttttccaaaaacattatcctcatctaccggaaatatttttcatttaaagaaaaatgcagaaagatattcggcgcgaaggcaatccgtccggtttttatcgggaagaccgcattcatcataggattgccgatattgcgcctgctcgtaccgcctatgctgtacccggcaatcaaggccgtttatcagaaatttttttcggaataa

SEQ ID NO: 5312 - DNA, 1092 bp, Neisseria meningitidis
atgtcccatatctcccccatccccgaaatcctagccgacatcaaagccggcaaaatggtcatcatcaccgatgccgaagaccgagaaaacgaaggcgacctgctgatggcggcgcaattcgtcacgcccgaagccatcaacttcatgatcaaacacgcgcgcggcttggtctgcctgccgatggacggcgaaatggtcgaaaaactcgggctgccgatgatgacccaaaaaaacggcgcgcaatacggcaccaactttaccgtctccatcgaagccgcacacggcattaccaccggcatttccgccgccgaccgcgccctgactattcaaaccgccgtttccccgaccgctaaacccgaagacatcgtccaacccggtcatatctttccgcttcgcgcccaaaaaggcggcgtactcgtccgcgccggacacaccgaagccggcgtcgacctggcgcaaatgaacgggctgattcctgcctccgttatttgcgaaatcatcaacgacgacggcacgatggcgcgtatgcccgaactgatgaaattcgccgaagaacacaagctcaaaatcggcacgattgccgacctcatcgaataccgcagccgtaccgaaagcctgcttgaagacatgggcaatgcgcctgtacaaaccccgtggggcgagttccaacaacacgtttacgtcgacaaactctccggcgaaacccacctcgccctcgtcaaaggcacgcccgccgccgacaccgaaaccctcgtccgcgtccacgaacccttcagtgtgatggacttcattcaagccaacccgcgccattcatggtcgctgcccaaagcccttgagcacatccaacaagccgaaagcggcgtcgtcatcctcttacaccgcaccgaagacggcgcatccctgctcgaccgaaccctacccaaaggcgcaaaccaagcctacaaatgggacagcaaaagctacggcatcggcgcacaaatcctcgccggcctcaacgtcaaaaaactgcgcgtcctcgggcagccctcatctttcaccggcctgaccggcttcggtttggaagtcgtcggctttgaagaagcggaaaaataa

SEQ ID NO: 5313 - DNA, 231 bp, Neisseria meningitidis
gtggaagatttcagtgtggtaatcggctacgatgaaatcaaagcgaagaatcacagcttgtcggcggggcagtatttcgaggtaaagattgattatgtggatatttccgccgacgaatttgcgcaaaaaatggcgggattttcagcggatttggataaacttttcgccgaatctgccgaattggaaaaagagattaaggatagattggcgatgttgaaattcaattcataa

SEQ ID NO: 5314 - DNA, 1311 bp, Neisseria meningitidis
atgaccgatttgtttgcccgagaacccgacgcgccgcttgccgaacgattgcgtccgcatacgcttgacgacgtggtggggcaggaacacctcatcggcgaaggtaaacctttgcgcgtggcggtagaaggcggcaagccgcattctatgttgctgtgggggccgccgggcgtgggcaagacgacgttggcgcggattttggcgcagagtttcaacgcccagtttttgcctgtttccgccgtattttccggcgtgaaggacatccgcgaggcaatcgataaagccgaaatcgctttgcagcagggacgcgcgacgattttgtttgtcgatgaagtccaccgcttcaacaaggcgcagcaggacgcgtttttgccgcatgtcgaaagcggtttgctaacctttattggtgcgacgacggaaaatccgtcgtttgaagtcaatcccgcgctgttgagccgcgctcaggtgtatgttttgcaacccttgtcttcagacgacctgaaaaagctgattgccaaggtattggctttgcctgaataccaagagtttacgattgaaacggatgcgcaaaaattactcgtgaataccgccgacggtgatgcgcgcagattgttgaatttgttggaacaacttttacgcgccgccgatacacgtcgtctgaaaaacttaaccgccgaatttctcgccgacagtctcggggcgcaaatccgccgtttcgacaaaggcggcgagagtttctacaaccaaatctccgccctgcacaaatccgtgcgcggttcgcatccgaacgccgcgctgtattggttctgccgtatgctcgacggcggcaccgacccgcgctacctcgcccgccgcatcgtgcgtatcgcttgggaagacatcgggcttgccgacccgcgcgccttccaaatcgccaacgatgccgccgccaccttcgaacgcttaggctcgcccgaaggcgaactggctttggcgcaagcggtattgtatcttgccgccgccgcgaaatccaacgcgggctacaaggcatacaaccaaatgcgccacttcgtcaaagaaaacgctagcgacgaagtgcccgtccacctgcgcaacgccccgaccaagctgatgaaggaattgggctacggacgcgaataccgctacgcccacgacgaaccgaacgcctactccgccggcgaaagctatatgcccgacggcttggacgaaccggacttctaccaacccgtcccgcgcgggttggaaatcaaaatcggcgaaaagctggaatggttgaaatcgctggacgaagaagtattaaaggcaaaatga

SEQ ID NO: 5315 - DNA, 966 bp, Neisseria meningitidis; identical to SEQ ID NO: 5307

SEQ ID NO: 5316 - DNA, 2940 bp, Neisseria meningitidis
atgagcggttttaattacgagaaaaaccagccgcaccaaatgcgggcggtttcggcggttttgggcgtgtttgacggggcaacgcccaaatatcggacggcagacgaaaatcccgaacttttgtttgctgcaaaacaatacgcaaacaatatcctgaaagtgcaaagccaaaacggtatagacggccgattccccgaccgttcggacgaccaaaatatccttgatatttccatggaaacgggcacgggcaaaacctatacctacacacaaaccatgttcgagctgcaccgttggctgggcgtgttcaaatttatcgtggtcgtgccgactttgtccattaaggcgggaacacagcagtttttgcaaagcaaggctttggcagagcattttgaacaggatttcggcggcgattatgaaggcgtacgcctgaaaacctatgtggtggaaagcgcgaaaaagaataagggcaaaaagtccaatgcgcccataacgattgagcaatttgtcaaagcggaaaacaaaaaggaaattcatgtgctgctgattaacgcgggcatggttaattcgtcgtccatgaacgatacgggcgacaaggcattgaaggatttgtttgacaatcccgttgatgcattggctgccgtgcgcccgtttatgattgtggacgaaccgcataaattcccgacccgagatagcgcgaaaacgtggggcaatatcaaacgcttaaaaccgcaatatattttgcgctacggtgcaacatttaacgatgaatattacaacttgctttaccgtttgacggcagtagacgcgtttaacgacgggctggtcaaaggcgtgcgcgtgtttcaggaagaaatgcagggcggcatggatgcggcggtaaaactggtgtcgtcggacggcaaagaagcgaaatttgaattaaacgaaaaggacaaaaagcagacgttcaaactggcaaaaggcgaagatttggcgcaaatccatccggctatttcggatttgaaaatcgacaaaatgaataaaaccgtggtggtgttaagcaacggcttggagttgaaaacgggtgccgtcatcaacccttattcctattcgcaaacggtgcaggatgcgatgatgcagcgggcggttgccgaacatttcaagctggaacgcgcgcttttggcagaacgcgcgccacagcccaaaatcaagccgctgacgctgttttttattgacgatatcgcgggctaccgcagcggcaacgagctttcaggcagcctgaaagataaatttgaaagctggattcgcgcggaagcggcacgccgtctgaaaacggaaagcgacccgttttaccgcgattacctgcaaaagacgttggacgatgtatccgcctgccacggcggctatttttccaaagacaatacagacagcgacgatagaatcgagcaggaaatcaatgaaatcctgcacgataaggaaaaactgctgtctttggacaacccgcgccgctttattttttccaaatggacgctgcgcgaaggctgggacaatcccaacgttttccagatttgcaaactgcgttccagcggcagcacgacttccaagctgcaagaagtcggacgcggcctgcgcctgccggtaaacgagctgatggcgcgggtgcgcgatgtaccgtacaaactgaattattttgtcgatagcagcgaaaaagactttgtgaagcagcttgtcggcgaaatcaacgacaattcttttcaggaagaaatctccaaaaagtttaccgaagagctgaaacaaaaaatattgcaaaaataccccgatatcaaaccgctggtattggtaaaccaactgtttttagatggcatcattgacgacaatgaaaactttgccgaagacggctatgacaaattaaaagccgcctatcccgaagccttccccaaaggtttggacaaaggcaaagtcagcaacgccaaagacgaaggcaaagacaccatcatcatgcgcgaaggcaaatatgaagaactcaaagccttgtgggagctgattcaccataaagccgttttgcagtataaaatcaaggatgaagccgaatttgccgatttatttaccgcctatttgcatgaaaacgctgccaaattcccacaggcaggcatacgcacggcggtaaacgaagcttatatcaacaacgggcttatgctttcccgccgcatagacagttttgaagatgaagattttatccgtttcaacacaatgacttaccgagagtttctggaaaaactggcacaaacggcaaaaatccgtatgcagactttgcatcaggcgttttactgcatccgcaacgaactgaacattggcgattttttgaatatgcaaaccatcgcccaaatcaaaaacggcttcaaccggtttttgcttcatcattccttccataaattcgaactggattaccggcttgtcggcagcaaaatccatccgaccaaatttaccaataaagacggcaaaccgcgcgcggtgaaaaaagcagatttgggcagatttgaagatacggagcaccggcctgccgccggctatctcttcggcgagattttctacgattcggatatagaacatgaaaatgtcgccaacaaccaaattgaaggcgtaatcgtatttaccaaaataccgagaaactccatcaaaatccctgttgccggcggcggcacgtattcgcccgattttgcctatatcgtgaaaaccaaaagcggcgagatcctgaactttgtgattgaagccaaagggactgacggggcggaagatttgcgaaaaagcgaagagcggaaaatcaaacatgccgaaaagctgtttgccgagatttccaaagaaatcaaggtggtgttcaaaacgcagtttgacggcgagaggatagccgaactgatcgggcaaaatatgcccgcaggcgggcattctgaaaacgggcgttaa

SEQ ID NO: 5317 - DNA, 2084 bp, Neisseria meningitidis
atgctgccaacccaacccaacccaacccaacccaacccaacccaacccaacccaacccaacccaacccaacccaacccaacccaacccaagccctgatctaagcgacacagccggggcgaacactgaggcaatctacacttcagacggcattaccgccaactctacccaactcgaacagctcaaaaaactgtttcccgcctgttttgacgcagacggaaatttccttatcgacagattacaagccgaaatcgcgccgcagaccgacatcggacgcgaattttacgaaatgaactggctgggcaaatcatatgctcgcctgcttcgcaacctgccgcccgaaaccctgataagtgaagacaagacgcacaacgccaagcccgaaaatgcaggcagccaaaacctgctgattcgtggcgacaatctagaagtgttgaaacacttaaaaaacgcctacacaaacagcgtgaagatgatttacatcgacccgccctaaaacaccggatcagacggctttgtctatcaggacgaccgcaaattcacacccgctgaacttgcccgcctagccaatattgatgaagacgaagccgcgcggattttagatttcaccgacaaaggctcaaactcgcacagcgcatggctcacctttatgtatccgcgcctgtatgtcgcccgcgaactgttaaaggacgacggtgtgatttttatctcgattgacgataacgaagcggcgcagttgaaattgttgtgtgatgaagtgtttggggaagggaattttgttgcacaattgccttggcgaaaaagaacagctaaatcagatgtgccttttggtatttcgcaggattatgaatggatatttgtattcgcaaaatcttgccaatttattgcagcaactaaaggcaaggaacgacgctattatgagactgatgatttccccgatcgtccttggcgtacccacgacttaacgaaacaaacaactgcggcggaaaggccaaatagttttttcacaatggttgatcccaagacaggaaaaaaatatccagcaaatccaaatgcaacttggcgtgtaaccaaagatacatttcaagattattataataaaggaaaaatcgttttccctgatgattatgatttcttaaatatcagcaatccagttatgcgttactttaaagatgacgacatgaaaaaagctggcgaggattttggcaaagtagctgtaagcagtagattacctgaaaatgttggtacattagccgatgcagtagccgaatatttggctatttttagtaggacgctacctgaaaatatcggaatgactaaagaaggcacaaaagaaatcacagatttatttggtagcaaaatatttaccttccccaagcctagtcaattgattaaatttttagtttcaataagttcaaagagtaatgacctaatcctagacttcttcgcaggcagcggcacaaccgcccacgccgtgatgcagcttaacgccgaaggacaaaacggtaaccgccgctatatctgtgtacagcttcccgaaaaaaccgctgaaaaatccgaagcccgtaaagcaggctacccgaccatcttcgacatcaccaaagcccgcatagaaaaagccgccgccaaaatccgcgtcgaacatcccgattacacgggcgattcgggcttcaaaatctttcaaacggcagacaatttcaggcagcatccggacaaggatttttcgcccgaacaaccggatttgccgcttaacgatgaattaagcgaagaacagctgcaaacgcttctgaccacctggacgctgtatgacggggcggcactgaccacgccggttgagcctgtgcggttaggggcttacacggcgtatctgtgcgaaaaacggctgtatctgatgaatgccggttttacttccgccgatttgttggcgtttatccgcaagctggacgacgatgcggatttcaatcccaaccgcgtgattgtattcggcagcaatatggcaagcgccatgcagcacgaacttgaccaggcggttcgcggttatgccaataaaaaagagattgagttgaatgtggttatcagggtttga

SEQ ID NO: 5318 - DNA, 558 bp, Neisseria meningitidis
atgaaacccaaattcaaaaccgttttaaccgcgctgcttttggcggtttccctgccgtctatggcggcaacccatgttttgatggaaaccgatatgggcaatatccgtttggttttggacgaatccaaagcccccaaaaccgttgctaatttcgtgcgctatgcccgaaaaggcttttacgacgacaccgtttttcaccgcgttatcgacggttttgttatccagggcggtggattgaccgaggacttggcacaaaaggcaagcgataaggccgttgccaacgaatccggcaacggcttgaaaaacaccgccggcaccatcgccatggcgcggacgacagcccccgattccgccaccagccaattctttatcaatctggcggacaacgcttcgctcgactacaaaaacggacaatacggctataccgttttcggcagggtcgaaagcggcatgaacaccgtttccaaaatcgcccgcgtcaaaaccgccacgcgcggcttttatcaaaacgtacccgtacagcccgtcaaaatccgtcgcgttgttgtcgggcagtaa

SEQ ID NO: 5319 - DNA, 918 bp, Neisseria meningitidis
atgaaaaaaaccaaagtccacctgatttcaggttttctgggaacaggcaaaaccaccgcgctcaaaagcctgatggcgcaaaaagacccgaacgaaaaatgggtcatcatcgtcaacgagttcggcgaaatcggcattgacggcgcggtattgagcgacaacggcatccctgtggcagaaatcgccggcggctgtttgtgttgcaccgccggcccgcaaatgggcgtaaccgtgcagaaaatgctgcgcgacgccaagcccgaccgcctgatgattgaagcaagcggactggcgcacgccgccagtgtcattgatgaactgaaaaccaaaccgctggacagccttttggaaatcggcgcagtctttaccgtcgtcgatccgcgccagttcatcaaccccgattacgcgcagcaggcattgtataaagaccaaatcggcatctgcgacgtattggttgccagcaaaaccgatttatgcacccccgaacagcttgccgaatttcacgacaaagccgcaaaactgttcccgcccaaggctaaagtggtcgaagttcaaaacgcacaactcgatatccaatggcttgacatccccgtcatcgaaaaatcacgctaccgcctcaaagccctgccggacaacacgatgggcttccagtcgcaaggtttcacattccccgccggacgcgatttcgacggtgaaaaattgaccaacttcttcaatgatttgcccaatatgaccgaaggactcgtccgtgccaaaggcgtgttccaagtattgggaacgtgggtgtggctcaactgggtggacgggcaatggggtgcgaaccaagtgtcttggcggcgcgactcgcgttttgaattgattgccaaatcgtttgatgcggatttaatcgaacaaaaactcaaagacgcattggaatag

SEQ ID NO: 5320 - DNA, 273 bp, Neisseria meningitidis
atgaaaatgcagaaagaattgtcggtctatttgaaacagatattgcaggcagcgcaatatatccggctatataccgacaaaatggattatgggcaattttctgccgacacaaagactgtgcaggcagtcgtttttaatttgttccttatcggtgaaaacgcaacccatatccttaaatcgtatccggaatttgccgaggaaaccaaatatttgaattggatagggatgagggggtattgcgcaataggattgcccatggctactttgaaatga

SEQ ID NO: 5321 - DNA, 294 bp, Neisseria meningitidis
atgaaaccgtctcttttgttgcaaagcagaaagaaagaaatattggcagttttcgggaaatatccattgatttgcaatccaagggtattcggttcggtttctcgcggagatgatacggaaaacagcgacattgatttgttggtggatgcaaaaacagggacaacattattggatttgggcgggctgcaagaggaattgcagaaactcttgggcataaaggtcgatttgctgacacccgatgacatctcggcccactttagagataaggtgttgactgaggctgtcgcattatga

SEQ ID NO: 5322 - DNA, 477 bp, Neisseria meningitidis
atgaaaacaaatttcaaacagaaaattatcgaacaggcacgcagcgaaggcttgcaggtaaccgctttgcgcgagcaggtattagatattgtcttgcagcaaagcggcgtgattaaagcctacaacgtcttgtcgcagatgcagcagcaaagcgagggcgtgcttgcaccgcctaccgcctaccgcgcccttgatttttgggcggagcagggcgttttgcacaaagtggcggcggtcaacggctatattttgtgcagccacgcgcagcacgagtgcgacgaccattgccacgaccacgaagaagccgaagcgcaccacagcgcgtttattttggtctgcaccgaatgtggcacggcggacgagcaaaccctgagccacgagtgggcggcactgcgcgcaggcgttgccgaaagcggctttgcgctgaaagaagaacacgttgttttaaccgggatttgtaaaaaatgtcagcagtaa

SEQ ID NO: 5323 - DNA, 456 bp, Neisseria meningitidis
atgaaaaaaccgaaaatcctttttgtctgcctcggcaacatctgccgttcgccgatggcggaatacattttgcgccgccgcgccgccgaagcgggcattccccttgaagcggacagcgcggggacatcgggctggcacgacggcgaagatatgcaccgcgagacggcaaagatattgaaaaaacacggtatcgatgcttcaggctttaccagccgcaaaatccgccaaagcgatgcggcggcgtttgactgcatcatcgcgatggacggcaagaatttgtccgaattggaaagaaccttcggcaggcggccggaaaaaatattcaagctgaccgacctgatacccgaaagcggttacgaccatgtccccgatccgtggtatacgggcgattttgaagaaaccttcaggcttgcggatgcgggctgtcgggcattgttggaaaagatttccaaataa

SEQ ID NO: 5324 - DNA, 1116 bp, Neisseria meningitidis
atgaagattgtaattgcaccggattcgtttaaggaaagcttgacagctcaacaggtagctgaagcaataaaaagaggcttccaacaatcgatagcagatgtggaatgtctcctctgtcctgtcggtgatgggggagaaggcactgtagatgctatccgacattctcttgacctagaagaaaaatgtctccaagtgacaggaccttttggacaaaaagaagtcatgcgctattttcaaaaagaacaactagccctattcgaagttgctgatttggttggtcttggaaaaatcccgctagagaaacgaaatccattacaaatccaaactcgtggtattggagaattgattcgccacctcattagtcaagaaattaaagaaatctatattggcgttggcggtacggccagtaatgatggaggtattgggattgctgctggtttaggttatcaattttatgatgaggatggaaatgccttacccgtttgcggtcaatccttactaaacctagcttctgtttcaacagaaaatcgctatgaaattcctgaagatgttcacattcgtattttagcagatgttgtgagtcccttatgtggacaccaaggtgcgacctatacgtttggcaagcaaaaagggttggattctactatgtttgaggccgtagatcaggcaatacaagatttttatgaaaaagtctcccctgcaacattaaaacttaaaggagcaggagctggtggaggcatcgctggtggtttgtgcgcctttgctcaggcaagtatcgtatctggaattgacacctgcctggacttgattgactttgataagaaagtgtcagatgttgacttggttatcgttggtgaaggaagactagatcgtcaaagtttagcagggaaagcgcctattggtgtagcaaaaagaacccctgtcggagttcctgttgtcgctatttgtggcagtctcgttgaagatttgccttccctgccatttgaaaatatccaagctgccttttctattttggagaaaagtgaacctttagaagatagtttgaaaaatgccagcctctatttggagcatacggcttctaatattggacacttattaaatatgcctaagatttag

SEQ ID NO: 5325 - DNA, 1098 bp, Neisseria meningitidis
atgaaccagacatttaccttgcccgatacgcgcccgtatccccaaaatccgattaaaaaccacctgctgctcaatgcctaccagttggcgcataattcttcccaggcttcgcgcaaactctcgtccggccaacttcaaaccgaaatcaggggaatgcttgagcaaaaccactatatcaacctttccctcgcgctgacgatgtcgcccgatgccggaacttatgccgcgctgctttccagtgtgaacgcggtactcgattgcgagaaagaaggcgaagtgcagtggttcgccctgccggtcgtgctggtgtccggctgcaaaaaagaacgtgcaatcgagatgaagctgccgacggaggcattgtttgcctgcctgcaaaactatccgcacctgcgcgcgttgacgcaagagacgcaatggctgccttatcttgtgcattcttccgatttgagcgcggtcgcgccggatgagtggtggcgtgccaaacaaaataccgaagcggcggcgcaacacttgcgccgtttcgccccgcgccctttgctgttgcccgaagggcagtccgtccacgtcgtttacgcgctgggtttcggcagcggcaaagttcagacggcattgggtcagaaccttcttcaggcaggtctgcccctgatgcaggtatggcaggaaaatcttgcatcggaaggcgttacgctgtttgccaatccgctttccccggattctccggtacgcgcgctttcagacggcagccacacgcgccaacgtatggcgatggatgtgtttgcggcaaacgcgatacgcgccgtccgtatgcagagtccgcgcgtcggcgtggtcgctgcggcaaaggcgggcggacagattttattcgggtttaatgcgaccgacggcgcgtttgaagtcgtgccgcaggtgttttcgtggcagctttcctttaccgacaacatcgccgtcatccagcaaaatttcctcgacctgatggcggagtgccgcgtggaacacgtttacctgttgcacaatcccttgggcgaacaggaaagcatcccgagctatgcggaagcattgaaacgggaagggcacaatccgtttttcagcgcatag

SEQ ID NO: 5326 - DNA, 1632 bp, Neisseria meningitidis
atgaattggttaaacttgcgggcaatagtgccttcagacaaacaaaatatgccgaacaagaagaaaaaagccgcctttgcgcgtgctgcaacggagaacggtgtgccggacgtgtccaacatcaaaaattcatatgatgatttgatgtacgaatccggcgcattctctcaaaccgccatcaataatttggaggcgcgcgcccgcctgatgggtttgcagcccgcgcccgccgccaatgccaaggtcttggagctgggctgttcgatgggcggaaacatcatcacgcaggcactttattacccggatgcggaatttgtcggtatcgacctgtccggcaggcaggttgcacagggcaacgccatcattgaaaaaatgggcttgaaaaatgtgcgtctggaagaaaaagatattttgaccatcgatgagtcattcgggaagtttgactatatcatcgtccacggcatttggtcgtgggtgcctgacgcagttaaagacaaaattttttcgatttgctggaacaacctgaccaaacacggcattgcctatatttcatacaatgtttaccccggctggaaacggcaggagcagttgcgcgaaattatgtactttgccggcagggatgtgcttgaagaacccttggaagcgcggacgcggaaaggcttggacgcgctcaaggcgctggcggaaattttggaaaacgacaagggcttggacggcggcggcaaacttccggcgattcaaaaaatattgaatcataatttttattacatcgcacacgaatatatggaggcgtttaacgacccgatttacgtcaacggcttcatcgaatgggctaaccgccacaggctcgcatatatcggggataccaatttgcacgtgtcttttgtttcttggatggcggagcatacgcgggagcggattctggcattggcaggggacgattatattgccaaagaattttacagtgatattttatccgaccgccaattccgccgttcgcttttatgccgtgaggaagtcggggatactgtcaggcgtgatgagtcggttgccgtcgaagtgatagaaagtttgaatttccgcccggcaagaggggaaacaatcaactttgatgaaaacgatatcctgctttcgggcatacgcgatgtgatgaaaaccggagaggcgtttaaaacggaagatgttgcggaaaatctcgcccgccgatttcccggtttggaatttgaccgcatgaaaatcaattcccagcttttattgcaaaccattctcgggcgtttttctgtttcatcagacaatgcgggcaaaccattttttgaagaccataaaacctatgtgccggcgcgctttacaaactatgccgccgcctttgtggaacacggcgcggaagcgtttgtccggcctgccaaccgttacaacgaaagcaccccctcattcggatacgggcatttgtacattatgcgccaattgtcgcggccgacgagcaaacaggcattgattgaaacggttgccgaaaacttgaacatcgtcagcaccacgcccgacggtttgacattccatccgcctgccgaagtgtatgtggaagaaatattggcagacttggcagacaggcattttctcgtttcggcggattga

SEQ ID NO: 5327 - DNA, 213 bp, Neisseria meningitidis
atggaaacccttatcctcgacatcggcggcatgagctgcggcggctgcgtcaaaagcgttacccggatattggaaggcgtaaaaggcgtggcaagcgtcgaagtcagccttgaaaacaaaagtgcgaccgtcggatacgaccccgcgcaaaccgatgcaggggcgttgattgaagccgttgaagacggcggctatgatgccgcgttgaaataa

SEQ ID NO: 5328 - DNA, 144 bp, Neisseria meningitidis
atgatgctcaaccagggtttttgcgaagcgttcattgttgttgtcctgatgggaattgccgccattatgcgcaagcgtccgtattttttcaaaccgccgcaccgtttccgcgtttgcccaagttcacgccccgacttacaataa

SEQ ID NO: 5329 - DNA, 1437 bp, Neisseria meningitidis
atgccgctgctgtctgtcgagttcgcactgttctttctcgccttcctgccgatttactggggcttggcgaaatacccgtccgtccaaaacctgctgcttttggctgccggtatgggctggctctaccatatcggccctgtatttgcggcaatcatcgtcctttattcctcctgcgtgtaccttttgggcgaactgctccgttccgatcgcgaaaatacgcgccgtttctggctggggtgcggcattgccgcctcgctgaccgtcttgggctttttcaaatatttcgactttttccgcccgatgattgcccaatatgccggaaaaggcggcgcaatcgacatcctgatgccgctggggctttcgtattacaccttccagtcgctcgcctatctggtttactgcttccgcgccccgcacgccgcgcgtttcagctggcacgagctgctgctgcacctgagttttttccccaccgttacctccggcccgattatccgcgccgccgcattcaaaagcgcagacggcgagcaggcaggcgcattggcgcaaatccgtacccgccgagcgcgttcgcccgtccgccccgcactcgccgtttccctgattctgctgggtattgccaaaaaatggtggctggcggggatgctggcggaaaactgggtgtcgcccgtatttgaaaatcccgcccaattcgacggctggggcgtattgggcggcgtgtacggctataccttccaactctttttagacttttccggatattccgatttggttatcggcatggcgatgctgctgggctttaggctgcccaaaaatttctccgcaccgcttcgtgctttaaacatccgcgcattttgggacaaatggcacatcagcctttccacctggatacgcgactacatctacatccccttgggcggcagcaaaaaaggctttttacggacacagctcaacctgatggcggcaatggtgctctcaggcatctggcacggctacggctggaacttcctcatttggggcgcgctgcacggcacggcactggtgctgctcaacacgggcgaccgctatttcggacgcgacgcgctatgccgtctgaaatacttcgcgccgctctcatggctcattaccttccatttcgtctgccttagctttgtcgtcttcaataccgcaaatcccgacgatgcaggcgcagttttcagtgccctctttgccaatgccaacggctggaatgcgccgcaacaggcaaacatgctgttgcttgcctcgtttgcatccgtgatgctgctctacccttacctgcaacgcgctttcgacggcgcggtcaaaggtttggaaaaaatcccgatgtggctgtggtttatccccgtttccgccgtcctgctgctgattatcgtcctcgccccctcggggatacccggctttatttatgccaatttttaa

SEQ ID NO: 5330 - DNA, 984 bp, Neisseria meningitidis; identical to SEQ ID NO: 2225

SEQ ID NO: 5331 - DNA, 1445 bp, Neisseria meningitidis
atgaaccccaaacacctcatcgcattttccgccctattcgccgccacgcaggcagaagccctacctgtcgcctccgtcagcctcgacaccgttaccgtttccccgtccgccccctacaccgatacaaacgggctgctgaccgactacggcaacgcctccgcctcgccttggatgaaaaaactccaatccgtcgcacaaggcagcggcgagaccttccgtatcctgcaaatcggcgactcgcataccgccggcgacttctttaccgacagcctgcgcaaacgcctgcaaaaaacttggggcgacggcggcataggctgggtttaccccgccaacgtcaaagggcagcgcatggcggccgtccggcacaacggtaactggcaaagcctcaccagcaggaacaacaccggagacttcccgctcggcggcatcctcgcccacaccggcagcggcggcagcatgaccctgaccgcatcggacggcatagcaagcaagcagcgcgtttccctgtttgccaaacccctgcttgccgaacaaaccctgaccgtcaacggcaacaccgtctccgccaacggcggcggctggcaggtactggatacgggcgcggcactgcccctgaccatacacaccgaaatgccgtgggacatcggcttcatcaacatcgaaaatcccgccggcggcattaccgtttccgcgatgggcatcaacggcgcacaattaacccagtggtcgaaatggcgtgccgaccgtatgaacgacctcgcccaaaccggcgccgatttggttatcctttcctacggcaccaacgaagctttcaacaacaacatcgacattgccgacaccgaacaaaaatggctggataccgtccgccaaatccgcgacagcctgcctgccgccggcatcctcatcatcggcgcacccgaatccctgaaaaacacgctcggcgtatgcggcacacgccccgtccgcctgaccgaagtccaacagatgcagcggcgcgtcgcccgtcaggggcagacgatgttctggtcttggcaaaacgccatgggcggcatatgcagcatgaaaaactggctcaaccaaggatgggccgccaaagacggcgtacacttctccgccaaaggctaccggcgcgcggcggaaatgctcgccgacagcctcgaagaactcgtccgctccgctgcaatcaggcaataatcggacaggaggcggacggtatttccgcaacagggggatgccgtctgaaacgcataccttcatattgcttcagacggcatagccaccccgcgcacggtttgccggacgcaaccggcattcgcctcaggcatcggaaggacgcaggcgaacctccggcatacggcgcaaaggcggcgtttgatatgccgtctgaaggcaaagatgataaactgccgccttccgttttcagacggcatattgttttcaaatga

SEQ ID NO: 5332 - DNA, 1554 bp, Neisseria meningitidis; identical to SEQ ID NO: 1663

SEQ ID NO: 5333 - DNA, 2028 bp, Neisseria meningitidis
ttgtccctgtctgaatttatagaacgccgaacgtcatttaatccgatggttattttgacgactttgttttttgtgtgtgttttggtggtattggttttaaccgtgccggatcaggtgcagatgtggctcgatcgggcaaaagaagtcatttttaccgagttcagctggttttatgttttaacgttttccatttttctgggtttcctgctgatactctcggtcagcagtttgggaaacatcaggctcggacgggatgaagatgtgccggaattcggcttcctgtcgtggctggcgatgctgtttgcggccgggatgggcgtgggtctgatgtttttcggcgtggcagagccgttgatgcattatttttcggacattacggccggcacgccggaacacaggcagcagcaggcattgctgcacacggtgttccattggggcgttcacgcttggtcggtgtacggtacgattgcattggctttggcttatttcggtttccgctacaagctgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaatgggctggattgccgaaaacagcttcagcgtgcaggttttgattatcgccgccgtcatgtccctcgccgtcgtttcggcaatatccggcgtggggaagggcgtgaaggtgttgagcgagttgaacctgggccttgcgtttttgctgctgttttttgttttggcggcgggacccactgtttacctgttgtcggcattcggcgacaacatagggaactacctcggaaatctggtgcgcctcagttttaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggaatgctcgaaaagatgacctcctctccggaaacgctgctttttaaattctttaattacctccccctgcccgaattgacgagcatcgtcagcctgctggtcatttctctgttttttgtaacttctgccgattccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggcttgagtgcggataagaaatattttgagacccgggttaaccctaccagtgtattttggacgggcggcaagtggaaagaacggctggtgcagataatgagccagacgcaggagcaggatattttaaaattcctcaaacagactgcatcgcccgctatgcacgagttgcaacgggagctttcggaagaatacggcttgagcgtccgggtcgataaaatgtttcatcgggacgagcccgcaatcgagttcgtcattcggaaagagacgatgcgcgattttatgtacgggattaagtctgtcgggcaggatgtatccgaccagttgattaacgacggcaagctgccgcatatccggcatcagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagagtaa

SEQ ID NO: 5334 - DNA, 2007 bp, Neisseria meningitidis
atggctgatatgaagaaaattacccctcaaaacctgcgccccctgctttcggaaagcttgggacataccgattttgtcaacgtcctcaacgcactgattaaatttttgcgccgtggcggcaaaaaatgtgcgggggaacgtttcgacctgattatcgacacattcaaacaagacagggaattactgtcccgcttcagccggtgtttttacatttggctcgcgcaaatacacatttatccggcactcatcaaactcggcatcttctcgcgccacagctttgcccgggaaatgggcatacgcatctacgaacgcttcagcccgtcatataaagattttgccaacttgggcgaagtcttcctttatcttttccattccgaaaacgacgacaaatggctgcaaacgctcaatatccgccaatggctggttttatacgaactcatccggagccacgccgagccgtccaaattgcagacggcgggcatccgccttgccgatgcgcgtttgcgcgccatcgaaatgctgtctgtctggacggcatccgaagccatcgaacccgacctcatccgcatcgccccgcgcctgctggaagccgattcttccttcgtcgccctccaacgcgaaaccgccaaactggtcgaacactaccgcaacggcaccacgccttacgacaccgcccacctcgaagtgatgttcgaccaatgtttcagccagattgactatttgcgccgcaaagggacgggcgccggctccggttcgtcggtcaaagtcgcccacctgctcgaacggctccggcagaccgtagaccgtctgaagctgctcaccgacatccaaaccggcgccggcaacagcaaccgcctgaccatcgcgctgatgaactccctcatctacgcggcggtcgaacaatacagcacccgccacctgcgccgcagcagcatccgtatgctcgcccgcagcattaccgaaaacaaaagccaccacggcgaacactacatcacccgcaaccgcaaagaatatttcaaaatgttctactcggcggcaggcggcggcatcatcatcgccctaatggcgctgctcaaaatccgcatcggctcactcggcctcagccccttcctcacttccttgtcggctgggttcaactacggcatcggctttatgatcatccatatgctgcactgcaccgtcgccaccaagcagcccgcgatgactgccgccagctttgccgaacaggtcgatctcaacgaaggcggcaaagcggtggacaacaaactcgccaagctcctcatcgacgtatgccgctcccaaagtgtcgccgtcttcggcaacgtttccatcgccatccttttggcgtgcgccatatcgttcggctatgcccatctgtaccggctgcccatactcgatgcccacaccgccgcctaccagttcaaatccatagacatcatcgcttacccgacgctgtggtatgccgccattgcaggtctgtggctgttctgctccggcatcatcgcaggttttttcgacaaccgcgccgactacctcaacctgcgccaacgcctgcccttcaaccccttgctgcgtaaaatcatgcgccccgggccccgccgcgtcctcgccgcctacatccacaaacactacggctcgctggtcggcaacttcatcttcgggatgctcttgggtatgaccggctatttcggacacctcctcgggctgccgctggacatccgccacgtcgccttttcctccgccaacctcggctatgccgccgtcagcggcaacgtcggtttgggcacgttcgtactcggcattttcagcgtcctcgccatcggcctggtcaacctctgcgtcagcttcagcctcgccctcttcgtcgccctgcgctcgcgcggcacgaaaatcggcagcatccgcaatctgattaaaagtttttggaatcagattaaaagcaatccctgcatacttttcctcccgcccgccaaagaacagggacatcctccttcggacaagccttga

SEQ ID NO: 5335 - DNA, 1110 bp, Neisseria meningitidis; identical to SEQ ID NO: 3797

SEQ ID NO: 5336 - DNA, 1428 bp, Neisseria meningitidis
atgatacacaccgaaccgagcgcgcagccgtcaactatggacacggctgcttttttaaagcacatcgaatccgcattccgccgcattttttcagacggtatcgacctgatgcgatacctgcccgaagacaaatggcttgccttgaagcaggcgggtttgctgttgcccttcctcgacaaaaaatacggcgggcgcaagggcagccagtttgaaatccaagaagtcctgcggattgcggggcattacggcgtgcccgttacgctgcgtaccggcatcgaaggcgcgctggtgttgcagccactgcaagagttcggcgatgaagcgcaagtcgcgcaaggtttggagatgattttcaaaggcgagggcggcggtttgggtgttaccgaacccgaaacctccggcgcggcgattgcacgcgaaatgcagtcctactacgaatatatcgacggacaaaccatttacgtcaacgccgcgaaatactggcagggcaactcgcaaagcgacttcctcctcgttgccgccaaagagcgcaaaaacggcaaactcgccaaagtcatcgacctgctgctcgtccccaaaacatacatccgctgcgaaaccctcgcatccgaaggcttgcgcgccgtccgttacgccgtcaaccgcatcgatgccgaaatgcctgcaaccgccgtgatgaaactctcccagagcgacgctgccggtttgcgcgcgttccaaaacatctttatccgcagccgcctgcaactgatcggcatgacgcacggcattatggaatacatccttgaaaatctggaacgatacgtccgcaacgacatcaaattcgtcgattacgaacgccgcgaaatccggcgccgccatcaggtttccgagattctttaccgctacgtctgccattccgtttcgcctgttgcccccgtcgcccatcagctgatggaggcgaacatcgtcaaaaccctcgccacggaatacacttacgccgccgcgcaaatgttgcaaaaactcttgggtgcgaagggttttgaacgcggacacaccgccggcaatatcgctatcgacatccgccccttcacgatttttgaaggcccgaacgatatgctttatgccgaaatttacgaccagtttgtccgcgccaccgccgaagaaaaagaagcaggcatgaagttggacaaaaaccaaaccctgctcgaccgcctgcaaaccgatgcccgctttgccgccgtcgcccgcgactacactttgcctgaagacatccgcagcttcctgcaggaacacaccctgaccgatgcctgcgccctgcaaaaagtctttatcggcaaaatcatcgcccgactctttgtcttcgtacaggcgaaacacgaagacaccgcagccttcctgctgaacgacatccgcaaagatatattggactgccgatattgcgggtag

SEQ ID NO: 5337 - DNA, 4140 bp, Neisseria meningitidis
atgacctaccccatccccaaaccccgtgaaaaatcccgttggcccaatctttcgcaaggctcgctgcccttggctttggcgcgttatctgccgcacaagcggctcaaggtcgtgctgacccaagatgcggaacaggcgttgcgccttcagacggcatggcggtttttccgtccgcacgacacggcggtgttcctgccggactgggaaacgctgccttacgagcgtttttcgccgcatcaggatttggtgtcggagcggctgtcggcgttgtggcagattaaaagcggcgcggcggatgtgttgttcgtgccggttgccacggcgatgcagaagctgccgcccgtgccgtttctggcagggcgcacgttttggctgaaaacggggcagactttggatataggccgtctgaaaagtgatttggtggatgcgggctacaaccatgtttcccacgttgtcgcggcgggcgaatttgccgtgcgcggcggtatagtcgatttgttcccgatgggcagcgaaatgccgtaccgcatcgatttgtttgacgatgaaatcgacagcatcaaaaccttcgataccgaaacgcaacgcaccatttcccccgtttccgaaatccgcctgctgccggcgcacgagttccccaccgacagcgaggcgcaaaaaatcttccgcagccgcttccgcgaggaagtcgatggtaatccgaacgatgcggctgtgtacaaagccgtcagcaacggtcatttcggcgcgggcgtggaatactacctgccgctgttttttgaaaacgagttggaaacgctgtttgactatatcggcgaagatgcgctgtttgtctctttagacgatgttcatgccgaggcaaaccgtttttggagcgatgtcaaatcgcgttacgcgatggcgcagggcgacgaaacctatccgcctttgcttccacagtatttgtatctctctgccgatgtgttcgcaggccgtctgaaaaactacggacaggtgctgcccgatgtttccggcaaggaatacaccctgcccgaccttgccgtcaaccgccaagcagatgagccgttgcaggcattgaaggattttcagacggcgtttgacggacggattttgctgtgcgccgaaagtttgggacggcgcgaaactatgctcggtttcttgcagcaaaacggtttgaaagccaaacccgtgtccgactggcagggctttttatcggcacacgagccgctgatgattacagtggcgccgttggcatacgggttcaaactgggcggactgcaatcgccgaaccaacagcaacctactccctcccccgtgggggagggttggggagagggcaaagcagttgccgctcaaactgaattttccgcagccgcaataaaccctctccctagccctctcccacaggagagggaacaaagtgcagccgccgtttcagacagtctgaaagcagccgccgtttcaaccgaaagcagcctgcccctcggtacaagtaatctgcacgggcaaatccgacagcaacctgccccttcccccgtgggggagggttggggagagggcaaagcagttgccgctcaaaccgaatttcccgcatccgcaacaaaccctctccctagccctctcccacaggagagggaacaaagtgcagccgccgtttcagacgacctgaaaaccaaaagcagcctgcatcccgtcgcaaataatctgcacgggcaaatccgacagcaacctactccctcccccgtgggggagggttggggagagggcaaagcagttgccgctcaaaccgaattttccgcagccgcaacaaaccctctccctagccctctcccacaggagagggaacaaagtgcagccgtcgtttcagacagtctgaaagcagccgccgtttcaaccgaaagcagcctgccccccggtaaaagtaatctgcacgggcaaatccaacagcaacctgccccctcccccgtgggggagggttggggagagggcaaagcagttgccgctcaaagtgccatcgccgtcatcaccgaatccgatctctaccaatacgtcgcccgttcgcgcatccacaaccgccgcaagaaacacgccgccgtttcagacgggctgttgcgcgaccttgccgaaatcaatatcggcgaccccgtcgtgcacgaagaacacggcatcgggcggtatatgggcttggtaacgatggacttgggcggcgaaaccaacgaaatgatgttgctcgaatacgcaggcgaagcgcagctttatgtgcctgtttcgcaactgcatttaatcagccgctactccggtcaggcgcatgaaaacattgccctgcacaagctcggcagtggcgcgtggaacaaggcgaagcgcaaagccgccgaaaaagcgcgcgacaccgccgccgaattgctcaacctctacgcccaacgcgccgcccaatcgggacacaagtttgaaatcaacgagttggactatcaggcgtttgccgacggcttcggctacgaggaaaccgaagaccaggccgccgccatcgccgccgtgattaaagatttgacgcaagcgaagccgatggatcgccttgtgtgcggcgatgtcggcttcggcaaaaccgaagtcgccctgcgcgccgcgtttgtggcggtgatgggcggcaaacaggtcgccgtacttgctccgaccacgcttttggtcgagcagcacgcgcaaaacttcgccgaccgtttcgccgatttccccgtgaaagtcgccagcctttcgcgtttcaacaacagcaaagccaccaaagccgcgctggaaggcatggcagacggcacggtcgatattgttatcggtacgcacaaactggtgcaggacgacatcaaattcaaaaacttaggtttagtgattatcgacgaagaacaccgcttcggcgtgcgtcagaaagagcagctcaaacgcctgcgcgccaatgttgatatccttaccatgaccgccacgccgattccgcgtactttaagtatggcgttggaaggactgcgcgacttctcgctgattaccaccgcgcccagccgccgcctcgccgtcaaaacctttgtcaaaccctttagcgaaggcagcgtgcgcgaagccgtgttgcgcgaactcaaacgcggaggacaggtatttttcctgcacaatgaagtagatacgattgaaaatatgcgcgagcggctggaaaccctgctgcccgaagcccgcatcggcgtggcgcacggacaactgcgcgagcgcgagctggaacaagtcatgcgcgactttttgcagcaacgatttaacgtgttgctctgttccaccatcatcgaaaccggtatcgatatccccaacgccaacaccatcatcatcaaccgcgccgacaaattcggactggcgcaactgcaccagcttcgcgggcgcgtcggccgcagccatcaccaagcctacgcctacctgctcacgcccgaatacatcactaaagacgcagaaaaacgcctcgatgccattgcggcggcagacgaactcggcgcaggttttaccctagccatgcaggatttggaaatccgtggtgcaggcgaaatccttggcgaaggacaatccggcgaaatgatacaggtcggcttcacgctctacaccgaaatgctcaaacaagccgttcgcgacctcaaaaaaggccgccagcccgacctcgacgcaccgttgggcatcaccaccgaaatcaaactgcacagccccgccctgctgcccgaagattactgccccgacatccacgaacggctcgtcctctacaaacgcctcgccgtctgcgaaaccgtgcaacaaatcaacaccatacacgaagaactcgtcgaccgcttcggcctgcccgaacaacccgtcaaaacccttatcgaaagccaccacttacggcttatggcaaaagaattgggtatcgatgccattgatgcggccggcgaagcggtaacggtaacctttggtaaaaacaataatgtcgatccaaccgaaatcatcctgctgattcagaacgacaaaaaataccgccttgccggcgccgataagctgcggtttaccgcagagatggaaaatatcgaggtcagaatcaacaccgtaaaaaacgttttaaaaaccttgcaaaacagatgcctgcccaaataa

SEQ ID NO: 5338 - DNA, 384 bp, Neisseria meningitidis
atgttccgtaccatgcttggcggaaaaatccaccgcgccaccgttaccgaagccgatttgaactatgtcggcagtattaccgtcgatcaagacctgttagacgcggcaggcatctaccccaacgaaaaagtcgccattgtcaacaacaacaacggcgaacgttttgaaacctataccattgcagggaaacgcggcagcggcgtgatttgtctgaacggtgctgcagccaggctggtacagaaaggcgatatcgtcatcatcatgtcttacgtccaactctccgaacccgaaatcgccgcacacgaacccaaagtcgtcttggtagacggaaacaacaaaatccgcgacatcatctcctacgagccgccgcacaccgtgctgtaa

SEQ ID NO: 5339 - DNA, 843 bp, Neisseria meningitidis
atggatattaaaatcaacgacatcaccctcggcaacaactcgcccttcgtcctattcggcggcatcaacgttttggaaagcttggattccaccctccaaacctgcgcgcattacgtcgaagttacccgaaaactcggtattccctatatctttaaagcctctttcgacaaggcaaaccgttcctccatccattcttatcgcggcgtaggcttggaagaaggcttaaagatttttgaaaaagtcaaagcagagttcggcatccccgtcattaccgacgtacacgaaccccatcagtgccaacccgtcgccgaagtgtgcgatgtcatccagcttcccgcctttcttgcgcggcagaccgatttagtggttgccatggcaaaaactggcaacgtcgtcaacatcaaaaaacctcagttcctcagcccctctcaaatgaaaaacattgtggaaaaattccacgaagccggcaacgggaaactgattttatgcgaacgcggcagcagcttcggctacgacaacctcgttgtcgatatgctcggtttcggcgtgatgaaacagacttgcggcaacctgccggttattttcgacgttacccattccctgcaaacccgcgatgccggttctgccgcatccggcggtcgtcgcgcacaggctttggatttggcacttgcaggcatggcaacccgccttgccggtctgttcctcgaatcgcaccccgatccgaaactggcaaaatgcgacggccccagcgcgctgccgctgcaccttttagaagattttttaatccgcatcaaagcattggacgatttaatcaaatcacaaccgattttaacaatcgagtaa

SEQ ID NO: 5340 - DNA, 441 bp, Neisseria meningitidis
atgatgcagactttccgaaaaatcagccggtatgtcgcaaccttgtggctcggtatgcagattatggcgggttatatcgccgcaccggtgctgttcaaaatgctgcccaaaatgcaggcgggcgaaattgccggcgtattgttcgacatcctctcttggagcgggcttgccgtttggggcgcggtactggctgccgcctttgccgccctaacccggcggcaaaccgccctgctgctttttttattgtccgcccttgccgccaaccgattcttgattacacccgttatcgaggcactgaaatacggacatgaaaattggctgttgtcgtttgtaggcggatccttcggaatgtggcacggcatttccagtattgtttttatggcaaccgccctactttcagcagttttaagttggcggctttccggcaaagatgccgtctga

SEQ ID NO: 5341 - DNA, 1287 bp, Neisseria meningitidis; identical to SEQ ID NO: 3095

SEQ ID NO: 5342 - DNA, 279 bp, Neisseria meningitidis
atgaagtgggtaactgtcgttttatccttcgcacttgtctgttgccaatacagcctctggttcggcaaaggcagcatcggacgcaacagcagtctgagagaacagattgccgttcaagaagaaaaaaaccagacactcgccctacgcaatcattcccttgccgccgaagtctatgatttggaaaacggtcaagaagccatttcggaaatcgcccgggtagaactgggttatatccaagacggtgaaaccttttaccgactcatcaggcataaccggtaa

SEQ ID NO: 5343 - DNA, 291 bp, Neisseria meningitidis
atggcgcgcattggtacgaataagggtttttttgaactcttggagggcgagactctgttggaaggcttggaacggacggggcatatggtggaatatcagtgccgaagcggatattgcggatcgtgccgagtgaagattttggagggaagcgttacttatcgggagccgcctttggcttttttggggcgggacgagatactgccgtgctgctgttgcgtcgagggggatgtcaggctggattgcggtttgtcgggggaggatgaggggctgtctgacagtttgttgaaataa

SEQ ID NO: 5344 - DNA, 1155 bp, Neisseria meningitidis
atgtcctgcgaacacttaactatgtcatacagcacctttcccaaaaccaaaaacgacgcgctgaatgagccgatgttttttggtcagccggttaatgttgcccgttatgaccagcagaaatacgaagtatttgaaaaactgattgaaaaacaattgtctttcttctggcggcctgaagaaatcgatgtctcgcgcgaccgtatcgactacgccaatctgcccgaacacgaaaaacatattttcatcagcaatctgaaataccaaacactgctcgattccatccaagggcgcagtccgaatgttgccttgctgcctttggtttcgattcccgagttggaaacgtggattgaaacgtggagcttcagcgaaaccatacactcgcgcagctatacccacatcatccgcaatattgtgaatgatccgtcggtcgtgtttgatgatattgtcgaaaacgaatacattaccgcccgcgccgaagacattgcctgctattacgatgacttaatcgaatacacccagtattacaacctgttgggcgaaggggtgcacaatgtcggcggcaaacccgttaccgtgtctttgcgcgggttgaagaaaaaactctatctctgcctgatgtgcgtcaacgtgttggaagccatccgtttctacgtttcattcgcctgctcgtttgcttttgccgagcgcgagttgatggaaggcaacgccaaaatcatcaaactgattgcccgcgacgaagccctgcacctgaccggcacgcagcatatgcttaatctgatgcgttctggtgttgatgattctgaaatggcagaaattgccgccgagttgcaggacgaatgtttccaactcttcaaaaaagcggcggaacaggaaaaagaatgggcggcatatttgtttaaagacggttcgatgattggtttgaacaaagaaatcttatcccaatacgtcgaatatattaccaatctgcgtatgcaggcggtggggttgccggccggatttgaaggcgcaaatcaaaacccgattccgtggattaatgcgtggctgtcgtccgacaacgtacaggtcgcgccgcaggaagtggaaatatcctcttatttgatcggtcagatagattctgaagtgaatacggatgatttgggcgattttgagttgtaa

SEQ ID NO: 5345 - DNA, 1188 bp, Neisseria meningitidis
atgaatgacttggcagctcagacaatacaagtagtaaataaatccgatgacttagtagcttcagcaatacagacagcaaataaatcaattgcagtatactgtcgttatattcgtcccaatgatgttggtactactggtagtcaccaatcaggattttatattcaaaaacatttttcagacgacctctttgatgtagtttgccaaaagggaacaaataaaactatttcaatcaaaattaattggcaagatggaagcgtcactaatagcaattttaaatattacggccaaggcacgagaaatgaggcgagaattacgggttttggcaagaattttgaatttttaagtgataaatatagtggttccttattggtattgtgcagagcttgttataaagatttattattccatgcttttgttttatcttcagatgaagatattgaaatatttatcgcagaaactaacattttaccaggaagtttatatttacctaaaaaacaagaagtagaggataacctaacaaaattattttcactatttcctaacttccccaaaactgaagaaatggcagttttggcaagggaaaatattgcattaaataaaactaacgttagtaatgtgttaaaacaatgggtttcaaaggaatatgaattattttccatttttgaaaaacgtgaatttgaaattattaaatcaaaaattactgatttggatagcttcattaattttgcacattcttttacaaatcgcagaaaagcaagagcaggaaaatctttagagttacatttatcaagaatatttgacgaattttccttaaaatttgagacgcaagcgaagacagaagggaaaaagaaaccagattttttatttcctggaagtgaagagtaccatgcgatggatgaatcagggaatttcatatttcaaactgaaaagctgacaatgctaggttcaaagactacttgtaaggatcgctggcgccaagttttaaatgaagcagatcgaattcctcataagcatttatttactctacaagaaggtatatctgatactcaaattcaggaaatgagtgatgagaatttaaccttagttgtccctaaagaatccgtaaaaacatttggaacttttgggaaaacccatgttttaactttagaaaattttattaaatatataaagtctcagcaggttagttaa

SEQ ID NO: 5346 - DNA, 1014 bp, Neisseria meningitidis
atgaaaaataaaatacaaaatcaattagataatatagttaccttaaataatgagaaatttacttttattgatttatttgcgggaataggtggttttcgcattgcaatggagaatgttggtgggcgatgtgtattttctagtgaatgggatgataaagcccgtcaaacctaccaagtaaattttaatgatattccttatggagatattacattaaaggaaaccaaagcagctattccaagtaagtttgatgtattaacagcaggattcccgtgtcagccattctctatagctggtgtttcaaagaaaaaaagcctaggacgagaaacaggcttcttagataaggcgcagggaactctattttttgatgttgctgaaattattggaaaacatcgacctaaaatttttcttttagagaatgtgaaaaaccttgtttcgcatgacaaaggaaatacatttaaagtaattaaagggactttagaagagcttgactatcagatattttatcaagttatgaatgcaaaatattatgttcctcaaaatagggagcgtatttttattgtaggttttgatagacaatattttaataaggaaataaatttcaattttccttccccaccagaatcacaaccaaaattaaagcaaattttggaagatgatgtagataattcttttactctttctgataacttatggctttaccttcaaaattacgctaaaaaacataaggcaaagggtaatggatttggttttggattagttgatttagatggaatatcacgaactctatctgcacgatattacaaagatggttccgaaatactcatccctcagaaaggaaaaaatcctaggaagctgacacctagggagtgctcgcgtttaatgggatttcctaaagattttgttattgatgcagtatccaagacagctgcatacaagcagtttggcaattcaattgctgtaccgttggttcaagctattgctaaacaaattataaatgagttaaaaaatgaatga

SEQ ID NO: 5347 - DNA, 2280 bp, Neisseria meningitidis
atgaatacaccgactgatttgaaagtaaccaaacgagacggaagattagaagccattgatttggataagattcaccgtgtcgtcacttgggcggcggacggattggaaaatgtttccgtgtcgcaggtcgagttgaaatcgcacatccagttctacaacggcatccgcaccgacgacatccacgaaaccatcatcaaagccgctgccgatttaatttcggaagataccccggactaccaataccttgccgcgcgtttggcgattttccatcttcgtaaaatagcctacggcgagtacgagccgccgcacctttacgaccacgttaaaaaacttaccgatgccggaaaatacgacaggcatatccttgaggattacagccgcgaagaatttgacgaactgaacgcctatatcgaccacgaacgcgatatgtccttttcctatgccgctgtcaaacagctcgaaggcaaatatctggtacagaaccgcgttacccgccaaatttacgaaacgccgcagtttttatatgttttggtggcgatgtgccttttcagcaaatacccgaaagaggcgcgcttgggttacgtcaaacggttttacgatgccgtttctacatttaaagtatcgctgccgactccgattatgagcggcgtgcgtacgcctacgcgccagttctcaagctgtgtgctgattgaatgcgacgatagtttggattccatcaatgccactaccagcgcgattgtgaaatacgtttcccagcgtgcgggcatcggcatcaatgccggacgtatccgcggtttggacagcgaaatccggggcggcgaagcgcggcataccggctgcattcccttctttaaaatgtttcaggcggcggtcaaatcctgttcgcaaggcggcgtgcgcggcggcgcggcaaccttgttctaccccttgtggcatatcgaagccgaaagcctgctggtgttgaaaaacaaccgcggtgtggaagacaaccgtatccgtcagcttgattacggcgtgcaaatcaaccgcctgctgtacacccgcctgattaagggcggcaacattacgctgttttcgcccaacgaggttccgggattgtacgaagcgttttttgccgaccaagacgaatttgagcggctctatacgaaatacgagcaagaccctgatatccgcaagcgcatcattccggctgccgacctgttttccacgctgatgcaggagcgtgccggaaccgggcgcatctacattcaaaacgtcgatcactgcaatacgcacagcccgttcgatccgcgcgtcgcgcctgttcatcagtccaacttgtgtatggaaatcgccctgccgaccaaaccgctggacaatatcaacgatccgaacggcgaaatcgccctgtgtacactgtctgcctttaacttgggcgcattaaacagcttggacgaattggaagggcttgccgacttgaccgttcgtgcgctcgatgcacttttagattatcagggatatccggtagaagccgcgcgtacctctactatgggccgccgttcgctcggcatcggcgtgattaactatgcttattatctggcgaaaaacggtgtccgctacagcgacggttccgcgctcggtctgacccaccgtacctttgaagccatacagtattacctgctcaaagcatcggcaaaccttgccaaagaatacggtgcgtgcacgctctttaaccaaaccgtttattcgcaaggcaaactgcccatcgacacttacaaaaaagatttggatgccgtctgcggcgagcctttgcattacgactgggaaagcctgcgtgccgaaatcgtcaaatacggcctgcgcaactctactctgaccgcgctcatgccgtctgaaaccagctctcaaatcgccaacgccaccaacggcatcgagccgccgcgcggattggtaacggtcaaagcatcgaaagacggcattttgaaacaagtcgtgccggagtttgaaaccctgaaaaatgcctatgaaaccctgtggcagcttcccggcaacgaaggctacctgaaacttgtcggcgtgatgcaaaaattcgtcgatcaatcgatttccgccaataccgcctacgacccgggcaaattcgaaggcggcaaagtttctatgaaacaaatgctcaaagacctgctgaccgcctacaaatacggcgtcaaaaccctgtactaccataacacccgcgacggtgcggacgatacgcagaccgatattcaggatgacggctgcgcgggcggggcttgtaagatttga

SEQ ID NO: 5348 - DNA, 189 bp, Neisseria meningitidis
ttgtcggcggcggcgcggcaaaatcatactttgcaaaatttaacaatttgcaggggcagaaaacaggaagctttcctttttcgtcggaaaatccttatttcaccgccttgtagccggagccggtcaaaaggcaaaaaatttacccgttttttatcggtaaagaattatcagataaaacaaatattatag

SEQ ID NO: 5349 - DNA, 327 bp, Neisseria meningitidis
atgtctgtcaaaaagatgcttgccatactgttgtctgcaatattgggactggtatcgacaactgccgctgccggtacgtcagaacccgcccaccgcgataccaaacatatccgcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgctccctgccttatgcggaacagaaaatccaatgccgggcggcttatgaggctttcgatgatttcgacggcggcagtttccgccgttaa

SEQ ID NO: 5350 - DNA, 768 bp, Neisseria meningitidis
atgtcttcaaataaagcttcattttttacacgtctgcgccgcttgtgccgtttggcggtctggctgttcaaaaccgggaaaaacctgcgcggtattgacggcggttgccccgagtcgcgcaatcgggcggtaatcgagttgggcaggggggttttggcggctttggatatcggattggaggtgggcagacccgcacccgaacatccgaacggtgtcttggttgccgccaaccacgtgtcctggctggatattttcgcgatgagcgcggtttatccgagcagctttatcgccaagcaggaaatcaaaagctggccggtattgggcaagatggggcagaacgcgggaacggtgttcatcaaccgcaattcgcggcgcgacatcgaaccgattaaccgcgccgtctgcgaaaccttgcaacgcggtcaaaacgtcagttttttccccgaagcgcggacttcctccggattggggcttttgccgttcaaagccgcgctgttccaatccgccatcgatgcgggggcaaaggttttggcggtcgcgctgcgttattatgacgaaacgggaaaaaggacggctcgtccctcatatgccgatgtcggtttgccgacctgcctgtggcgcatcgtgtctatgaaaaaattgacgataagagtcgatttcgtttgcgtggcggatgcggcggaaagcgaagaccgttatgctttaaaagataaaatcgaagaaagcatccgtgccgttgtcgccgacgatgcggatatcgctgtctga

SEQ ID NO: 5351 - DNA, 828 bp, Neisseria meningitidis
atgcctgaattgccggaagtggaaacgacgttgcgcggcatcgcgccgcatattgaagggaaaacggtggaagccgtggtattgcgccaattgaagctgcgctggcagattaatcccgatttgggggagattttgtccggccggcaggtgttgtcctgcggcaggagggcgaaatacctgcttatccgctttcaaacgggcgtgctgctgattcacttggggatgtcgggcagcttgcggatttttacgccgtcggacggacgtatcggcaggccggacagacacgatcacgtcgatattgtgttttcagacggcacggtcatgcgttaccgcgatccgagaaagttcggcgcgatactttggtatgagggaatcgaagaacatcatccgctgttggaaaaactggggccggagcctttgtcggaggcattttgtgcggattatctgtatgcaaggctgaaggcgcagaagcgcgcggtcaaacttgccctgatggacaatgcggtcgtggtcggtgtgggcaacatttatgccaacgagagcctgttcagagcgggcatttcgccccaccgtcctgccaaccgcctgaaaaagaaagagtgcgcgcttttggttgaaaccgtcaaagcggtgttgcagcgcgccattgaaacgggcggcagtaccttgagggattttgtggacagcgacggcaaaagcggctacttccaacaggaatatacagtgtacgggcggcacaatcagccgtgcccccggtgcggcggtttggttgtgaaagaaactttggggcagcgcggcacgttttattgcccgaactgtcagaaatag

SEQ ID NO: 5352 - DNA, 666 bp, Neisseria meningitidis
atggatgcatggtttgaagatacggcgatggggcggtatgttgcaaaattggaacaggatttcttcgggcggtatctggattcataccgtttttcgggaatgtgtgcggttcaggtgggcggtccgtggctgagcctgtctgaagatgttgtctgtgtgccgcgagatatgtcgatgtcggcggagaatatggctttggcggatgtttctgcggatatgctgctttttccgcatacgcttgaaggcggtgttccttcgcaaatcctgtcggaagcgcaccggatattgaaaccgtgcggacgcttgatgctgacgggtttcaatccgtattcgctctggggattcagccgttggtttgacggcgaacgcctgccggaaaaacggttttgtctgccgctgcccgagttgaaaagacggcttgcggatgtcggtttcgatattgaatttgggaaatttatggtgtatctgccgccggtttcgtcgctcgggcaaatacgcttttggcggtttatggaaaaggcgggcgaccgttggtggccgcagtgtgccgcagtgtacggtttggttttggtcaaaagggcagcgggcgtaacgcccctgcccgcgtgggacgggtatttgggcggcaaagcccttgcggcgggtgcggcaagggttgcggattag

SEQ ID NO: 5353 - DNA, 1977 bp, Neisseria meningitidis
atgtccaaactcaaaaccatcgctctgaccgcatcaggtctgtccgtttgtccgggtttcctatacgcccaaaacacctcatcacaccaaatcggtttggcgattatgcgcttaaactcttcaatactcgacctgcccccgacaaaacaatatttccaatccggcagcctgtggggcgagctgcgccaaggcttccggatgggcgaagtcaatcccgaactggtacgccgccacgaaagcaaattcatcgcaagccacagctatttcaacagggtcatcaaccggagtagaccctatatgtaccatatcgccaacgaagtcaaaaaacgcaatatgcccgccgaagccgccctgcttcccttcatcgaaagcgcgttcgtcaccaaagccaaatcacacgtcggcgcatcaggattatggcagtttatgcccgctaccggcaggcattacggcctggaaaaaacaccggtttacgacggcaggcacgacgtttacgccgccaccgatgccgcactcaactatctgcaatacctctatggactgttcggcgactggccgcttgcctttgccgcctacaactggggtgaaggcaacgtcggacgcgccatcaaccgcgcccgcgcccaagggctcgaaccgacctacgaaaacctgcgtatgcccaacgaaacgcgcaactatgtccccaagctgctcgccgtgcgcaacattattgccactccccaatctttcggcatgaatatcagcgacatagacaacaaaccctattttcaggcagtcgaaccggatcgtccgctcgacaacgaagccatcgcccggcttgccggcatcacgcaaagcgagctgctcgccctaaaccccgcattcaacgtccccgcgtttatccccaaaagcaaacgcaaactgctgcttcctgtcgcgtccgtacaaaccttccaaagcaactacctcaacgccgcacccgacagcctgttttcatgggaagtctatacgcctgccgccaaaaccagcctgtccgacatctcgacggcaaccggcatgagcattgccgacatcaaacgcctcaacaacctgaacggcaaccttgtcaacgcaggacgcagcatccttgtcgccaagaacggcaaaacccttcagacggcatcggaatccgtcgtttccatcgacatcgacaatacgcccgacacctaccgttccaatatgccggcaggcacggtgaacgtcggcattgcccgaatccgacccgccgccgcacagacagcggacattaccgtcgcacctttgccgcagaaaaccgtccgtacggaacccgatccccttgtccgtattgccgaacctgcccttgcgacagccgcagcgcaacctcaaaccgaaaaacagaccgccatgccgtctgaaacccaaaccgcaacactcgcgcagatcatcccccaaaacgacatgcaggcggcagacgaactcatgcagcttgttgcccgaaacaacctgcgccgacaggctgaagaaaccatctccgccgtcatcggcacgcctgacacagttgccgaacacaaaatttccgcatctccgcaacataccgctgccgccgacggcaaacgccgggtacgtttggaaacgcgcgtagccaaagctgccgacggcgaagccgaaatctccccgctccatgccagcatccaccgcgttgtagaaggcgacaccctgttcaacattgccaaacgctacaacgtcagtgtagccgacctgattgtcgccaacaacatcaaaggcaacaccatccaaaaaggacaggtactccgcctggcgcaggcagcccctgcccaaacccgtattgaaaaagtatcctacaccgcgcgcaaaggcgacaccttcaaaagtatcgccgcgcgcttcaatatccatatcgacgacatccgccggctcaatcccaacctgaacaccatcaatccgggacagagggtcaaactgattggaagctga

SEQ ID NO: 5354 - DNA, 693 bp, Neisseria meningitidis
atgaaacttatcaaatacctgcaatatcaaggcataggaagccgcaagcagtgccaatggctgattgccggcggttatgttttcatcaacggaacctgcatggacgacaccgatgcagacatcgattcctcatccgtcgaaacgttggatattgacggggaagcagtaaccgtcgttcccgaaccctatttctacatcatgctcaacaagcctgaagattacgaaacttcgcacaaacccaagcactaccgcagcgtattcagcctgttccccgacaatatgcggaacatcgatatgcaggcggtcggcaggctggatgcagatacgaccggcgtattgctgattaccaacgacggcaaactgaaccacagcctgacttcgccgagcagaaaaattcccaagctgtacgaagtaacgctcaaacaccccacaggagaaacgctctgcgaaaccttgaaaaacggcgtgctgctccacgacgaaaacgaaaccgtttgtgccgccgatgccgttttgaaaaacccgaccaccctgctgctgaccattaccgaaggaaaataccaccaagtcaaacgcatgatcgccgccgccggcaaccgcgtgcaacaccttcatcgccggcgattcgcacatctggaaacagaaaacctcaaacccggggaatggaaatttatcgaatgtccaaaattctga

SEQ ID NO: 5355 - DNA, 1367 bp, Neisseria meningitidis
atgtcttccccttcaaataccaatcgtcaaacctggtccagccgattaacctatatcctgaccgttgccggcgcgactgtcggtttcggcgcgacgtggcgtttcccgtatttggtcggtgaaaacggtggtgcgcgtatgtgtttttattctgtatcgcgatgctggttatcggcatcccgatgattttggtggaaaatgtcatcggacggcgcaaaggcgtgaacgcgctggatgcgttcggcggcccgatgaacggcaaacccattgccaaaatttggaaactggtcggctggatgggctgctcggcgcgttcggcatcatggcttattacatggtactcggcggctgggtaatcagctatatcgttaatattattggaggaaatttgaatatttccagccccgtcgacggtgtggttacaaaaggcttctttgccgaacacattgaaacagcccttgggaaattgcgttttatacgctgctttttgtcgccgtgaaccaatggattttggtcaaaggcgttatcggcggcattgaaaaagcggcaaaatagctgatgccgctgctgtttttgttcctaatcgcgatggtcgtccgcaacgttacccttccgggcgcaatggaaggggttgctttctatctgaaacctgatttcagcaagattaccgccgaactgttcgtcttcgttttggggcaggtattttttgccctgagcttgggtttcggcgtgatgattaccttgtccagctatttggataaaaacgaaaatctggttcagacggcagttatcacggcaattaccaataccatcatcgccatacttgcgggctttatgattttcccgtcgctcttcagcttcggcgttgcccccgattccggcccgactttggtgttccaaagcttgccgattgtgttctcacatatgtgggcgggatctgtgttcgccgtgattttcttctcgctgctcctgattgccgcgttgacaacttcgctgaccatttatgaagtgttgattacgaccattcaggaaaaaaccaaaatccgccgtaccgccgcgattacgattgtattggctgccatcttcattttcggcaacatcccgtccattctgagctatggtccgtggaaagacgttccgtgttcggcaaaaatattttcgatgccttcgactacatcagcggcaacatcttgtttatgctgaccgcgctcggttccgcgctgtttgccggttttgtgatgaaggacgaagcgaaggacgaattgctttataaaggcaaccatacgacggtcaatatttggtttgcttatgtgaaatatcttgtgccgctggtgattctgctgattttcgtcagcaacctgttctaa

SEQ ID NO: 5356 - DNA, 657 bp, Neisseria meningitidis
atgaacagacaaaaagtcatcgccatcgacggcccgggcgcatcgggcaaaggcacggttgccgcccgcgttgccgccgcattgggatacgattatctcgataccggcgcactctaccgcctgactgccctatatgcacaaaaacaaggcgtgggatggcacgatgaagaaaacgtttccgaactggcaaaaaaactgcccgccgtattttcaggcagccgcatcctgctcggcggcgaagacgtttcagacggcatccggacagaagccatcggcatgggcgcatccgcagtcgcacagttgcctaaagtccgcgccgccctgctgcaacgccaacgcgattttctgaccgaaaaaggactggttgccgacggacgggacaccggatcggtcgtcttcccccaagccgaacttaaaatcttcctgacggcagaatccaaaatccgtgccgaacgccgcgccaaacaaatcggcatcccctgcgaaggtttggcattcgagcgcatcctgtccgacatcgaagccagagacgaggcagaccgaaaccgcaaagttgcccccctgaaacaacagcccgatgccctgcttttggacacaagccgcctgactatagaagaaactgtaaaaaaagtgcttgattggtatcgtgaagtttaa

SEQ ID NO: 5357 - DNA, 1686 bp, Neisseria meningitidis
atgtctatggaaaattttgctcagctgttggaagaaagctttaccctgcaagaaatgaacccgggtgaggtgattaccgctgaagtagtggcaatcgaccaaaacttcgttaccgtaaacgcaggtctgaaatcagaatccctgattgatgtagctgaattcaaaaacgctcaaggcgaaattgaagttaaagtcggcgacttcgttaccgttaccatcgaatccgtcgaaaacggcttcggcgaaaccaaactgtcccgcgaaaaagccaaacgtgcagccgattggattgccctggaagaagccatggaaaacggcgacatcctgtccggcatcatcaacggaaaagtcaaaggcggcctgaccgttatgattagcagcatccgcgcattcctgccgggttctttggtcgacgtacgtcctgtaaaagacacttctcacttcgaaggcaaagagatcgaattcaaagtgatcaaactggacaaaaaacgcaacaacgtcgttgtttcccgccgcgccgttctggaagccactttgggtgaagaacgcaaagccctgctggaaaacctgcaagaaggctccgtcatcaaaggcatcgttaaaaacattaccgattacggtgcattcgttgacttgggcggcatcgacggtctgttgcacatcaccgatttggcatggcggcgcgtgaaacacccgagtgaagtcttggaagtcggtcaggaagttgaagccaaagtattgaaattcgaccaagaaaaacaacgcgtttccttgggtatgaaacaactgggcgaagatccttggagcggtctgacccgccgttatcctcaaggcacccgcctgttcggcaaagtatccaacctgaccgactacggcgcattcgtcgaaatcgaacaaggcatcgaaggtttggtacacgtctccgaaatggactggaccaacaaaaacgtacacccgagcaaagtcgtacaactgggcgacgaagtcgaagtcatgattttggaaatcgacgaaggccgccgccgtatctctttgggtatgaaacaatgccaagccaatccttgggaagaatttgccgccaaccacaacaaaggcgacaaaatctccggcgcggttaaatccattaccgatttcggcgtattcgtcggcctgcccggcggcatcgacggtttggttcacctgtccgacctgtcctggaccgaatccggcgaagaagccgtacgcaaatacaaaaaaggcgaagaagtcgaagccgtcgtattggcaatcgacgtggaaaaagaacgcatctccttgggtatcaaacaactggaaggcgatccgttcggcaacttcatcagcgtgaacgacaaaggttctttggttaaaggttccgtgaaatctgttgacgccaaaggtgctgttatcgccctgtctgacgaagtagaaggctacctgcctgcttccgaatttgcagccgaccgcgttgaagatttgaccaccaaactgaaagaaggcgacgaagttgaagccgtcatcgttaccgttgaccgcaaaaaccgcagcatcaaactttccgttaaagccaaagatgccaaagaaagccgcgaagcactgaactccgtcaatgccgccgccaatgcgaatgccggcaccaccagcttgggcgacctgctgaaagccaaactctccggcgaacaagaataa

SEQ ID NO: 5358 - DNA, 315 bp, Neisseria meningitidis
atgacaaagtctgagttaatggttcgtttggcagaagtgtttgccgccaaaaacggcacgcatcttctggcaaaagacgtagagtacagcgtaaaagtcttggttgacaccatgactagatcgcttgcccgaggtcaacgcatcgaaatccgcggtttcggcagcttcgatttgaaccatcgtcctgcccgcatcggtcgcaatcccaaaaccggcgagcgtgtggaagtacctgaaaaacatgtaccccacttcaagcccggtaaagaattgcgcgagcgggtcgacttggctttaaaagaaaatgccaattaa

SEQ ID NO: 5359 - DNA, 408 bp, Neisseria meningitidis
atgacttatactactgccaaagccgccgaaaaaataggcatctccgcccacaccctacgtttttacgacaaagaaggtttgttgcccaatatcggacgtgatgaatacggtaaccgctgttttaccgataacgatttgcaatggttgggcttattgcaatgcttgaaaaatacgggaatgagcttaaaagacatcaaacgctttgcggaatgtaccgtcattggcgacgataccattgaagaacgcctttccttgtttgaaaatcaaatagaaaatgtgaagtgtcaaattgccgaattaaaacgctatttagatttgcttgaatacaaattggcgttttaccaaaaagcgaaagcattaggctcggtaaaagctgtaaatttgccgcaaattcctgaaacggcttag

SEQ ID NO: 5360 - DNA, 1137 bp, Neisseria meningitidis
atggaaatgaaacaagccgattcaaccatcaaatctcgtgcggcggtggcattcgcccctaaccaacccttacaaattgtggaaatcgacgtagaaatgccgcgtaaaggcgaggtgttaatccgcaatacccacactggcgtgtgccatactgatgcgtttacgttatcaggaagcgatcctgaaggcgtattccctgtggtgcttggacacgaaggtgcgggtgtggtcgttgctgtgggcgaaggtgtgtcaagcgtaaaaccgggtgatcacgtgattccgctttacaccgccgaatgtggcgaatgtgagttttgttgttcaggtaaaaccaacttgtgcgtctcagtgcgtgatacacaaggtaaaggcttaatgccggacggcacgacgcgtttttcttatcaaggtcagccaatctatcactatatgggctgttcgactttcagtgaatactccgttgttgccgaagtttcactggcgaaaatcaaccctgaagccaaccatgaacaagtatgtttgctcggctgcggcgttaccacaggtattggtgcggtacataatacggcaaaagtgcaagaaggcgactctgttgccgtgtttggtttgggggcgattggtttggcggtggtgcaaggtgcgcgtcaagccaaagccggccgcattatcgccattgataccaatccatcaaaatttgagttggcaaaacagttcggtgcaacggattgtttgaacccgaacgattacgataaaccgatcaaagatgtgttgttagacattaataaatggggcattgaccatacctttgaatgtatcggcaatgtaaacgtaatgcgtcaggcattagaaagtgcacatcgtggttggggtcaatccattatcatcggcgtagcaggtgcaggacaagaaatttcaacgcgtccgttccagttggtaacaggtcgtgtttggaaaggttcagcatttggcggtgtgaaaggtcgctctgaactgccgaaaatggtggaagattcaatgaaaggcgacattgagttagaaccgtttgtaacccacacaatgacactcgatcaaatcaataaagcctttgacttaatgcacgaaggtaaatcgatccgcgccgttattcactactaa

SEQ ID NO: 5361 - DNA, 828 bp, Neisseria meningitidis
atgaaactgattgaacaacatcaaatttttggtggttcgcaacaagtttgggcgcatcatgcccaaacgctgcaatgcgaaatgaaatttgccgtctatttgccaaataatccagaaaatcgaccgcttggtgtgatttattggctttccggcttgacgtgtacggaacaaaatttcattaccaagtcaggctttcagcgttatgcggcagaacatcaagtaattgtggtggcccccgataccagccctcgcggagagcaagtgccgaacgatgatgcttacgatttaggacagagtgcaggcttttatttgaatgcgaccgaacagccttgggcggcgaattatcaaatgtatgattacattttgaacgagctgccccgtctgattgagaaacactttcctaccaacggcaaacgttccattatgggacattcaatgggcggacacggcgcattggtattggcgctgcggaatcaggaacgttatcaaagtgtttctgccttttcgcctattttatcgccaagcctcgtgccgtggggagaaaaagcctttactgcttatttagggaaagaccgtgaaaaatggcagcaatatgatgctaactcactcattcaacaaggctataaagtgcaaggtatgcgcatcgatcaaggcttggaagatgagtttttgccgacacaattgcgtaccgaagattttatcgaaacctgccgtgcggcaaaccagccggtcgatgtgcgtttccataaaggctacgatcacagctattacttcatcgccagttttattggcgagcatattgcttatcacgccgcgtttttgaagtaa

SEQ ID NO: 5362 - DNA, 1152 bp, Neisseria meningitidis
atgagtaatagagaccaactttttaaagccccgccgtttgaaaaccacagcccgctgacctggtatcaggctgcctcacaactgcccaacttcatccgcgacgacgcgcaggcagccgccatcgaacacctcgatcggctttggaccgaattgatgatgttcaaacgcaaaagaaaccgttttttaggcaggagtttgcgttccccgcaagtccccaaagggctttatttctatggcggggtcggacgcggcaaaagctttctgatggacgcttttttcggctgcctcccgtaccgccgcaaacgccgcgtccactttcatgcctttatggcagaaatccaccagcggctgaaaaccctgaaaagcgaaagcaacccgttgaaatccgttgccgccgagattgccaaagaaacccgcgtattgtgttttgacgaatttcatgtcagcgatattgcggatgcaatgattttaggccgtctgctggaaaacctgcttaacgagggcgttgttttggtggcgacttcaaactacgcgccttccgaactctacccgcaaggtcaaaaccggagcagttttcttcccacaatcgcgctcatcgagtccagcctgaccgtcttaaacgttgacggcggtgaagactaccgactgcgtaccctccgccccgccgagattttctttacgcctgccaatgaagaaaatgaggcaaaactggcaaaactgttcaaagaaatgacaggcattaccgatttgaaccccggcatcagcaccatccacggtcgggagattccccacaaagccgagtccggccgtgccatatggtttgatttccgcgcactgtgcttcggcccccgctcacagtccgactatctgtatttggccgaacattatgaaatggtttttatttcaggtttggaacaactctcaccgcaagaaaaggcggaggcgcggcggctgacttggctgattgacgtactctacgatttccgggtcaaactgtgtgccaccggcgcggtagatgtcaaccatatctatacggaaggcgattttgccgaagaatttacccgcaccgccagccggatggtcgaaatgcagtccgaagtttatttggaacagccgcacctgaccctatctcccaaggcttcaggcggataa

SEQ ID NO: 5363 - DNA, 426 bp, Neisseria meningitidis
atggcgattgaacgtaccatctccatcatcaaacccgatgccgtcggcaaaaatgttatcggcaaaatatacagccgctttgaggagaacggtctgaaaatcgttgccgccaaaatgaagcagcttactctcaaagaggcgcaagaattttatgcggttcataaagaccgccccttctacgccggattggttgaatttatgaccggcggtccggttatgattcaggtattagagggtgaaaacgccgtcctgaaaaaccgcgaactgatgggtgcaactaatccttccgaagccgccgaaggcacgatacgcgcggactttgccacttcggtcagcattaatgccgtacacggttccgacagcgtggaaaatgccgctttggaaattgcctactttttcagccaaaccgaaatctgcccccgttga

SEQ ID NO: 5364 - DNA, 1095 bp, Neisseria meningitidis
atgaaaaccaatctgctcaactacgaccttcaagggctgacccgacattttgccgatatgggcgaaaaacctttccgtgccaaacaggttatgcgttggatgcaccaatccggcgcgcaaaattttgacgaaatgaccgatttggcaaaatcgttgcgccataaactgaacgaacaggcaggcatcgaaattcccaagctgatgatgtctcaaaaatcttcagacggcactcgaaaatggcttttggatgtcggtacgggcaacggcgtggaaaccgtcttcatccccgaatcggatcgcggcacgctctgcatttcctcacaagtcggctgcgctttggaatgtacattttgttcgaccggccggcagggcttcaaccgcaatttgactgctgccgaaatcatcgggcaattgtggtgggcaaacaaagcgatgggcgttacaccgaaaaacgagcgcgtgatttccaacgtcgtcatgatgggcatgggcgagccgatggcgaacttcgacaatgtcgttaccgccttaagcatcatgctggacgaccacggctacggtttgagccgccgccgcgtaaccgtttccacttcgggtatggttccccaaatggacaggttgcgcgatgtcatgccggtggctttggcggtttccctccacgcttccaatgacgaagtccgcaaccaaatcgtaccgttgaacaaaaaatatcccttgaaagaattgatggccgcatgccaacgctatctggtcaaagcacccagggatttcatcactttcgaatacgtcatgttggacggaataaacgataaggcgcaacatgcgcgcgaactgatcgaactggtcacagatgttccctgcaagttcaatctgattccgttcaatcccttcccaaactccggatacgaacgctccagcaatgagaacatccgtgtgttccgcgatattttgcagcaggcaggatttgtcgttaccgtacgaaaaacgcgcggcgacgacatcgatgccgcctgcggacagttggcggggcaggttcaggataaaacgcgccgccaacaaaaatggcagcagattttaatcggacaacaggggtaa

SEQ ID NO: 5365 - DNA, 762 bp, Neisseria meningitidis; identical to SEQ ID NO: 3357

SEQ ID NO: 5366 - DNA, 1266 bp, Neisseria meningitidis
atgaacacactccaacgccgcaagacgcatcaagtccgcatcgatcatattaccgtcggttcagaagcacccgtcgttatccaatctatgaccaacaccgacactgccgatgcaaaagccaccgcattgcagattaaggaattgagcgatgccggatccgaaatggtgcgtattaccgtcaacagccccgaagccgcgtccaaagttgccgaaatccgccgccgcttggacgatatgggctatgccacaccgcttatcggcgatttccacttcaacggcgaacgcctgttggcggaatttccagaatgcggcaaagcattgtccaaataccgcatcaatcccggcaatgtcggcaaaggcgtaaaaggcgatgaaaaatttgcctttatgattcggactgctgctgaaaacgataaagccgtccgcatcggcgtaaactggggttctttggatcaaagcctcgccaaacgtatgatggatgccaacctcgcttcttccgcgccgaaaccgcccgaagaagtgacgaaggaagcactgattgtctccgctttggaatctgccgaaaaagccgttctattgggactgcccgaagacaaaatcatcctgtcgtgcaaagtcagcgcggttcaggatttgattcaggtttaccgcgaactgggcagccgttgcgcctatccgctgcatttgggtttgaccgaagccggtatgggcagcaaaggcattgtcgcatcaacggcggcattatccgtcttgcttcaagaaggaatcggcgacaccatccgcatttcactgactccggaacctggcagcccgcgtactcaggaggtcgtcgtcgggcaagagattttacagactatgggattgcgttcgtttacgccgatggttaccgcctgccccggctgcgggcgtaccaccagtaccgtatttcaagagctggcacaagatgttcaaaattacctgcgccaaaaaatgtctatatggcgtaccctttatcctggggttgaatccctgaacgttgccgtaatgggctgcgttgtcaatgggcccggagaaagcaaattggccgacatcggcatcagcctgcccggtacgggagaaacacccgttgcccctgtttatgtagatggtgaacgtaaagtaacgctgaaaggcgacaacattgcaacggaatttctggctattgttgaagagtatgtcaaaaccaattatggggagaacggactcaaacgccatcaagggaaggttatcccgatacactccctataa

SEQ ID NO: 5367 - DNA, 237 bp, Neisseria meningitidis
atgccgtctgaaagccaaatggggcagcagtttttgcaagggcgcgacactcgcatcctcctgaatctgccggtacggttattgagaaaagacaagggcaggaagcggtatcccgccttccttatttatacctgcaattcatctccgtatttgccgattgtattttcatattgcgcctccattccttatcggtttaaaaaaatgccttttccaatgggatgggttttatatcaatga

SEQ ID NO: 5368 - DNA, 531 bp, Neisseria meningitidis
ttgaaagagcgcatcgtattcttggtcggaccggtaaccgacgagtccgccaatctggtggttgcccaactgttgtttttggaaagtgagaatccggataaggatattttcttctatattaactcgccgggcggttcggtaacggccggtatgtcgatttacgacaccatgaatttcatcaagcccgatgtatcgactttgtgcttggggcaggcggcaagtatgggcgcgttcttattgtcggcaggcgagaaaggcaaacgttttgccctacccaacagccggattatgattcaccagcctttaatcagcggcggtctgggcggtcaggcatccgacattgaaattcacgcacgcgaacttttaaaaatcaaagaaaaactcaaccgcctgatggcgaaacattgcgaccgcgatttggcagatttggaacgcgacaccgaccgtgataatttcatgtctgccgaagaagccaaagaatatggtttgattgaccagattttggaaaaccgcgcttctttgcggctttaa

SEQ ID NO: 5369 - DNA, 1314 bp, Neisseria meningitidis
atgatgagcgtaactgttgaaactttagaaaatctggaacgcaaagtagtgttgtccctgccttggtccgaaatcaacgcagaaaccgataaaaaactgaaacaaacccaacgccgtgcaaaaatcgacggtttccgtccgggtaaagcacctttaaaaatgattgcccaaatgtacggtgcgagcgcacaaaacgacgtgatcaacgagctggtgcaacgccgcttctacgatgttgccgttgcccaagagttgaaagtggcaggcttcccccgttttgaaggcgttgaagaacaagacgataaagagtctttcaaagttgccgccatttttgaagtgttccccgaagtcgttatcggcgatttgtctgcacaagaagttgaaaaagtaaccgcttccgtcggtgatgccgaagtggaccaaaccgtagaaatcctgcgcaaacaacgcacccgcttcaaccatgtcgaacgcgaagcccgaaacggcgaccgcgtcatcattgactttgaaggcaaaatcgacggcgaaccttttgccggcggcgcatccaaaaactacgccttcgtattgggcgcaagtcaaatgctgcctgaatttgaagccggcgtagtcggcatgaaggctggcgaaagtaaagacgttaccgtcaatttccctgaagactaccacggtaaagacgttgccggtaaaactgccgtgtttaccattacgctgaacaacgtttccgaagcgactctgcctgaagtcgatgcagattttgcaaaagccttgggtattgcggatggcgacgttgccaaaatgcgcgaagaagtgcagaaaaacgtaagccgcgaagtggaacgccgcgtaaacgaacaaaccaaagaatccgtaatgaacgcgctgctcaaagccgtagagctgaaagcacctgttgctttggtcaatgaagaagccgcacgcttggcaaacgaaatgaaacaaaattttgttaaccaaggtatggctgatgctgccaacttggatctgcctttggatatgttcaaagaacaagccgaacgccgcgtatctttaggtctgattttagccaaactggttgacgaaaacaaactggaaccgactgaagagcaaatcaaagccgttgttgccaactttgcagaaagctacgaagatcctcaagaagtgattgactggtactacgcagatccttcccgcctgcaagccccgacttctttggcggtagaaagcaacgtcgttgatttcgttttgggcaaagccaaagtaaatgaaaaagctttgtcttttgacgaagtgatgggcgcgcaagcctga

SEQ ID NO: 5370 - DNA, 2439 bp, Neisseria meningitidis
atgacagaaaaatcccataaaaaaacagcaaaaggcagggcgggaagcccgtccccaacgtccgcacgcaacaagaaagccgacaacggcgcacggggcaataaagtttccgagcggctcaaggcggtcaaagagttgcagaaaaccgaaaccaaaaaggcgcgtcccgaacatgtcgtcaaccttatcggcgacgcactgtggctgatgggtttggcggcaaccctgtatttggcgatttccctgatcagtttcgatatgggcgatccgtcttggtcgcacagttcgccggttgtggaagatgtcgccaattggggcggactgttcggcgcgtatgttgccgatgtcggctattatcttttcggctggtcgttctggtggtggatagcggctgcctgcgtcgtgctgtataaaaatttccgcctgcacgcaaaacagacggaaaacgaggcatacaaccacaaaatcgctgccgccgcgctgtttgtcctgacggtcttcagccccgtcttggagtattttgtgctgggcggaaaatatgccgactccctgcctgtcggagcaggcggtatggtcggcatacgcgtcggcgcagtgtttgcgtggctgctggggaaatcgggcagcctgctgattatcttggttgttctgctgttgtcgttgtccctgctggtgcagatttcatggctggaatttttgaacggtgcgggcagggcggttcaaaaccgcctgagtgccttatccggcaaggtcatggctttaggaaaacgccggccgaataccaaaacagacggtgtcgatacccaaaatacacggcgcatggtaaaagaagccaagaatattacggccaaacccgttgccttgcccgaaggcagcagcagcaaccgcaaatccgtcgcggtttccgtcgcgccgccgcccaaaattcaggtttctctgtttgaagatgacgaacctcggcaggcgggcgaataccacaagcctacattgaacctattgcggattcctgacagcgaacccgtcagcatcaatcccgccgaattggagcgcactgccgaactgatcgaatccaaactggcagaattcggcatcggcgtacaagtcgtatccgccacatccggccccgtcatcacgcgctacgaaatcgaacccgcgcaaggtgttaaaggcagccaaattgttgccttgtcgaaagatttggcacgctctatgtcgctgcagtccgtgcgtatcgtcgaaaccatcgcaggtaaaaacacgatgggcatcgagttgcccaacgacaaacgccaagacgtgatgttgagtgaaatcttgtcctcgcccgtgtttgccgaagccaaatccaagctgaccgtcgcgctgggcaaagacattgccggtacccccgttgtcggcgacttggcgaaaatgccgcaccttttggtcgccggtatgactggttcgggcaagtccgtcggcgtgaacggcatgattatgtctatgcttttcaaagctacgcccgacgaagtccgcttcattatgatagacccgaaaatgctcgagttgagcatttacgacggtattccgcacctgctctgtcccgtcgtgaccgatatgcgcgaagcagggcaggcgttgaactggtgcgtcgccgaaatggaaaaacgctaccgcctgctttcccatgccggtgtgcgtaatttggagggcttcaaccaaaaagtcgaagccgcaaaagcggcaggcaagccgctgctcaatccgttcagcctgaaccccgacgagcccgagccgctggaaaaactgccgttgattgtggtcgttatcgacgaacttgccgacctgatgatgaccgaacgcaaagccgtcgagcagcaaatcgcccgtctcgcccaaaaagcgcgcgccgccggtatccatatgattgtcgccacccaacgtcccagtgtcgatgtcgttaccggcctgattaaagccaacatcccgacgcgtatggcgtttaccgtgcaaagcaaaatcgacagccgtaccatcctcgaccaaatgggcgcggacgaactgctcaaatatggcgattcgctgttcctccagcccggcagtgccgaaccgactcgcctgcaaggcgcgtttgtttcagacgacgaagtacatcaagtcgtcaactatgtcaaatcgcaagccccagccgactatattgaaggtctgctcagcggcgaggccgcgctggaaactgccaatatcgttaatccgaatgcagacagcgacgaattgttcgatcaggcagtcgcctatgttttggaaagcaaaaaaacctccatttcgtctttgcagcggcagctgcgcatcggctataaccgcgcggcaaacctgatggaggcactggaaaatgcgggtgtcgtttcttccaccgacctcaacggcagccgtaaaattttggcgcacaaggaccatttgtag

SEQ ID NO: 5371 - DNA, 1212 bp, Neisseria meningitidis
atgaaccaactgaaacttgccgtttccggtgcacagattttatttgtggcattcggcgcaatggtgctggttcccctgctgaccggtctgaatccggctcttgcgcttttgggcgcaggcttgggaacgctgctgttccaaatcacaaccaaacgcaaagtgccgatttttcttggttcttcgtttgcctttatcgcaccgattatctactccgtcggcgaatgggggctgccttccaccatgttcggactgtttgccgccggctttatgtattttgtgtttgccgcgctgatccgttggcgcggactggcagcggtacacaaactgctgcctccggtcgtcatcggccccgtcatcatggtcatcggtctgtctgttgccgtggcggcaagcagcatggcaatgggtcaggcggacggcaaacaggtcatcgactataccgattcgctgattctttccggctttacctttgccgttaccgccatcgtatcggttttcggcagcaggatgatgaagctgattcccatcttgatcggtgtcgcttcgggttatgttttggcactgctgatgggactggtggacacggcaagcattgcacacgcgccctggttcgccgttccccattttgaaacgcctcagatcaactggcaggctgcactgtttatgctgcccgttgccgtcgcccccgccatcgaacacatcggcggcatcatggcaatcggcaatgtgacggggaaagactatacgaaagacccgggcttggacaaaacccttgcaggcgacggtttgggcgtatgcgttgcgggtctgatcggcggcccgccggttacgacctacggcgaagtaacgggtgcggtgatgattaccaaaaacagcaaccccgtcatcatgacttgggcggcggtttttgccgtctgcatggcgtttttcggcaaattcaatgcgtttttggcttccattccgatgccagtaatgggcggcattatgctgctgctgttcggcacgattgcttctttgggcgtgaaaacgctgattgatgccaaagtcgatttgatgctgccgaaaaacctggtcatcgtcagctcggtactgaccacgggcatcggcggcatgacgctcaaattgggcagcttcagctttgccggcgtgggcttgtgcgccgtacttgccattatgttgaacagcctgctgcccgatccgaaagaatcctga

SEQ ID NO: 5372 - DNA, 441 bp, Neisseria meningitidis
ttgaatcaaagagcgcacagttccgccgtaataagaagaagatgtgcaatacactgtttccaagccgcattgtccctgtacgccgtattttttgatgcactggttgagtgcgacctgatgaacgctcgtaaaacgcggagaagtaatcacgacggcgttgtcgacacgcagcgcgcccaaggctttcgggtatgccagcgcgacacaggtattgttcagcgacacgaccgaccggcatccggtcggctcgtcttcagcaatgcccgcaagcgtgtcctgacctttgcagaaggcttccaactcggaaaacgcttcgcttttcgtcgaatcttcttttgtggttttaacctgcaaaacatcgtccgcattctgcggattctgccaaacggcgagatagccgtaagtatcggcagcccgtgccgccgcagtcatcaggcatag

SEQ ID NO: 5373 - DNA, 405 bp, Neisseria meningitidis
atggcaaaccgatttcagcagcgcaaatccgcataccgccgccttagcggcaagccgttgttttcagacggcattgcggccaacctttgcggcgggcgaaaaaccttgtcctataatttatcccgtttcaaaatcagcatacggtcggaaatgcaaaaaatatctttcaatttgttgaagcctgcaaactccccgaaaatagggaaacgccgccccggtttgaacggcgcgccgcatattccgatgccctccccccgataccttccggcaagcccagaaatgcccggcaacaacatccatccggcaaaaatccgaaacaacacacccggcggcaggcagagtcaaaccgccccgcaaagcatccgccatcagaaaaacaaaccgcctccgagggcttcatcctaa

SEQ ID NO: 5374 - DNA, 747 bp, Neisseria meningitidis
atggaaaccccgaccaacaccccgcaacgctccctgcgtcaaaacagtatctacctgctgcccaattcctttactatcgccgcgctgttttccgcgttttacgcaatcacccaatccatgcacggacgttatgaaaccgccgccatcgcggtattcatctctatgttgctggacggtatggacgggcgcgtggcgcggctgaccaacagccaaagcgcgttcggggagcagctcgacagccttgccgatatggtcagcttcggcgttgctcccgctctgattgcctacaaatggcagctttggcagttcggcaaaatcggttattccgtcgccttcatctactgcgcctgcgccgccctgcgcctcgccctgttcaacacactcatcggcaaggtggacaaacgctggtttatcggcgtgcccagtccgactgccgccgcgctgattgtcgggctgatttgggtcaaccacagcgtcgaaaaattccccgccgtccactggtgggcattgggcatcacactgtttgccggcctgtcgatgattgtccaaatccctttttggagttttaaagaaatcaacatccgcagacaagtcccctttgtcggaatgctgcttgccgtcttactgctgcttctggtcacttgggaaccgtcgctcgtcctcttcctgttctttctcggatacagcctgtccggctacattatggcggcacgccgattttggaaaaagtacagaaaggcggattaa

SEQ ID NO: 5375 - DNA, 774 bp, Neisseria meningitidis
atgtggcattgggacattatcttaatcctgcttgccgtaggcagtgcggcaggttttattgccggcctgttcggcgtaggcggcggcacgctgattgtccctgtcgttttatgggtgcttgatttgcagggtttggcacaacatccttacgcgcaacacctcgccgtcggcacatccttcgccgtcatggtcttcaccgccttttccagtatgctggggcagcacaaaaaacaggcggtcgactggaaaaccgtatttacgatgatgccgggtatgatattcggcgtattcacgggcgcactctccgcaaaatatatccccgcgttcgggcttcaaattttcttcatcctgtttttaaccgccgtcgcattcaaaacactgcataccgaccctcagacggcatcccgcccgctgcccggactgcccggactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatcttcggcattatgttgcttttga

SEQ ID NO: 5376 - DNA, 453 bp, Neisseria meningitidis
atgcaaattattctgttagaaaaaatcggcggtctgggcaacttgggcgacatcgtaaccgttaaaaacggctacgcccgcaactttctaattcccgcaggtaaggcaaaacgtgcgaccgaagcgaatatgaaagagtttgaagcacgccgcgcagaactggaagccaaacaggctgaaattttggcagatgcccgagtccgtcaggaaaaattggacggtcaaaccgttaccgttgctcaaaaagctggtgtggacggtcgcctgttcggttccgttaccaatgccgacattgctgctgcaatcgttgctgccggcatcgaagccgtgaaagcaaatgtacgtctgccgaacggtcctctgaaagccgttggcgagtacgaagtggaagtggctttgcacactgatgccgttgctaaaattaccgttgccgtcgttgccgcaaccgagtaa

SEQ ID NO: 5377 - DNA, 231 bp, Neisseria meningitidis
atggctcgtcaatcattcaaacgtagaaaattctgccgtttcacggctgaaaaaatccaagaagtcgattacaaacaagttgatttgctgaaagacttcatctccgaaaacggtaaaatcattcctgcacgcatcacaggaacgaaggcattctaccaacgccaattggctgttgccgtaaaacgcgcacgcttcctggctctgctgccttacaccgaccaacacaaataa

SEQ ID NO: 5378 - DNA, 303 bp, Neisseria meningitidis
ttgggattcaataatcttgtttcgcttgccgcgttaattgaaaaggttttccctattcgatatacgcctgccggaatccctgttttagatattattttaaagcacgaatcgtggcaggaggaaaacgggcagcaatgccttgtccaattggaaattccggcacggattttaggcaggcaggcggaagagtggcagtatcggcaaggtgtatatgttcacgtcgaaggttttttagctcaaaaaagcagacgttcccttatgccgatgctcaggatacaaaatattcaagaatataaaggttaa

SEQ ID NO: 5379 - DNA, 369 bp, Neisseria meningitidis
atgcgtcattacgagatcgtgtttatcgttcatcccgatcaaagcgagcaagtacccgctatggttgaacgttacaaaaccatgattgccgaagcaaacggtaagattcaccgtctggaagactggggtcgccgccagctggcttacccgattaacaaaatccataaagcccattacgttttgatgaacatcgaaaccactcccgaagtggttgaagagctggaaaccgcattccgcttcaatgatgcaatattgcgtcatctgaccatcaaaaccaaacacgccgttaccgaagcatcccctatgttgggtggtgaaaaggctaagaacctgttgagcggtgcgtctgaagaagcggtcgcccaataa

SEQ ID NO: 5380 - DNA, 951 bp, Neisseria meningitidis
atgtcccaacaccgcaaactgattattttgggttccggccccgccggatacaccgccgccgtctatgccgcgcgcgccaatttaaaccccgtcattattacaggtatcgcgcaaggcgggcaactgatgaccaccaccgaagtggacaactggcctgccgatgccgacggcgtgcaagggccggaattgatggcgcggtttctcgcccacgccgaacgtttcggaacggaaatcatttttgaccaaatcaacgccgtcgatctgcaaaaacgcccgtttacactcaaaggcgatatgggcgagtacacttgcgatgccctgattgtcgcaacaggcgcgtccgccaaatacctcggtttgccgagtgaggaagcgtttgcaggaaaaggcgtttccgcttgtgccacctgcgacggtttcttctataaaaaccaagatgttgccgtagttggcggcggcaatacggcagttgaagaggcactctaccttgccaatatcgccaaaaccgttaccctgatccaccgccgcagcgagttccgtgccgaaaaaatcatgatcgacaaactgatgaaacgcgtggaagagggcaaaatcatcctcaagctggaaagcaacctgcaagaagtactgggcgacgatcggggcgtaaacggcgcattattaaaaaacaacgacggttctgagcaacaaattgccgtcagcggcatttttatcgccatcgggcacaagccgaataccgatattttcaaaggtcagttggaaatggacgaagccggttacctgaaaaccaaaggcggcacggcggacaatgtcggcgcaaccaatatcgaaggcgtatgggcggcgggcgacgtaaaagaccatacctaccgtcaggcgattaccagcgcggcttccggctgtcaggcggctttggacgcggaacgctggctgggcagccaaaacatttga

SEQ ID NO: 5381 - DNA, 2163 bp, Neisseria meningitidis; identical to SEQ ID NO: 2811

SEQ ID NO: 5382 - DNA, 1854 bp, Neisseria meningitidis
atgaataaagaaacccgttttccggaacacttcgacatcccacttttcctcaaaaacctgcccaacctgccaggcgtataccgttttttcaacgaaagcggcaacgtcttatacgtcggcaaagccgtcaacctcaagcggcgcgtgtccggctatttccagaaaaacgaccattccccgcgcatcgcattgatggtgaaacaggttcaccacatcgaaaccaccatcacccgctccgaatccgaagccctgattctcgaaaacaacttcatcaaagccctgtcgcccaaatacaatattcttttccgcgatgacaaaagctatccttatttgatgctcagcggccatcaatatccgcaaatggcgtattaccgcggcacgctgaaaaagcctaatcaatatttcggcccatatcccaacagcaacgccgtgcgcgacagcattcaagtgttgcaaaaagtctttatgctgcgtacctgcgaagacagtgtattcgagcatcgcgaccgtccttgtctgctttaccaaatcaaacgctgcaccgcgccttgtgtaggccacatcagtgaagaagattatcgtgacagcgtgcgtgaagccgcgactttccttaatggcaaaactgacgaattgacgcgtaccctgcaacacaaaatgcaaaccgccgccgctaatctacaattcgaagaagccgcacgttaccgcgatcaaatccaagcgctcggcatcatgcaaagtaatcagtttatcgacagtaaaaatccgaacaatcccaacgatatcgatttgcttgcactggcggtttcagacggcctggtttgcgtacactgggtcagcatccgcggcggacggcacgtcggcgacaaaagctttttccccgacaccaaaaacgatcccgagccaaacggacaagattacgccgaagccttcgtcgcccaacactatctgggcaaaagcaaacccgacatcatcatcagcaactttcccgttcccgatgcgctaaaagaggctttggaaggcgaacacggcaagcagatgcaatttgtcaccaagaccataggcgaacgcaaagtccggttgaaaatggcggaacaaaacgcgcaaatggcgattgcacaacgccgcctgcaacaaagcagccagcaacaccgcattgatgaactggcaaaaatcctcggcatggattcagacggcctcaaccgccttgaatgtttcgacatcagccacacacaaggcgaagccactattgcgtcctgcgttgtgtacgatgagcaaaacatccagccttcgcaataccgccgctacaacatcacgaccgccaaacccggcgacgactacgccgccatgcgcgaagtgttgacgcgccgttacggcaaaatgcaggaggccgaagccaacggcgagaccgtcaaatggccggatgccgtgttgattgacggcggcaaagggcaaatcggcgtagccgtatcggtatgggaagaactcgggctgcacatccctttggtcggcattgccaaaggcccggagcgcaaagccggtatggaggagctcatactgccttttaccggcgaagtcttccgcctgccgcccaacagcccggccttgcatctattgcaaaccgtacgcgatgaatcgcaccgtttcgccattaccggtcaccgcaaaaaacgcgacaaagcccgcgttacctcctccttaagcgacatccccggcgtaggcagcaaacgccgccaagccctgctcacccgcttcggcggtctgcgcggcgtgattgccgccagccgcgaggacttggaaaaagtggaaggcatcagcaaggcattggcggaaacgatttacaatcatctgcattag

SEQ ID NO: 5383 - DNA, 1404 bp, Neisseria meningitidis
atgaacaatcccgacttaccctatcggcaggccttagaatgcctgtctcaaaaacaatataactttaccgaagtccgccgactgctgacagaagcgttctcggcaggtcatcccgccgccgcattcgagttggcaaaacacctgatggacgcggacagcccctaccaagaccgcgaacaaggtatggaaatgctccgcatcgccgctgaacagggacatccctacgcgcgttacaatctggcatatatccaagaattggaaggcgcacccccggaaaccctgataccgctttacagaccgttggcagaagaaggactgcccgaagcgcaagtccgcctgatgtaccttctgtacgcgtcccgacattttgaagaagccttggaatgggcaaaaacaagcgcaaaaaacaacaacccccacgggcaatacctgcttgcccaatactgccggtacggcacaccgccggattttgaaacggcgcacctgctctaccgaaaatcggcggcacaaggcttgccggaggcacattggcagctcgggctgcaatatcgtttcgggcaagggacgaaagtcgacacggcacaggccgtcaatcatttgcgcgccgccgcacaacaaggatacattcctgcctacaccccacttgccgagctcatcctacctacggctcctgatgaagccgttcactggtttcaacaggccgcacaggaaaatgaccccgatgcccatgccgcacttgccgacatctacctgcaaggcaagcatctggaaagaaaccacaaacttgccctgcatcatgccgaagcagccgccgccgaacgccatcccgaaggtttgcggatactgggcgacatctgccgctacggtttgggcatagcccccgatacggaaaaagcccggcattattatcggcaggcagccgaagccggcagcctttccgcctatcagaaactcatatccgacagcgcgttaaaccatcctgaccaatacggcggcattaaagattccgccatcaggcggcaaagggcagaacggctttatcaaaaagcccaagccctgcattacggattacaatgcgcgcccgaatacgcagccgcgctcaaactctacacagaagccgcagaactcggacacagcaaagcccaaaccaatctgggcagcatgtattacttcggacagggtatgaccgccgactacaatgaagcacgcaaatggtttgaaaaagccgccgcgaaaaaagacagtatggcgttctacaacctcgcctgcatccattacagcggacacggcgtcgagccggacaaagaaaaagcctgccgctacctgcaagaagccataaacaacggatacgggcaaaaaagcgtcctgcaagaactgctgcaacaatggcaaaatgccgtctga

SEQ ID NO: 5384 - DNA, 717 bp, Neisseria meningitidis
atgacagacaccgccgagaaccaaacacaaaacaactggcaagccggacacccccgcagcatccgcagcttcgtcctccgccaaagccatatgaccgccgcgcagcaacgcgccatcgataccttatgggacagcttcggcatcgactaccaagcaacaccggccgatcttgatgcccgtttcggaagcagccgacccaaaatcctcgaaataggcttcggtatggggacggcaaccgcagaaatcgcccgccgcctgcccgaaaccgacttcctcgccatcgacgtacacggtcccggcgtaggcaacctgctcaaactcatagacgaaaaccatttagaaaacatccgcgtgatgcggcacgatgccgtagaagttgtcgaaaatatgctgcaagacggctcgctcgacggcatccacatattcttccccgacccgtggcacaaaaaacgccaccacaaacgccgtctgatacaagcccccttcatcgccaaactactgcccaaactcaaaaccggcggctatatccacctggcgacagactgggaagaatatgcacagcagatgcttgaagtcctcagtagcttcgacagcctgcaaaatacggcggcagactacgcccccaccccggactaccgccccgaaaccaaattcgaagcgcgcggcaaacgcctcggacacggcgtttgggacttggtattcaaacggatcggataa

SEQ ID NO: 5385 - DNA, 195 bp, Neisseria meningitidis
atggattgcaacgacgggaatgttgaaggttttgtcggatacaagtatccgacctacgcttgttgctatatatcttttgatttaatgactaaatatgacaaagttaaagtgcagattacagcaagcatgatatgcttctttaggcttttatcattccatgatatagatatttcttccttttcattttctttataa

SEQ ID NO: 5386 - DNA, 363 bp, Neisseria meningitidis
atgtctcaattagattttaatttagaattatttattaaaaattcaaattttgatgattataagatttttgatatcgtgaaagaagctattgaaacacaggatgaaataggttcaatcttacgaacacatttattttttgaaagaattttagaggcatggatatatgcaaaatgtaataaagaagattttttcaatgatacacaaattggatttcgcacaaaactaaaaattgcgcgtaatcttggcttatttagcgaagtatatgatataggggagagattaaataaaattagaaatacaattgctcaccatgtactaagggaagtaaatcaagaaaatttaactctttacatgaaagtttaa

SEQ ID NO: 5387 - DNA, 2028 bp, Neisseria meningitidis
atggaagttatccaatacccaaattcccccttcaaactccaccaacccttcccgcccgcaggcgaccagcccaccgccattgcaggcctgctcgaagggctttcagacggccttgcctatcaaaccctgctcggcgtaaccggttcgggcaaaacctacaccatggcgaacgtcatcgcccaaagcggccgccccgccatcatcatggcgcacaacaaaacccttgccgcccagctttacgccgaaatgcgcgaatttttccccgaaaacgcagtggaatatttcgtctcctactacgactattaccagcccgaagcctatgtgcccagccgcgatttgttcatcgaaaaagacagcgcgatcaacgaacacatcgagcagatgcgcctttccgccaccaaaaacctaatgacgcgcaacgacgtgattatcgtcgccaccgtgtccgccatttacggtatcggcgacccgaccgagtatcaacaaatggtgttgtccgtcaaagaaggcgataccatcgagcagcgcgacatcatcgccacgctcgtttccatgcaatacgaacgcggcgatttggacttcaaacgcggcagcttccgcgtgcgcggcgacgtgattgacgtgtaccccgccgaaagctccgaaaacgccttacgcatcagcctgtttgatgacgaaatcgaccgcctcgatatgttcgacccgctttcaggcagccttatccagcgcgtcggccgctacaccgtcttcccgtccagccactacgttaccccgcgcgacaccgtcttgcgcgcctgcgagtccatcaaagaagaattacgcgaacgcatcgaatttttcgcccgcgaacaacgccccgtcgaacaacaacgcatcgaacagcgcacccgtttcgacctcgaaatgctctacgaaatgggcttctgcaaaggaatcgaaaactactcccgccacttttccggcaaaaaagaaggcgaaccgccgcctacgctgatggactacctgcccgacaacgccatcatgttcatcgacgaaagccacgttaccgtaacccaaatcggcggcatgtacaaaggcgacgcatcgcgcaagcaaaacctcgtcgactacggcttccgcctgccttcagcccgcgacaaccgcccgctcaaattccacgaatttgaaaaagtcatgccgcaaaccatcttcgtttccgctacccccgccaaatacgaagaagaacacgccggacaagtggtcgaacaagtcgtccgccccacagggctggttgatccccaaatcatcatccgccccgttgccacccaagtcgacgacttaatgagcgaaatcaacgaccgcattgaaaaaggcgaacgcgtactcgttactaccctcaccaaacgcatggcggagcaactcaccgactattacagcgaactcggtatcaaagtgcgctacctgcacagcgacatcgacaccgtcgagcgcgttgaaatcattagagatttacggctcggcctgtttgacgtactcgtcggcatcaacctcttacgcgaaggcctcgacatccccgaagtctctctcgtcgccatcctcgacgcagataaagaaggcttcctgcgctcccaccgcagcctgattcaaaccataggccgcgccgcgcgcaacgtgaacggcgtcgccatcctgtacgccgacaaaattaccgactccatgaaagccgctatcgacgaaaccgaacgccgccgtgaaaaacagattaaattcaacgaagaacagggcatcgtgccgcagcagattaaaaaacaggtcaaagacatcatcgacggcgtgtaccacgaagaagacggcagtaaaggccgtctgaaaggtaaaaacaaggttaaagtgggcgagattcacaacgaagaagatgcgattaaagaaatcgccaaactcgaaaaagccatgcagcaggcggctagggatttgcagtttgaagaggcggctgtgttgcgggataggattagggatattaaagagaatttgttgtttggggcggagtga

SEQ ID NO: 5388 - DNA, 1485 bp, Neisseria meningitidis; identical to SEQ ID NO: 3465

SEQ ID NO: 5389 - DNA, 1791 bp, Neisseria meningitidis
atgcgctacaaaccccttctgcttgccctgatgctcgttttttccacgcccgccgttgccgcccacgacgcggcacacaaccgttccgccgaagtgaaaaaacagacgaagaacaaaaaagaacagcccgaagcggcggaaggcaaaaaagaaaaaggcaaaaatggcgcagtgaaagataaaaaaacaggcggcaaagaggcggcaaaagagggcaaagagtccaaaaaaaccgccaaaaaccgcaaagaagcagagaaggaggcgacatccaggcagtctgcgcgcaaaggacgcgaaggggataagaaatcgaaggcggaacacaaaaaggcacatggcaagcccgtgtccggatccaaagaaaaaaacgcaaaaacacagcctgaaaacaaacaaggcaaaaaagaggcaaaaggacagggcaatccgcgcaagggcggcaaggcggaaaaagacactgtttctgcaaataaaaaagtccgttccgacaagaacggcaaagcagtgaaacaggacaaaaaatacagggaagagaaaaatgccaaaaccgattccgacgaattgaaagccgccgttgccgctgccaccaatgatgtcgaaaacaaaaaagccctgctcaaacaaagcgaaggaatgctgcttcatgtcagcaattccctcaaacagcttcaggaagagcgtatccgccaagagcgtatccgtcaggcgcgcggcaaccttgcttccgtcaaccgcaaacagcgcgaggcttgggacaagttccaaaaactcaataccgagctgaaccgtttgaaaacggaagtcgccgctacgaaagcgcagatttcccgtttcgtatcggggaactataaaaacagccagccgaatgcggttgccctgttcctgaaaaacgccgaaccgggtcagaaaaaccgctttttgcgttatacgcgttatgtaaacgcctccaatcgggaagttgtcaaggatttggaaaaacagcagaaggctttggcggtacaagagcagaaaatcaacaatgagcttgcccgtttgaagaaaattcaggcaaacgtgcaatctctgctgaaaaaacagggtgtaaccgatgcggcggaacagacggaaagccgcagacagaatgccaaaatcgccaaagatgcccgaaaactgctggaacagaaagggaacgagcagcagctgaacaagctcttgagcaatttggagaagaaaaaggccgaacaccgcattcaggatgcggaagcaaaaagaaaattggctgaagccagactggcggcagccgaaaaagccagaaaagaagcggcgcagcagaaggctgaagcacgacgtgcggaaatgtccaacctgaccgccgaagacaggaacatccaagcgccttcggttatgggtatcggcagtgccgacggtttcagccgcatgcaaggacgtttgaaaaaaccggttgacggtgtgccgaccggacttttcgggcagaaccggagcggcggcgatatttggaaaggcgtgttctattccactgcaccggcaacggttgaaagcattgcgccgggaacggtaagctatgcggacgagttggacggctacggcaaagtggtcgtggtcgatcacggcgagaactacatcagcatctatgccggtttgagcgaaatttccgtcggcaagggttatatggtcgcggcaggaagcaaaatcggctcgagcgggtcgctgccggacggggaagaggggctttacctgcaaatacgttatcaaggtcaggtattgaacccttcgagctggatacgttga

SEQ ID NO: 5390 - DNA, 237 bp, Neisseria meningitidis
atgccgtttgcccaatcttgcgccttctttgcgcggatacttgcaatcggctcaaacagccttatattgtgcgtcatattttcaatgccgcaacggatattgtgttccgacacacagggtagcacattaagccgcataccgtatgttgcccgattttgggaacgtgcgcccctccaaacaaagcaagccctgccgctttcacggaaaacggggattcaaccgataaggaaattttga

SEQ ID NO: 5391 - DNA, 561 bp, Neisseria meningitidis; identical to SEQ ID NO: 3629

SEQ ID NO: 5392 - DNA, 549 bp, Neisseria meningitidis
atgaacctctccaaccactttctcatcgccatgcccgatatggaagacgcgtttttttcacaatcggtcgtctatatctgcaaacacgatgaagacggcgcactcggcatcgccatcaacaaaccctctccgattacgatggacatgattttttccgccaccggcaaaaacatccccatgcggatgcagcacgacagcgtgatgatgggcggtccggtgcaggtcgagcgcggttatgtcgtgcataccccgatcggcaactggcaaagcagtatcggcgtttcagacaatatcgcgctaacttcttcccgagacgtgattgaaaatatttcacgcgaaggtgcggttgacaaagccttgatcagcataggctattcaagctggagcaaagggcagctcgaacgcgaacttgccgacaatgcgtggctgactgttcccgccgacgaacacatcctgttcgacatcccctacgaacaccgttacgccgccgcattcgccaaactcggcatcgacccgctcgccctgttttcaggagccggccatgcataa

SEQ ID NO: 5393 - DNA, 456 bp, Neisseria meningitidis
atgcataaaattccaaaaggaacggcactggcattcgacttcggcgaagcgcgtatcggcgtggcacaaggagacgcggaattagggctatcccatcctttgagcaccgttaccggcggcagcaacgatgaaaagttcgcggcaatcgccaagctggttcaagaatggcagccgcgttattttgtcgtcggactgcccgtgcataccgacggcacgaaacatgaaatgacgcacctgtcgcgcaagttcggacgcaggctgaacggcaggttcaatctccccgtctattgggttgacgaacggctgtcgtccgtctatgccgaaagcctgctttcggaagcacaggtcttcggcaaaaaacgcaaatcggtgctcgaccaagtggcggcgcaagccatcttgcacggttttttcgagggcggtccggcggaatgtttcaacgggcgtgagggttaa

SEQ ID NO: 5394 - DNA, 657 bp, Neisseria meningitidis
gtggcttcagtatttttagaaggagaggcagtcgaggtcggcaatattttctgtatcggcaggaactatgccgcacatatcgaagagttaaaaaacgaaataccttccgaacctgtggtgtttatgaagccgtcaggcagcattttgaacagcggcggtacaatcttgctgcccgagtttagtagggatgtgcagtttgagtgcgaactcgtgctgctggtcggtaaggattcagacggcacgggcgagggtaaagatattttgggatgtgtcgcaggatatggtgtagggctggaccttacggcacgggatatccaatgccgtctgaaggaaaaagggctgccctggctgaaggcaaaagggttcaggcattccgcgtgcgtgtcggattttgcggcggcaggcagaatcggcaatcccgagaaggtgttgttttcattaaaacaaaacggcgtattgaaacagcgcggggataccggtttgatgatttacccgattcgggaaattttacacaaactggcggcagattacggtttggggaaaggggatttggtgtttaccggaacgccctccggcgtgggcgcaatcggtgcgggggacaatttggcattggagctggacggcttggtgcgcgcctctttcacggtagggtgttaa

SEQ ID NO: 5395 - DNA, 1713 bp, Neisseria meningitidis
atgaaagccagccaattctttatctctactttaaaagaagcccctgccgaagccgcgcttgccagccacaagctgatgattcgcgccggcctgattaaggccaacgcatcgggtctttatacttggatgccgatggggctgcgcgtgttacgcaaagtcgaaaacgtcgtgcgcgaggaaatggcgcgcgcgggcagcgtggagttgctgatgccggtggtgcagcctgccgagctgtggcaggaatccggccgctgggagttttacggtaaagaactgctgcgcctgaaagaccgccacgaccgcgatttctgcatgggcccgacctgcgaggaagtcatcgccgacatcgtgcgcaaagaaatcaacagctacaaacagctgccgaaaaacttttaccacatccaaaccaaattccgcgacgaagtgcgcccgcgcttcggcgtgatgcgcgcgcgcgagtttgtgatgaaagacgcttattccttccacgccgactatgcctcgctccagacgacctatcaagatatgtatgatgcttattgccgcatctttacccgactaggcttggcgttccgacccgttgctgcggataccggcagcatcggcggtaccggttcgcacgagtttcaagtgttggcggaaagcggcgaagatgtgattgcatacagcgacacttccgattacgccgccaatatcgagttagcgccgaccttgccgctcaaaggcgaacgtgcagccgctcaggcagaactcgtcaaagtacacacgccaaacgtcaaaaccattgattcattggttgatttcctcagtattccgattgaaaaaacactgaaatccatcgtggttgaaggcgaaaacgaaggcgaacttatcctgctgctgttacgcggcgaccatgaatttaacgacatcaaagccgagaaactcgcgggcgtgaaatcgccgctgacgatggcaagccctgccgcgattgtcgaacagttcggcgcaaacggcggctctctcggccctgtcggttttgcaggcaaagtctatgccgatttcgctaccgaaaaaggcgcggactgggtcatcggcgcaaacgaagacgactaccactataccggcttcaatttcggccgcgacgctgccgaacctgagtttgtcgatttgcgcaacgtcgtcgagggcgacgaaagccccgacgggcaaggccgtctgaaactggcgcgcggcattgaagtcggacacgttttccaattgcgcgacaaatacacccaagccatgaacgtaagcttccttgacaacaacggcaaatcgcaaattatggaaatgggctgctacggcatcggcatcacccgcgtcgttgccgccgccatcgagcagaataacgacgaaaaaggcatcatctggaccaaagcaatggcgccgtttgaagtcgttatcgtgccgatgaactacaaaaaatcagacaccgtacgcgaagccgccgacaaaatctatgccgaattgctggcggcaggcgcagacgtcctcctcgacgaccgcgacgaacgcgcaggcgtgttgctgaacgattccgagctgttgggtattccgcaccgcatcgtcatcggcgaccgcgccttgaaagaaggcaatgtcgaatacgccgaacgccgcgacaacgaagcgcaggcagttgcaatcggagaaattgttgcacgtgtaacagcttcattaaatgcgtaa

SEQ ID NO: 5396 - DNA, 231 bp, Neisseria meningitidis
atggttatttgccagcagacccgattgctgataggatttcgtgtggagcagatcgaacatttttttcaagttttcccttgtttccaaaacttttataattttttgaaaacattaaacttaaattatttttttcggtttgatttagaaattttcgtttttgcttattatttttcacaaacgaaaataaaggggttggctacaccctccctgccgattaaacactcaacataa

SEQ ID NO: 5397 - DNA, 2664 bp, Neisseria meningitidis
atgtccacccaattacacgatgttgaccctatcgaaacccaagagtggctggacgcgttaagctccgtcctcgaatatgaaggcggcgaacgcgcgcaatacctcttggaaaacctggtcaaatactgccgcgacaagggcgtacgtatgccacacggcacgaccaccccgtatttgaataccgtttcggttgaaaacgaaaaaggcattccgggcgaccaaaacatcgaacaccgcatccgcgcattcgtgcgctggaacgccgccgccatcgtattgcgcgccggcaagaaagatttggaactgggtgggcacatcgcatctttccaatctgccgccaccatgtacgaagtcggtttcaaccacttttggaaagccaaaggcgaaggcgaagaaggcgatttggtcttcttccaaggtcacgtcgccccgggcatctatgcacgcgcattcgtcgagggccgtctgaccgaagaccagctgaacaacttccgccaagaagtggacggacacggtctgccttcctatccgcacccccacctcttgcccgacttttggcagttcccgaccgtatccatgggcttggggcccatcatggcgatttatcaggcgcgtttcctgaaatacttggaatcgcgtggtttggcaaaaaccaaaggccgtaaagtatggtgtttctgcggcgacggcgaaatggacgaacccgaatctcaaggtgcaatcgcactggctgcacgcgaaggcttggacaacctgattttcgtcatcaactgcaatctgcaacgcttggacggtccggtacgcggcaacggcaaaatcatccaagaattggaaggcaactttgccggcgccggctggaatgtcgtcaaagtcatttggggccgccgctgggaccgcctcttggcgaaagacaaagacggtatcctgcgccaacgtatggaagaatgtttggacggcgactaccaaacttacaaatccaaagacggcgcgtatgtgcgcgaacacttcttcaatacgcccgaactgaaagcattggttgccgatatgaccgatgagcaactctgggcattgaaccgcggcggccacgacccgcaaaaagtgtacaacgcctacgaccgcgcagcgaaccatgccgacggcaaacctaccgtcatcttggcgaaaaccattaaaggttacggtatgggcgcatccggcgaaggtcagaacgttgcccaccaagccaaaaaaatggacaaagcgtccctgaaacaattccgcgaccgctttgacattccggttaccgacgaacaaatcgaaagcggcgatctgccttacctgacttttgcccccgatacggaagaatacaaatacctgcacgcacgccgcgatgctttgggcggctacctgccgcaacgcaaaccgacgcaggaagtattggaagtgcccgagctgtcagcattcgacgcacaactcaaatccagcggtgaacgcgagttctcgaccacgatggcattcgtccgcatcctgtccactttactgaaagacaaaaaaatcggcaaacgcgtcgtacctatcgttcccgacgaaagccgtactttcggcatggaaggtatgttccgccaatacggtatttggaatccgaaaggtcagcaatatacccctcaagacaaagaccaactgatgttctataaagaatccgttgacggtcaaatcttgcaagaaggtattaacgaaccgggcgcgatggccgactggattgcggctgcaaccagctacgccaacagcaacttcgccatgattccgttctacatttactattctatgttcggtttccaacgtatcggcgacttggcttgggcggcgggcgatatgcacgcgcgcggcttcctgctgggcggtactgccggccgtacgacgctgaacggcgaaggcctgcaacacgaagacggccacagccacatccaggccgacctgattccgaactgcgtatcttatgacccgactttccaatacgaagtcgccgtcatcgtacaagacggtctgcgccgtatgtatgccaataatgaagacgtgttctactacatcaccctgatgaacgagaactacacccatccggatatgcccgaaggtgcggaacaagacatcttgaaaggtatgtacctgctgaaagccggcggcaaaggcgataagaaagttcaattgatgggctccggtaccatcctgcaagaagtcattgccggtgccgagctgctgaaagccgacttcggcgtagaagcagacatctggtcttgcccgtccttcaacctgctgcaccgcgacgctgtcgaggtagaacgcttcaaccgcctgcatccgctggaagccgaaaaagtacctttcgttacttcccaactgcaaggtcatgacggtccggttattgccgctaccgactatatccgcagctatgctgaccgtatccgcgcctacatcccgaacgactaccacgtcttgggcactgacggtttcggccgttccgacagtcgcgccaacctgcgccgcttctttgaagtggatcgctacaacgttgccgtggccgcattggccgcattggcggaacaaggcaaagtcagcaaagaaaccgttcaacaagccattgagaaatacggcatcaaagccgattcagctcctagctggaaacgctga

SEQ ID NO: 5398 - DNA, 1608 bp, Neisseria meningitidis
atgagtatcgtagaaatcaaagtccccgatatcggcggtcacgaaaacgtcgacatcatcgccgtagaagttaaagcgggcgacaccatcgccgttgacgacaccctgattacactggaaaccgacaaagccacgatggatgtgcctgccgatgcggccggtgtcgtgaaagaagtaaaagtcaaagtcggcgacaaaatctccgaaggcggcgtaattctgaccgttgaaaccggtgccgccgccgccgaagccgccccggctgctgccgaagcacaacctgcacctgctgccgcacccgctgccgcaggcggtgcaaccgttcaagtagccgttcccgatatcggcggccataccgatgtggatgtaatcgccgttgaaatcaaagtgggcgacaccgttgccgaagacgacacgctgattactttggaaaccgataaagcgacaatggacgtaccttgtaccgctgccggtgtcgttaaagccgtattcttaaaagtcggcgacaaagtatccgaaggctctgccattatcgaagtagaaaccgtcggctctgccgcagcagcccctgctcaagccgctcaagctgccgcaccggctgccgctccgcctccgactgctgccgccgcacccgccgccgcgcctgcaccttctgcacctgccgctgccaaaatcgacgaggccgctttcgccaaagcacacgccggtccttccgcacgcaaactggcgcgcgaattgggcgtggatttgggccaagtcaaaggcaccggcttgaaaggccgtatcatgggcgacgacatcaaagcctttgtgaaatccgtgatgcagggcggcgcggcaaaacctgccgcagccagcgcatctttgggcggcggtctggacttactgccgtggcctaaagtggacttctccaaattcggcaatgtcgaagttaaagaattgtcccgcattaagaaaatttccggtcaaaacctgtcccgcaactgggttgtgattccccacgttaccgtacacgaagaagcggacatgaccgagctggaagaattccgcaaacagctgaacaaagaatgggaacgcgaaggcgtgaaactgtccccgttggcgttcatcatcaaagcctctgtttccgcgttgaaagcattccccgaattcaacgcctcactggacggcgacaacctggtgctgaaaaactacttcaacatcggtttcgcagccgatacgccgaacggcttggttgttcccgtcatcaaagacgtggatcaaaaaggcttgaaacaaatcagccaagaattgaccgaattgtccaaaaaagcccgtgaaggcaagctcaaaccgcaagaaatgcaaggcgcgtgctttaccatttccagcttaggcggcatcggcggcacaggcttcacgccaattgtgaacgctcccgaagtcgccatcttgggcgtgtgcaaatcccaaatcaaacctgtttggaacggcaaagagtttgccccgcgcctgatgtgcccgttgagcctgtccttcgaccaccgtgtcatcgacggtgcggccggtatgcgcttcaccgtattcttggcgaagctgttgaaagacttccgccgcattaccttataa

SEQ ID NO: 5399 - DNA, 438 bp, Neisseria meningitidis
atgggaaatttcttatatagaggcattagttgccaacaagatgagcaaaataatggacagttaaaacctaaaggtaataaagctgaagttgcaattcgttatgatggtaagtttaaatatgatggtaaagctacacatggtccaagtgtgaagaatgcagtttacgcccatcaaattgaaacaggtctatatgacggatgttatatatctacgacaacagacaaggaaattgccaagaaatttgcaacaagttccggcatcgaaaatggctatatatatgttttaaatagggatttgtttggtcaatattctatttttgaatatgaggttgaacatccagaaaacccaaatgagaaggaagtaacaatcagagctgaagattgtggctgtattcctgaagaagtgattattgctaaagagttgatagaaattaactaa

SEQ ID NO: 5400 - DNA, 1785 bp, Neisseria meningitidis
atggctttagttgaattgaaagtgcccgacattggcggacacgaaaatgtagatattatcgcggttgaagtaaacgtgggcgacactattgctgtggacgataccctgattactttggaaaccgataaagcgactatggacgtacctgctgaagttgcaggcgtagtcaaagaagttaaagttaaagtcggcgacaaaatctctgaaggtggtttgattgtcgtcgttgaagctgaaggcacggcagccgctcctaaagccgaagcggctgccgccccggcgcaagaagcccctaaagctgccgctcctgctccgcaagccgcgcaattcggcggttctgccgatgccgagtacgacgtggtcgtattgggtggcggtcccggcggttactccgctgcatttgccgctgccgatgaaggcttgaaagtcgccatcgtcgaacgttacaaaactttgggcggcgtttgcctgaacgtcggctgtatcccttccaaagccttgttgcacaatgccgccgttatcgacgaagtgcgccacttggctgccaacggtatcaaataccccgagccggaactcgacatcgatatgcttcgcgcctacaaagacggcgtagtttcccgcctcacgggcggtttggcaggtatggcgaaaagccgtaaagtggacgttatccaaggcgacgggcaattcttagatccgcaccacttggaagtgtcgctgactgccggcgacgcgtacgaacaggcagcccctaccggcgagaaaaaaatcgttgccttcaaaaactgtatcattgcagcaggcagccgcgtaaccaaactgcctttcattcctgaagatccgcgcatcatcgattccagcggcgcattggctctgaaagaagtaccgggcaaactgctgattatcggcggcggcattatcggcctcgagatgggtacggtttacagcacgctgggttcgcgtttggatgtggttgaaatgatggacggcctgatgcaaggcgcagaccgcgatttggtaaaagtatggcaaaaacaaaacgaataccgttttgacaacattatggtcaacaccaaaaccgttgcagttgagccgaaagaagacggcgtttacgttacctttgaaggcgcgaacgcgcctaaagagccgcaacgctacgatgccgtattggttgccgccggccgcgcgcccaacggcaaactcatcagcgcggaaaaagcaggcgttgccgtaaccgatcgcggcttcatcgaagtggacaaacaaatgcgtaccaatgtgccgcacatctacgccatcggcgacatcgtcggtcagccgatgttggcgcacaaagccgttcacgaaggccacgttgccgccgaaaactgcgccggccacaaagcctacttcgacgcgcgcgtgattccgggcgttgcctacacttcccccgaagtggcgtgggtgggcgaaaccgaactgtccgccaaagcctccggccgcaaaatcaccaaagccaacttcccgtgggcggcttccggccgtgcgattgccaacggttgcgacaacggctttaccaagctgatttttgatgccgaaaccggccgcatcatcggcggcggcattgtcggtccgaacggtggcgatatgatcggcgaagtctgccttgccatcgaaatgggctgcgacgcggcagacatcggcaaaaccatccacccgcacccgaccttgggcgaatccatcggtatggcggcggaagtggcattgggtacttgtaccgacctgcctccgcaaaagaaaaaataa

SEQ ID NO: 5401 - DNA, 1551 bp, Neisseria meningitidis; identical to SEQ ID NO: 2821

SEQ ID NO: 5402 - DNA, 1778 bp, Neisseria meningitidis
atgggcaaagccaacgcctttaccgcgccgattaccgtcgtcaactacgacgaacaagccctcaacaacaccgaggcgcgtactttggtggatgccgtagcgaaaaaagacgcttccgtttggcagttcggcggcgaaagcaacacgctgaccggattgtatttcagaggttatcagcttgatgcgcgccaattcagcgtcaacggtttgacaggtatgtacggcacgcaaggcacgaccagcgtgcaagtcggctccgcacaactgattcaaggcgcgtccaccgccgtaaacggcatgaaccctgatggcgcggtatccggttccgtcaatatcgaaaccaaaaaagccgctgatgaaggcaaccgcaaaatcggtttggcccggttcggcaacaaccgcgcccaaggtacgttcgacttgggccaacgtttcggcgaaaacaaagcattcggcgtgcgcgccaacggcaaactgcgccacggcgacaccccgcgccacggttacagcgaagacaacaaagaatttgcggtaaatgccgactatcgcggcgaaacactgcgcgtagcgttcgattccatctacgcaaaacgcaaaaccaacggcggtcgcgcgcgtatgcaggacattcaaaacgccggcggacgcttgtcctgactttgggcggacgtttccaagcggttgaatacaccaataagaaaaaatcacgcggaacggcagccggagctagcaaggtagaagtgaaggcaaacggaaatattgagcatcaattggcatcgtttacagccgactatcccaattcttgggagaactctgccaacttggatgccaatatcaaagtcaacagcctggctttgtccgacaccttgggcttcgtggataacaaataccgcctgactttgggcggacgtttccaaacagtcgaatataccgacaaaaaatcacagagcggcgatgccaaacgtttcagcccgatgctgatggcggcgtgggtgccgcaacctgatttggttgtgtacggcaactatatggaagacttggagcctgccgacatcaaaaccgatgattccggcgaaacgacaatggcgaaaccgcgtgtcagccgccagtttgaagtgggcgtgcgtaaaaactggggcaatttcgtaaccacgttaaacgcgttccaaatcaaacgcccgggctactggcgcggtcatacaactaccaagacaacaaaaggggtaacaacaacgctgacctatggcaataattctgatttcgcccgctataaggcgcaaggcggcgcggccggcgacgagcaaggtatggaacgcaatcgcggtattgagttcaacacctacgcgaacttgctcaacaatactttgcgtccgactttgggtctgatgtatctgcaatcgaccgtgaaagagtatccaaattcacgcgatatgctggttaacggcgtacaagtcgccaatccgcgcgtaattgccaaagcaggtttggaatgggatacaccgtttgccaaaggcttgactttaaacggtaatgtttcgtatttcggcaagtctgaccaagacacgcaaaaacaatacgccttcccgtcctataccttgattgacgtaggcgcgcgctacaaaaccaagcttggcaaaaacactctgaccgtcagcagctcggtggaaaacctgttcaacaaaaactattggcaggtacagcgcggccaatacgaccgcagcttcgccgtcgtcggtatgccgcgcacttactggctgaaggcggaattggatttctga

SEQ ID NO: 5403 - DNA, 786 bp, Neisseria meningitidis
atgaatccgtttttgaatacagcctttaaagccgcccgccgtgccggtcagatgatgatacgcgccgcgggcaatctcgatgccgtcaaaaccgacagcaaagccttcaacgattttgtttccgatgttgaccgcaattccgaaatcatcctggttgaggctttgaaagaagcctatccgcaccacaaaatcacttgtgaagaaagcggctcccacggcaaagccgcagccgagtacgaatggattatcgatccgctcgacggcacgaccaatttccttcacggtcatccccaatacgccatctctatggcgctgctgcacaaaggcgtgttgcaagaagctttggtttacgcccccgaacgcaacgacgtatatatggcttcgcgtggcaaaggcgcgttgctcaacgaccgccgcatccgcgtttccaaccgcatcgaactgaaccgctgcctgattggtaccggcttccctgttgtcgatcaaagcatgatggacaagtatctggcgattttgaaagatttcttggcaaaaaccgccggcggccgtcgtgaaggtgcggcttctttggatttgtgcgccgtagcaacaggacgttttgacggctttttcgagtttaacctcaaaccgtgggacattgccgccggtgcattgattgttcaggaagcgggcggtatcgtaaccgatatgtcgggtgaagacggctggctggaaagcggcgatattgtggctgccaatcccaaagtgctggcgcaaatgttgaaaatcatttccgcacacgtttaa

SEQ ID NO: 5404 - DNA, 816 bp, Neisseria meningitidis
atgactactctcaaacccgccctgcccgcttatctggacaacatccgcatcatcctcacgcgcaccagccatcccgccaacatcggctctgccgcgcgcgcgatgaaaacaatgggtctgcacaaactgaccatcgtcgccccaaatctgatggcaacgccgatgacggaaaacccgcccgtgtttgacccggagcatcctcaatcgtttaaattaccggaagaaagcttcatcctcgcttccggcgcggcagacgttttggaaaatgccaccattgccgcttctttggacgaagcccttgccgacaccaccatcgcctgcgccctgaccagccgccgccgcgaaattactgcgccgctgcaaaccccgcgcgatttggtatccgaattactgcagaccgcaaaccgaggcgagaaagtggcactggttttcggcaacgagactttcggcttgagcatcgaagaagtccaagcctgcaaccgactgatgaccatcaacggcaatcccgactatttctcgctcaacctcgcccaagccgtgcaggtcgtgtgctacgaaatcttcagccaaaccggttcgcccatgacccatcttcaacaagaagaccacgctgcgacccacgagcaaatcaaaggcatggtcgcccacatggaaagcgtgatgaacgacatcggctttttcaaccgccgcaacggcgagcgtctgatgcgccgtatgcagagcctgttcggccgcgccaatacgcaaaccgaagacatcgatatcctgcgcggttttttcaataccgtcagccaccgtatccataaaaaagactga

SEQ ID NO: 5405 - DNA, 858 bp, Neisseria meningitidis
atgaattacgccctagacgcattatggtggaaacttaccagccaacccgtccgcgaccttgcctcgctgctgactgcgccgcctttgtggcaaagcggctgcgaattgagcgtgcgagaactactgggagaacacggtttccgttaccttttggcattggatgccgatcccacgcggctgacggattacctcgcccaacgcgccccgttcggccaccgtctcggcatttatgccgaagagctgctggctttttggtttgccaatgcaccgcacgccgaactgctcgcgcacaacctcacggtttccggttcggacggcaatacgcaaggcgcggcggattttgtggcaaggcttaacggcaaaccctaccatatcgagctgacctgcaaatattacggcggcgacacggacagtcccgaagggatgcgcggattcgaccccaaagacacgctgttgggaaaagccgccaaactgaccgcccaactcggtctgccgcacacttcagacggcatccggaccttgcggcagcacggtttgccgcttaacgtaaaacccgtttccatcgtgcgcggcatcggattttttccacacggtttccatgcttttgagccaccgcttaatccatacggttggcgcggcatctatattcaagattgggcggaatacgggtttaaacgccaagaagtccgctaccatctgctcgaccgtatggcctacctcgcgcctgcgcgtgtcgccgaaaccgaaacattgaacgcaaccgaaatccgccgtatcgaccaaggcttgattgccgttttggaatgtcggccggacggcttttggcacgaaatcgaacgcattatgaaggccgtctga

SEQ ID NO: 5406 - DNA, 342 bp, Neisseria meningitidis
atgaagaataatgttaaaaattggacaactaaagaagtcaagcaatcattagataaatttaataatattttaattaaaaatacttttcttcttcagtatctgaaaaaagagttttcagcttcaagtgcttattgtttgtctatgctccctgaagaagaagatatatatgaaatattggttaatgggaatattattattgatttagaatttaataaacatacaaatgaaacagttgttattaatgttactgatgttgatgaatacttgaaaactttaaccaatgagagtggtagagtattttttacattagcaaaagaaatcggcaaacagaaaaacatttaa

SEQ ID NO: 5407 - DNA, 1257 bp, Neisseria meningitidis
atgaacgccgcacaactcgaccataccgccaaagttttggctgaaatgctgactttcaaacagcctgccgatgccgtcctctccgcctatttccgcgaacacaaaaagctcggcagtcaagatcgccacgaaatcgccgaaaccgcctttgccgcgctgcgccactatcaaaaaatcagtaccgccctacgccgtccgcacgcgcagccgcgcaaagccgctctcgccgcactggttctcggcagaagcaccaacatcagccaaatcaaagacctgcttgatgaagaagaaacagcgttcctcggcaatttgaaagcccgtaaaaccgagttttcagacagcctgaataccgccgcagaattgccgcaatggctggtggaacaactgaaacagcattggcgcgaagaagaaatcctcgctttcggccgcagcatcaaccagcctgccccgctcgacatccgcgtcaacactttgaaaggcaaacgcgataaagtgctgccgctgttgcaagccgaaagtgccgatgcagaggcaacgccttattcgccttggggcatccgcctgaaaaacaaaatcgcgcttaacaaacacgaactgtttttagacggcacactggaagtccaagacgaaggcagccagctgcttgccttattggtgggcgcaaaacgaggcgaaatcattgtcgatttctgtgccggtgccggcggtaaaaccttggctgtcggtgcgcaaatggcgaacaaaggcagaatctacgccttcgatatcgccgaaaaacgccttgccaacctcaaaccgcgtatgacccgcgccggactgaccaatatccaccccgaacgcatcggcagcgaacacgatgcccgtatcgcccgactggcaggcaaagccgaccgtgtgttggtggacgcgccctgctccggtttgggcactttacgccgcaatcccgacctcaaataccgccaatccgccgaaaccgtcgccaaccttttggaacagcaacacagcatcctcgatgccgcctccaaactggtaaaaccgcaaggacgtttggtgtacgccacttgcagcatcctgcccgaagaaaacgagctgcaagtcgaacgtttcctgtccgaacatcccgaatttgaacccgtcaactgcgccgaactgcttgccggtttgaaaatcgatttggataccggcaaatacctgcgcctcaactccgcccgacaccaaaccgacggcttcttcgccgccgtattgcaacgcaaataa

SEQ ID NO: 5408 - DNA, 435 bp, Neisseria meningitidis; identical to SEQ ID NO: 2153

SEQ ID NO: 5409 - DNA, 1344 bp, Neisseria meningitidis
atgtttcacagtgtcaatgtatttacgggcgaaacgctttaccgccgccccgctcaagattatgcggagtttgaacggcggctggcggatttgaaaatgcgcggcggggcgttcgcgcaactgggcgtaaccgaacgtgccgcgcgcctgcaaaaatttgccgaccgtttggaggcggagaaagagcgttttgcggaaatggtgtgtgaggaagtcggacgctgcttgcacgaatgccgtgcggaaatcggcaagtctatcgaactgatacgctattacgcccgccttgcccccgaactgcttgcccacaaaaccatcgcgacgcaggcgagtttgagtcaggtgcgcttcgagcctttgggcgtggtgtttgccgtcatgccttggaactatcccgtctggcaggtattgcgtttcgccgttcccgctatgtgcgcgggcaacgcgtgcgccgtcaaacccgcgcccagcgtggcacgcgtcagtcaggcactgttcgatttggcttcagacggcattcctctggcaggcgtgtggctggatgaggcgggcacgctcaaggcggttgaagataccgatgcaatggcgtttaccggttcaacgcatacggggcgcatccttgcggcacacgcgggcgcaaaccttaagaaaaccgtgttggagctcggcggtagcaacgcctttatcgtgatgcccgatgctgatttggagcgtgccgccgcagaagcctgttattcccgtttccgcgatgcggggcaatcgtgtaacgccgccaagcgcatcatcgtaaccgaagccgcagccgatcgttttatcacgctgtttcttgccgaatgcgctaaattgaaaatgggcgaccccaaacatcccgatactacgcttgcaccgctgcaccgcgaagatttgcgggacagggttcacgggcaggttgaagatgccgtttcaaacggcgcggtatgcctgaccggcggaaaaatcccacaagggcgaggctggttttatcccgcgacggttttagacagggtaaatcctgcctgccgcgtctggagagaagaagtattcgggccggccgccctgattttgcgcgccgaaaacgaagaacatgccatcgcccttgccaatgattccccgttcgggctcggtgcctgcatttataccgccgataccgaacgcgcttggcggtttgccgaaaaaatacaggcgggatcggtgtttatcaaccgccataccagcagcgatttgcgcctgcctttcggcggagtcaaagattccggttacgggcgcgaattgtccgaattcgggctgtacgagttcgtcaacgtcaaaacctactggcagaaatga

SEQ ID NO: 5410 - DNA, 654 bp, Neisseria meningitidis; identical to SEQ ID NO: 2147

SEQ ID NO: 5411 - DNA, 291 bp, Neisseria meningitidis
atggcactgacacttgccgacgtagacaaaatcgcccgactctcccgactgcacctgactgcggaagaaaaagaaaaatcgcttcaagaattaaacgacattttcactatggtcgaacagatgcaaaccattaacacagacggcatcgaaccgatggcgcacccgcacgaggccgccctgcgcctgcgcgaagacgaagtaaccgaaaccgaccgcgccgccgaatatcaggcgggtgctccggaagtacgcaaccgtctgtacatcgtaccgcaagttatcgaagaataa

SEQ ID NO: 5412 - DNA, 1446 bp, Neisseria meningitidis
atgacccaatacacattgaaacaggcaagcgtcctgttgcagtccaaacagatttccgccgtcgaactggcaagcgcataccttgccgccatcgccgaaaaaaatcccgccctcaacggctatatcaccatcgaccaagataaaacccttgcagaagcccgtgccgccgacgaacgtatcgcgcagggcaacgcctccgcgcttaccggcgtacccgtcgcctacaaggatattttctgccaaaccggctggcgcagcgcgtgcgcttccaaaatgctcgacaacttcatctccccctacaccgccaccgtcgtccaaaacctgctcgacgaaggtatggtaacgctcggccgcaccaatatggatgagttcgctatgggttcgaccaatgaaaactcattctacggtgcagccaaaaacccatggaatcttgagcacgtccccggcggttcgtcaggcggttccgccgccgtcgttgccgcgcgcctcgcccctgccgcgctcggttcggacaccggcggctctatccgccaacccgcatcgcactgcggcattaccggcatcaaacccacatacggcacggtttcccgcttcggtatggtcgcctacgcctccagcttcgatcaaaccggcccgatggcgcaaactgccgaagactgcgcgattctgttaaacgcgatggcaggtttcgaccccaaagactccaccagcctcgagcgcgaaaaagaagactacacccgcgatttgaaccaaccgctcaaaggtttgaaaatcggcctgcccaaagaatatttcggcgaaggcaacagcgccgatgttctgacggcattgcaaaacaccattgatttgctgaaagcccaaggcgcggaattgattgaagtttccctgccgcaaaccaagctgtccatccccgcctactacgtcctcgcctccgcagaagccagcaccaacctttcacgttacgacggcgtacgttacggacaccgtgccgcccaattcgccgatttggaagaaatgtacggcaaaacccgcgccgaaggtttcggcagcgaagtcaaacgccgcatcatgatcggcacttatgtactgtcgcacggctactacgatgcctactatctcaaagcccaaaaactgcgccgcctcgttgccgatgattttcagacggcatttgcacggtgcgacctcatcctcgcgccgaccgcacccactgcagccccaaaaatcggagcggatgcttcgccggttgaaacctacttgagcgatatctacaccatcgccgtcaacctcgccggactgcccgcattgaccctgcccgcaggcttcagcggcggcggactgcccgtcggcgttcagcttgtcggcaactacttcgccgaagccaaaatcctcggtgcggcgcatcaaatccaactcaacagcgattggcacggcaaacgacccgaatga

SEQ ID NO: 5413 - DNA, 933 bp, Neisseria meningitidis
atgaagcagaaccgcacctttaccttccccgattttcgcaccgtttacagctatgcgcctttatatcggctgcaacatttaaaatacacattgcgaaaatttttcggaaaaaaagaaatttacgccttcgagcagtttgtcaacgcatcccctatccgtcaggggctgttcctccactgcccgcaaaatgcctatccgctgctgcgcgaatttgttgacaggcgttttaactgcaaacgccgtttagatgcgatgacggcagattttctcatggcggaaaaactgttcggcacagacatcctgcaccaaatggaagactaccgcttccatttggtcttggcgcacctttcagacggcatcagcttgtggctcaaccgcaacgacaactgcgtcgaagaaggcgcgtggtctttatctttgcgcgacgaagcaggcaaccggctgtatatggcgactttcgcctttgtcggcacacacctgctgacagcctccgtacaagggccggcgggtgaagaagccaaagacaccgtccgccgcataaccaaacaactccacggcttgcgtccccaacaactgatggtaaccgccctgcaatatttcgccgccgtactcggcttggacggcgcaatgggcattgcacaaaaacatcaggtcaaactgcgctggaaacttaaaaagcgcgtcaaaatgaattacgacgcattctggcaggaatacggcgcaagtttggaacgggacggctactggcatctcccccaaacccccgcccgcaaagaccttgccgacatcgaaagcaaaaagcgttcgatgtaccgcaagcgttatgaaatgctggacaatatggttgcagagatgaaagacagtctgaaaacagaagcacgcggcatttcagacggcatccaaacggaaaaaccgccccgccggacagcctga

SEQ ID NO: 5414 - DNA, 1431 bp, Neisseria meningitidis
atgacctgggaaaccgtaatcggcttggaaatccacgtccaattgaacaccaaatccaaaatcttcagcggcgcatcgaccgcattcggcgcagaacccaacgcgcacgccagcgtagtggaatgcgcgctgccgggcgttttgcctgtgatgaaccgtgaagtcgttgaaaaagccatcaaattgggtttggctttagatgcgaaaatcaatcagaaaaacgtgttcgaccgcaaaaactacttctatcccgacttaccaaaaggttatcaaatcagccagttggacttaccgattgtcgaacacggcaaattggaaatcgtagtcggcgacgatgtgaaaaccatcaacgtaacccgtgcgcacatggaagaagacgcaggcaagtccgtgcatgaaggcttgaacggcgcaaccggtatcgacctgaaccgcgccggcacgccgctgttggaagtggtatccgaacctgaaatgcgttccgccgccgaagccgttgcctacgccaaggccttgcacagcttggtaacctggctggacatttgcgacggcaatatggcggaaggctcgttccgcgtcgatgccaacgtatccgtgcgcccgaaaggtcaagaagagttcggcacgcgccgcgagattaaaaacctcaattccttccgtttcttggagcaggcgattaattacgaagcggaagcgcaaatcgagattttggaagacggcggcaaagtacagcaggcaaccatgctgtttgatcccgaaaaaggcgaaacccgcgtaatgcgcctgaaagaagatgcgcacgactaccgctacttccccgaccctgatttgctgcccgttatcatttcagacgcccaaatgcaaaaagccaaagcagaaatgcccgagctgccgaaagaaatggcagcgcgtttcgtggcggattacggcgtgtccgaatacgacgcgcgcctgctgaccgcaagccgtgcgcaggctgcctattttgaagaagccgccaaagaaagcggacaaggcaagctgactgccaactggatgaacggcgaacttgccgccgcgctgaacaaagaaggcatggaacttgccgacagcccgattaccgccccgcgcctcgccgcgctggttggcaaaatcgccgacggcacattaagcagcaagttagcgaaaaaagcctttgaagccatgtgggcagaacccgaagccaccattgccgaaatcattgaaaaacacggtttgcaacagatgaccgacaccggcgagattgaagccatggtggacgaagtgctggcaaacaacgccaaagccgtggaacagtttaaatccggcaacgaaaaagccctgaatgcgattgtgggacaagtgatgaaggccagcaaaggcaaagccaaccccgcgcaggttcaagagctgattaaagccaaactggcttaa

SEQ ID NO: 5415 - DNA, 1011 bp, Neisseria meningitidis
atgaaccacaccgttaccctgcccgaccaaaccacctttgccgccaacgacggcgaaaccgttttgaccgctgccgcccgtcaaaacctcaacctgccccattcctgcaaaagcggtgtctgcggacaatgcaaagccgaactggtcagcggcgatattcaaatgggcggacactcggaacaggctttatccgaagcagaaaaagcgcaaggcaagattttgatgtgctgcaccactgcgcaaagcgatatcaacatcaacatccccggctacaaagccgatgccctacccgtccgcaccctgcccgcacgcatcgaaagtattattttcaaacacgatgtcgccctcctgaaacttgccctgcccaaagccccgccgtttgccttctacgccgggcaatacattgatttactgctgccgggcaacgtcagccgcagctactccatcgccaatttacccgaccaagaaggcattttggaactgcacatccgcaggcacgaaaacggtgtctgctcggaaatgattttcggcagcgaacccaaagtcaaagaaaaaggcatcgtccgcgttaaaggcccgctcggttcgtttaccttgcaggaagacagcggcaaacccgtcatcctgctggcaaccggcacaggctacgcccccatccgcagcatcctgctcgaccttatccgccaaggcagcaaccgcgccgtccatttctactggggcgcgcgtcatcaggatgatttgtatgccctcgaagaagcacaagggttggcatgccgtctgaaaaacgcctgcttcacccccgtattgtcccgccccggagagggctggcagggaagaaatggtcacgtacaagacatcgcggcacaagaccaccccgacctgtcggaatacgaagtatttgcctgcggttctccggccatgaccgaacaaacaaagaatctgtttgtgcaacagcataagctgccggaaaacttgtttttctccgacgcattcacgccgtccgcatcataa

SEQ ID NO: 5416 - DNA, 633 bp, Neisseria meningitidis
atggatttgcacaatattcgggaagattacagcaaacgggaattgtcggaagccgattgcgccgataatccgatcgagcagttcgagcggtggttggacgaggcggtacgcgcacaggtcaacgagccgacggcggtcaatgtggcggcggttgacggacgcggcaggcccaacagccgtatggtgctgctgaaggaagttaattctgaaggttttgttttctttacgaattatcacagccgcaaggggcgttcgctggatgctcatccatttgcggcgatgacgtttttttggccggagctggagcgtcaggtgcgcgtggaagggcgtgttgaaaggctggcggagaagttgtcggacgaatattttgagagtcgcccgtatcagagccgtttgggtgcgtgggcaagtgcgcagagcgaggttattccgaacaaggcggtattggtggcaaaggcggcggcggttggactcaaacatcctctgcatgtgccgcgtccgccgcattggggcggctatattgtgattcccgatttgcttgagttctggcagggcagaccgagcaggctgcacgaccgcatccaataccgtttgctggatggtggctggatacgcgagcggctgtcgccttga

SEQ ID NO: 5417 - DNA, 1053 bp, Neisseria meningitidis
atgatgtccaaacagcccaccagcaaacgccaatggcgcgacggcgcagccccgtctgccaagaaaaccgccaaaccgttcaaaagcaaagcccgtcccaaagatgaaacgggcaaaaccgcttcccaaccttacggacaaaaagcttcagacggcatcaaacctcaaaacgtccccaaacagcgcgccgccaaagccaaaaaactcgtcgtccgcaatcccaaccaaaaaattatggaacacgcgcgcgatttgaaagaacgccgcagcgacctgtcgcgcatggaacccgaacgcctgcaaaaagtgcttgccgcgtccggcgtcggctcgcgccgcgaaatggaagaatggattaccaacggctggataacggtcaacggcaaaaccgcgcaactgggcgacaaagttacccccgacgaccacgttaccgtcaaaggcagcatcatcaagctcaaatgggcggaccgcctgccgcgcatcatcctgtattacaaacaagaaggcgaaatcgtttcccgtgacgacccgcaaggccgcgtcagcatattcgaccgcctgccgcaggccgccagcagccgctgggtcgccatcggacgcttggacatcaacaccagcggacttctgattcttaccacctccggcgaactcgtccaacgtttcgcccaccccagcttcgaagtcgaacgcgaatacgccgtgcgcgtcttgggcgggctgaccggcgaacaaatgcgcgtcctcaccgaagaaggcgtgatgctcgaagacggcttggcaaaagtcgaacgcatccgcgaacaaggcggcgaaggcgcgaacaaatggtacaacgtcgtgattaaagaaggccgcaaccgcgaagtgcgccgcatttttgaaagccaaggactcaccgtcagccgcctcgtgcgcatcggcttcggtcccatcggactgcccaaccgcctcaaacgcgggcagttctacgaactcaaccccgccgaagtcgccaacatcatcaaatgggcggacatgctgctgccgggcgaacgccgccgcaaaaaagcctaa

SEQ ID NO: 5418 - DNA, 1542 bp, Neisseria meningitidis
atgaagtttttagaccgtgaggcaagcattgccaagccgggtttcaaccgttggctcgtaccgcccgcagcattggcggtacaccttgccatcgggcagatttacgcctattccgtattcaacgcgccgctgaccaaacttatcggcataaccgaatcggcggccggagattggaagctgacgaccgtaggttggattttcagtatcgcactcgcgatgctgggcgcgtcggccgccctgttcggtacgtggatggaacgggtagggccgcgcaaagccatatttgccgccgcctgctgcttcagcctgggcttcttcgtatccgcattcggcgtgcgtacgcacaacctcttcctgctctatttgggcaacggcgtcatcggcggcgtaggcttgggtttgggctacatcgggccggtttccacactgatgaaatggtttcccgacaagccgggtatggcgaccggtttggcgattatgggtttcggtggcggcgcaatgctggcctcgccgctttccgtatcactgatgaacaccttttcaaacgctgcttcggtcggggttgccgaaaccttcgccgtattgggtctgctttacctcgcactgatgatgttcggcgcgtttaccatccgcgtacctgccgacggctggaaacctgaaggctataccgcgccgaaaacgcaaaacaagctggtcagcagcaatcatgtcaacgtgtcccaagccatgaaaacgccgcagttttggctgttgttctgggtattgtgcctgaacgtaactgccggcatcggcgtattgggtcaggcatccgtgatgattcaggaactcttttccgaaacctccataggcaggcaggcagcagtcggcgcaggtgcggcggcaggcttcgtcagcctcctgagcctgtttaacatgggcggacgctttttgtggtcgagcgtttccgacaaaatcggacgcaaaaacacctacaccatcttcttcgtactcggttcgctgctgtatttcgccgttccctccatcggcgagggcggcagcaaagccctgttcatcatcggcttttgcgtgattatttccatgtacggcggcggatttgccgccattcccgcctacctgaaagacctgttcggcacctatcaggtcggcgcgattcacggacgcatcctgctggcctggtcaaccgccgccgtcatcggcccggtactggtcaattacatacgccaaagccaaatcgacagcggcataccggcggcacaggcatacagcgtaaccatgtacatcatggcgtgcctgctgattatcggtttgttgtgcaacctcgccgtcaaatccgtacacgaaaaacaccacgaaaaagacatcaaaaccgccgcacacagcggcaaccccgatgacgaaaccgccatatccgacgcttaccttgtgggcgaaaaagtttccggcggcggcatatcggtctggtggcgttgggcattggccgtcataccgctcgcctacggcgtggtgatggtctttgtcaaagcactcgaccttttctcctga

SEQ ID NO: 5419 - DNA, 1356 bp, Neisseria meningitidis
atgtctgatttttttcattctgacgtgttgtccgtttccgagttgaacgcatttgccaaaagtcttttggaaaaccaccttgccggtttgtggattgccggcgaagtatccaacctgacccgtgccgccagcgggcattattatttctcgctcaaagacagccgcgcacaggtgcgttgcgcgatgttcaagggtgcggcggtgcgtttggcgaagcctttgaaagaaggcgaccatatcgaggtatcaggaaaaatcagtatttatgaagcgcggggcgaatttcagattaccgtaaacgaagtacggctcaaaggtttggggcagctttacgaagcctatgagcggttgaaggcgcagttgcaggcggaaggcgcgtttgcggcggaacgcaagaaacctttgcccgtccgtccgcaatgtatcggcatcgtaaccagtctggcggcggcggctttgcgcgatgtcgttactaccttgaaacgccgcgcacccgaaatccccgttatcgtttatccgacacccgttcaaggcgcaggcagcgaattgcaaattgcccaagcgattaaaaccgcctcgcaacgcgccgaatgcgatgtgttgattgtctgtcgcggcggcggcagcattgaagacttgtgggcgtttaacgaagaaccggtcgtgcgcgccatcgaatcctgcacggttccggtcgtcagcggcgtaggccacgaaaccgatttcacgctcgccgatttcgtcgccgatatgcgcgcgcccacgccgaccggtgcggcggaactggtcagccccaaccgccaagaatcgctgcaccgcctcgcccaagcccaatgccgtctgaaaaccgttttggaacaacgctatttcgatgccagccaaaaactcgactggctggcgcggcaaatccgtcatccgcgccaaaaactcgacgaacagcgcgcttcaatcggcaagctggcgcaaacgctgtcttactcgatgacgcaaaacgtccgtacccacaccgcccgtttcgaacgccaaacccaagccctgaaacattgccgtcctgatgtttccgtttgcaaaaaaaacatcgaccgctttcagacggccctgtcgcacgccttccaccaactgcttacccaccgccgccaaagcctgactgcccaagccgcattgctcgaagccgtttcgccgcagcacattctggagcgcggcttttccgtcgtcaaaaacacacgcggacaagtcatccgcaacgccgatgttttgaagcaggggcagaagctgcacattatcttcgccgacggcgaaaccgacgtgcgcgtaagcaaagaacaagggcagcaggatttgttcgattgcatttaa

SEQ ID NO: 5420 - DNA, 822 bp, Neisseria meningitidis
atgatgcggatattttcgacaggaggaaaaatggatacgcaggcagttatcacacatatcgcccgatggttggacgaatacgccgcccgggcaaatgcaaaagggtttgtcgtgggcgtttccggcggcatcgattccgccgtcgtctccgcactcgccgcccgcaccggccgccccacgctgcttctggatatgccgatacgccaacaccccggccagcttgagcgggcaaggctgcacatccgcaatctgcaacggcaatatgccaatgtaagcgcgcaaacggtcgatctgaccgacaccttccagacctttgaacaaaccgtcggtgctcatcagacggcatttgacagtcagccgctttccctcgccaacgccagaagccgcctacgtatgctgaccctgtactactacgggcagatacacggactgctggttacggggacaggtaataagattgaagatttcggcgtgggcttttttactaaatacggcgacggcggcgtggacatcagcccgattgccgacctgaccaaaacgcaggtttaccggcttgccgaagcattgggcgtggacgaggcgattcaaaaagccccgccgaccgacggcctgtgggatacggaacgcaccgacgaagaacagatgggcgcaagctatcccgaactggagtgggcaatgggcgtgtacggcacgcgcaaacccgaagattttgaagggcggcagcgcgaagttctagaaatctatacgcgacttcaccgcgccatgcagcacaaaatcaacccgattcccgtatgccgcattccgcccgaattgctgggctga

SEQ ID NO: 5421 - DNA, 474 bp, Neisseria meningitidis
atgactgatttttccgtttgggagaccgccccctttggtgcaaccgtcgatcatatcctgcaacgctaccacaatgtccaccgtgcacaatttgaagaattggtgccgctggcgcaaaaagtggcccaagttcatgccgacacctttccggcggaaattgccgagctgcttgcctatatgcagaacgaactgctgatgcatatgatgaaagaggaaaggatgctgtttccgatgattaatcagggtgtcggacgcggtgcggcgatgcccatcggcgtgatgatgcacgaacacgaagaacacgaccgcgccatcgcacggctcaaagagctgaccgacaatttccaaccgccagaaggggcttgcggaagctggacgcggctttacgcgctggcgaaagaaatggtggaggatttgaacgaccacattcatttggaaaacgatattttgtttgcccgcgtactcgattcttaa

SEQ ID NO: 5422 - DNA, 333 bp, Neisseria meningitidis
atgagcagcgaattgattgtacacaccagcgatgccgcttttgaaaaagacgttttaaatgcagatatccccgtcctgctggacttttgggctccgtggtgcggcccctgcaaaatgattgccccgattttggacgacattgccgccgaatttgaaggccgtctgaaagtggtcaaaatcaacatcgacgacaacgaagccaccccgtcccgtttcggcgtgcgcggcattccgaccctgatggtgttcaaaaacggcgaagtcgtcgccaccaaagtcggcgcattggcaaaaggtcagctgaccgcctttgtcgaagcctctatcgcctga

SEQ ID NO: 5423 - DNA, 1065 bp, Neisseria meningitidis
atggcttcgtatgacaagataagcgacggatggtatagggtttgcccgaaacggtcaagcaatcgggcgttaattacagtaaaattgccgttttccactttattccgcctgaaaccaatgaccgacatcacaccgtttgccaaccgcttgggcaaaaacatcaaacaccttatgaaatgggcgaaacgcaacggcatcgaagcctggcgcatttacgaccgcgacatcccccaattcccctttgccgccgatgtttacggcgatcgaatccaccttcaggaatacgataccggctggctgatgcggcccgaagaatacgaagcgtggcttgccgaagtcttggaagccgtcgctttcgttaccggttttgcgcccgaacaaatccgcctcaaacgccgcgaacgccaaaaaggtttgcagcagtacgagaaaaccggcaaggcgggcgacgatttcgtcatcaccgaaaacggccgcaagttttgggtcaaccttgataagtatttggatacggggctttttttggatcatcgaaacacgcgcaaaaaagtcggcgaaacggcggcgggcaaacgttttttaaacctgttttcctacaccggcagcttcaccgtctatgccgccaccggcggcgcggcatccagcgaaaccgtcgatttgtccaacacatatcttgattgggcgaaacgcaattttgaattgaacggcatcgatacggaacgacacaaaatcgtccgcgccgacgtgttccaatatcttcagacggcatatggggaaggcaggcggttcgacctcattgtgatggacccgcccagtttttccaacagcaagaaaatgtccgacatcctcgacatccagcgcgaccacaaaaagctgattgacggcgcggtgaagctgctcgcttcagacggcattttgtacttttccaacaacctgcgcagcttcgtcttagacgacttggtatcggaacaatacgccgtcaaagacatttccaaacaatccgttcccgaagatttccgcaacaaaaaaatccataggtgctgggaaatccgccacaaatcttaa

SEQ ID NO: 5424 - DNA, 1389 bp, Neisseria meningitidis
atgtctattaaatttgccgatttgaaccttgataaaaacattttgtccgccgtcagcagcgagggttacgaaagcccgacgccgattcaggcgcaagccattccgtttgctttggaaggccgcgacatcatggcttcggcgcaaaccggctccggcaaaaccgccgcctttctgttaccgactttgcaaaaactgaccaaacgcagcgaaaaaccgggcaaaggcccgcgtgctttggtgttgaccccgacccgcgaactggcggctcaagtcgagaaaaacgcgctggcgtatgccaaaaatatgcgttggttccgcaccgtcagcatcgtcggcggcgcgtctttcggctaccaaacccgtgccctgagcaaaccggtcgatctgattgtcgccacgccgggccgtctgatggacctgatgcaaagcggcaaagttgattttgaacgtttggaagtgctgattttggacgaagccgaccgtatgttggatatgggctttatcgacgacatcgaaaccatcgtggaagcaacgccgagcgaccgtcagactttgttgttctccgccacttgggacggcgcggtcggcaaactggcgcgcaaactgaccaaagaccctgaaatcatcgaagtcgaacgcgtggacgatcaaggcaaaatcgaagaacaactgctgtactgcgacgatatgcgccacaaaaaccgcctgctcgatcatatcttgcgcgatgccaatatcgatcaatgcgtgattttcacgtccaccaaagccatgaccgaagtcattgcggatgaactgtacgaaaaaggtttcgccgcaaactgcctgcacggcgatatgccgcaaggctggcgcaaccgcacgctgatggatttgcgtaaaggccgctgcaaaattttggttgccaccgatgttgccgcacgcggtatcgacgtaccgaccattacccacgttatcaactacgacctgccgaaacaggcggaagactacgtccaccgcatcgggcgcaccggccgcgcaggccgcacgggtattgcgattacgtttgccgaagtgaacgaatacgtcaaagtccacaaaatcgaaaaatacattaaccgaaaactgcccgaactgaccatcgaaggcatggaaccgacccgcaaacgcaaatccgcaggcggcaagccgaaaggcaaaggcggctggggcgatcgtaaatccggcggttggcgcggcgatcataaaccgagcaaagaaggcttcggcggcaaaacgcgcggcgaaggtttcaagaaagaaggctttaagagagacggtttcaaaaaaaccggcgaaggcttcaaaggcaaacgcaaagccggcgattcttttgcaggcaaaggcgaacgccgttacaaagaccgctaa

SEQ ID NO: 5425 - DNA, 555 bp, Neisseria meningitidis
atgaaaaaaatcatcgcctccgcgcttatcgcaacattcgcactcgccgcctgccaagacgacacgcaggcgcggctcgaacagcagcagaaacagattgaagccctgcaacagcagctcgcacagcaggcagacgatacggtttaccaactgactcccgaagcagtcaaagacaccattcctgccgaagcacaggcaaacggcaacaacgggcaacccgttaccggtaaagacgggcagcagtatatttacgaccaatcgacaggaagctggctgctgcaaagcctggtcggcgcggcggcaggcgcgtttatcggcaacgcgctggcaaacaaattcacacgggcaggcaaccaagacagtcccgtcgcccggcgcgcgcgtgcagcctaccatcagtccgcacgccccaatgcgcgcaccagcagggatttgaacacgcgcagcctccgtgcaaaacaacaggcggcgcaggcgcagcgttaccgcccgacaacgcgcccgcccgccaattaccgccgccccgctatgcgcggtttcggcaggaggcggtaa

SEQ ID NO: 5426 - DNA, 561 bp, Neisseria meningitidis
ttgttaccttcacacaggtcgcccgattcggcaacacacgacagaatcaggaaaatgaccatgaatgcaatgccccaaaccgccgcacaaaacgaaaccctgcacacttgtagcattattgtcgatgatgcacaggatttttcccccatgcttctcgatgcagggcgggacgacacacttatcagcgaatcgatgattccgcaaatccgcaccgttgccgccctgatagccgccgaacggcacgacttcagccgcagcagccccgccgagtttaccgatgccgccgatttttttgccgcacggattctcgtattgggcgtgcgacgcttccatctggacgtatcgctgcttcagattttgaaaaccgccaacagccgcgcccgccgctttgccgaaaaacaccgcctgtttttcacacccgcacaagccgaattgagcctgaacaaacacaaaaaccgccgcctgctgaccgtagaaaccgaacacgaagtcgaaaacaaaggcaacccagtcgccaacagcctcgcatttgtccgcaaattgcacaccctgcccctgtaa

SEQ ID NO: 5427 - DNA, 1197 bp, Neisseria meningitidis
atgcaaaactatctgacccccaatttcgcctttgccccgatgattcccgaacgcgcttcaggcagccgcgtttgggatacgaaagggcgtgaatatattgatttttcaggcggtatcgccgtcaatgcgctgggacactgccaccctgcccttgtcgatgctttaaacgcgcagatgcacaagctgtggcacatttccaatatctatacgacgcgtccagcgcaggaattggcgcaaaaattggttgcaaacagttttgccgacaaggtttttttctgcaactcgggctcggaagcgaatgaggcggcgttgaagctggcgaggaaatacgcccgcgaccgtttcggcggaggaaaaagcgaaatcgtcgcctgtatcaacagttttcacggacgcacgctgtttaccgtgtccgtcggcggtcagccgaaatacagcaaggattatgcacccctgccgcaaggcattacgcacgttccgttcaacgatattgccgcgctggaagctgccgtcggcgaacagacctgcgcggtcatcatcgagccgatacagggcgaaagcggcatcctgcccgccactgcggaatatttgcaaaccgcgcgccgtctgtgcgaccggcacaatgcgttgttgattttggacgaagttcaaaccgggatggggcatacgggcaggctgtttgcctatgaacattacggcattgttcccgatattttgagttcggcaaaagccttgggctgcggctttccgatcggcgcgatgctggcgacagaaaagattgccgccgccttccaaccgggcacgcacggctcgactttcggcggcaacccgatggcgtgtgcggtcggcagccgcgcattcgacatcatcaatacgcccgaaactttaaaccatgtccgtgaacaggggcagaaacttcagacggcattgctggatttgtgcaggaaaacgggcttgttctcacaagttcgcgggatggggctgctactcggctgcgtgttggacgaagcctatcgcggacgcgcatccgaaatcaccgccgccgccttgaaacacggcgtgatgattttggttgcgggtgcggacgtattgcgtttcgcgccttcgctactgttgaacgatgaggatatggcggaaggtttgcgacgtttggaacacgcgctgacggaatttgccgcgacatcagacaatccgtaa

SEQ ID NO: 5428 - DNA, 1245 bp, Neisseria meningitidis
atgtccaacgaaaaccgtacttgttccttttgcggaaaatccaaatcacacgtcaaacatttaattgagggcgaaaacgcctttatctgtgacgaatgcgtctcaaactgtattgaaatattgcatgaagacggaaatgacggcacgccttcggaaagtgccggaggggagccggaagaatccggcaagctgcccacgcccgccgaaatcgtcgccaacctcaacgaccacgttatcggtcaggaacaagccaagaaagccttggcggtgtcggtgtacaaccattacaaacgcctgcgccatcctaaagcaggagctaatgtcgaattgtcgaaatccaacatcctgcttatcggcccgaccggatcgggtaaaaccctgctggcgcaatctttggcgcgcaaactggatgtgccgttcgtgatggcggatgccacaactttgactgaagcaggttatgtcggcgaagacgtcgagcaaatcattaccaagcttttgggcaaatgtgatttcgatgtcgaaaaagcccagcgcggcattgtctatatcgacgaaatcgataaaatttcacgcaaaagcgacaacccgtcgattacccgcgacgtatccggcgaaggtgtgcaacaagccttgttgaaactgattgaaggtacagtggccagcgttccgccccaaggcggccgcaagcatccgaatcaggaatttatcaacgtcgataccaccaacatcctgtttatctgcggcggcgcgtttgcaggcttggaaaaagtcatccgccagcgtactgaaaaaggcggtatcggtttcggtgcgtccgttcacagcaaggacgaaaatgccgacattaccaagctgttcggcatcgtcgaaccggaagacttgattaaattcggtctgattccagaattaatcggacgtttgcctgtgattgcaactttagaagaattggacgaagacgcgctgattaatattttgaccgagccgaaaaatgctttggtcaagcagtatcaggcgttgttcggtatggaaaatgtcgaactggagtttgaagaaggcgcattgcgttccatcgcgcgtcaggcaatggaacgcaaaaccggcgcgcgcggcctgaggtccatcgtcgaacgctgcctgctcgatacgatgtaccgcctgcctgatttgaaaggcttgaaaaaagtggtggtcggtaaggcagtcatcgaagagggcagggaaccggaattggtgttcgagtcctga

SEQ ID NO: 5429 - DNA, 372 bp, Neisseria meningitidis
atgagaaaaccccaacgcggctatgcccgccaagaccgtgtcaaagaacaaattatgcgcgagcttgccgaactcgtccgtaccggactgaaagacccgcgcgccggcttcattaccgtcaacgaagtcgaagttacccgcgattacagccacgccaccgtgttctacaccattttaaaccaagacgcgcgcgaaattacggaagaagtgctggaacacgcgcgcggacacctccgcagcgaattggccaaacgcatcaagctgttcaaaacgcccgaactgcatttcaaatacgacgaatctttggaacgcggtttgaacctgtccgcccttatcgaccaagtagcggcggaaaaaccggttgaagactga

SEQ ID NO: 5430 - DNA, 924 bp, Neisseria meningitidis
atgaatacaggcaaaccccaaaaacgtgccgtcaacggtgttttgctcttggacaaacccgaaggcctttccagcaacaccgcgctgcaaaaagcgcggcgtttgtttcatgccgaaaaagccggacataccggcgtgctcgaccctttggcaaccggacttttgcccgtctgcttcggtgaagcgaccaagttcgcccaatacctgctggatgccgacaaagcctacaccgccacgctgaaactcggcgaagccagcagcacgggtgatgccgaaggcgaaatcattgccaccgcccgcgccgatatttccttagccgaatttcagacggcctgccaagcactgacaggcaacatccgccaagtgccgccaatgttttccgcgctcaagcacgaaggcaaaccgctgtacgaatacgcccgcaaaggcatcgtcatcgaacgcaaagcgcgctacattaccgtttacgccatcgatattgccgaatttgacgcgcccaaagccgtcatcgacgtacgttgcagcaaaggcacctacatccgcaccctcagcgaagacatcgccaaacacatcggcacgttcgcccacctgaccgccctgcgccgcactgaaaccgccggctttaccatcgcccaaagccacacgcttgaggccttggcaaatttgaacgaaacagaacgcgacagcttgctgctaccctgcgacgtattggtttcacactttccccaaaccgttttaaacgattatgccgtccatatgctccactgcggacaacgtccgcgtttcgaagaagacctgccttccgacacgccggtacgcgtttacacggaaaacggccgctttgtcggtctggcggaatatcaaaaagaaatatgccgtctgaaagccttgcgcctgatgaacacggcggcatccgccgcctga

SEQ ID NO: 5431 - DNA, 2110 bp, Neisseria meningitidis
atgaagacagacattcaaaccgaattaacccaagccctactaccacacgaaaaagtatgggcgaacgaagaaaaaaccattttagccaaaaacatcctgttggatttggtggaaaaaaccgacccgaccattatcggtttgttattgagtaatgatgagttaaaacgccatttctttgtggaagtgaatggtgtgctggtgtttaaattgcaggatttccgttttttcttggacaaacacagcgtcaataattcctacacaaaatacgccaaccgcattggtttgacggacagcaaccgctttttgaaagacagcagtgatattgtgttggattttccgtttaaagattgtgtgttaaatggcggacaaagcaccgaggaaggcgaagaaatttattttaaacgcaataacagccagccagccagccagccagccagccagccagccagccagccagccagccagccagccagccagccagccagccagccaattatacactaaattaacccgaaaaagacaagaaatcttttttaatcaaacccttgcttttgatgaaattgatcggctttttgacgcaaaagcattctcaaaattctctcgctataccgcagacggcaaacaagccgttggcgaaatcaaacgacattcagacggcacacccgccgaaaatctcattatcaaaggcaataatctgattgccctgcattcgcttgccaagcagtttaaaggcaaagtgaagctgatttatattgacccgccatataacacgggtaatgacggttttaaatacaacgacaaatttaatcattccacttggctgacttttatgaaaaaccgtctagaaatcgccaaagagctgcttatgaaagacggttcgatttttgtgtcaattgacgacaacgaacaggcatatttgaaaattttaatggatgaagttttcggaaatgaaaatttcatctgcaattttatttgggaaaaaaagacaggtgcgtccgatgccaaacagatagcgactattacagagtttgtcttatgttactcaaagaactttaaaacagttaaattaaataaaaacacgttttcttatgatacagagagatacaaattaagtgataagtttgaacaggaaagaggcaaatattatatcgacaatttagatagagggggattgcagtatagtgacagtttgaattttgcaatccaatgtccagatggcacttttacgtatccgaatggcaggactgaatttgtcaatgatggctggatatggaaatggagtaaaaataaaattgattgggcaataacaaacggttttttggagtttagaaaatcaaagtctaaaaaatctggatggagtgtatgttataaaaactatatgttggttgataacgaaaacaagccgatagaacgttctgctccctataagaacttaatacaggatatcttaaatacacatgcgacagatgaattgaaaaaactgttcggcagcaaagtttttactactccaaaacctgagagcttattgcagtatcttattcaaattgccacatccgaatccgacatcgtcttagactaccatcttggtagtggcacaaccgccgccgttgcccacaaaatgaaccgccaatatatcggtattgaacaaatggattatattgaaacgcttgctgttgaacgcttgaaaaaagtgattgatggcgagcaaggcggtatttccaaagccgtgaattggcaaggtggtggcgagtttgtttatgccgaacttgccccatttaacgaaaccgcaaaacaacaaattttggcttgcgaagattcagacggcatcaaaacgctgtttgaaggtttatgcgaacgctatttcttgaaatacaacgtcagcgtaaatgaatttagtcaaatcattcaagagcctgaatttcaatctttgccattagacgaacaaaaacaaatggtgcttgaaatgttggatttaaatcaaatgtatgtttcattatccgaaatggatgacgaacaatttgcagattgcctgaacgatgatgataaagccttaagccgtgcattctatcaatcagtaaaaaatcaagcggagaaaaaagatggcgaataa

SEQ ID NO: 5432 - DNA, 2778 bp, Neisseria meningitidis
atggcgaataataaaacgttgtttgaagtgattgaaaatgaacgtaaagcggttaaaaaatacaagcctgaattacttgaaatgccagaatttacgtccaaaaacttaaaatatgatttttttgaatggcaaaaatctgcccttgaaaactttttgatttttgaccgcacttcaaagctagacgatttccctgatttaaaaaataagccaacgcatttgctgttcaatatggcaacaggtgctggcaaaacgatgatgatggcggcgttgattttgtattattttgaaaaaggttatcggcattttctgttttttgtgaatcaaaacaatatcgtggataaaacggaaaataattttaccgatccgacgcacgcaaaatttttatttaccgagaagattttgcagggcgatacggtaattcctattcgcaaagtggagacatttagcccacattcagacggcattgaaattaaatttaccagcattcaaaagctgtataacgatattcgcacccggcgggaaaatcaaaccacattggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgccgatgtacaacaaaaatacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaaaattatcaaaaacacaatgtgattattaccaactccgaaaccaacaaaaccaaaaccgaaaaaaccgacagcgaaacagaaaaattgctgaataatttggaagcggctgataatccgattcgtgccatttttacggtggacagattaaccgaaggttgggacgttctgaatttgtttgatattgtgcgtttgtatgaagggcaaaacggcggcggttcaaataaaaaatcaggcaaaacggctgccgctactgtatcggaaaagcagttgattggtcgcggcgtgcgttattttccatttgcgtttgaaggtaaacagccgaataaacgcaaatttgacaacgatatgcaacacgaattgcgtattttggaagaattgttttattacacgcacgatgagcaatctcgctatattacagaactgaaaaacgagttacgaaaagacggttatttgcctgaaaaagacgatgataaggtattggcaacatttaaactcaaatctgaatttgccgataatcaggattttagagagttgttaatttgggcaaataaaaaaatccccaatcccaatgccagagccaataatgcagacagcctgaaagccaatccgcaaacgcttccattccaagttcacggcaatcaactgttgcaggaaacgcaatttacagccgatgaaaatgatgaaatagcccgacaaatcgacacacaaaataattttactcaaatcataaaaatgagtgaaatggaacggcacattttcaataaatccctgcatatcaaaggaaaaaatggtcaatctttattccattttgaccgcttgcaaagcaaactcaacatttacaatcgcaatgaattgcaaaataacttgttaaaagattgacaaattgaatttttgggattagggcaagacaaacagatcagcccagatgacaaacttgcaggctgcctaaaaatcttggaaatggttgaaaaacatttgaatgaaagtgatatgccatttatcggtacaaaagaatttacgcctaaaaaattgtgggaaatttttggcacaccaaaacaaaaatgggtcaaaaaagatgatataaaaactgccattgccacgcaaaatgattggtatgtgatggataattttgctggaacgagtttggaagaagcgttaattcaatttatttcagagcatttgggcgatttgaagtctaaatatgatgttcatttaatccgtaatgaagaagtgtttaaattgaataacttttccgatggtgaaggatttatgccggactttattttattgctgaaaaataaacaaaaatcttcttccaatggtgtggatgactttttgcattaccaaattttcattgaaccaaaaggtgagcatttggtggaaaatgattcgtggaaagacgcttttttaaaggcaattacagcggaatacgggacggataagattctgcaaaaagatacaccgcattatcgtttgatcggtttgccgttttttactgacaatcaggaaaatgaacaatttacaaagtcattccctttaggggcggcatcgcttgaaaaatag

SEQ ID NO: 5433 - DNA, 1173 bp, Neisseria meningitidis
atgaaacgtgatttgagcaaaatgacctgcatcgaagacttgcgccgcgttgccaagcgcaaaatgccgcgtatgttttacgattacatcgattcgggttcgtggacagaaactacctaccgtgaaaacacttcggatttcaaagacatccgcttccgtcaaaaagtattggtcaatatggaaggccgaagcctggaaaccaaaatgatcgggcaggatgtgaaaatgccggtggcgattgcgccgacgggtttcacgggtatggcacacgccgacggtgaaattttggcggcgcgggcggcggagaagttcggcattccgtttacgctgtccacgatgtctatctgctcgattgaagacgttgccgagaacacttccgcaccattttggtttcagctttatgtgatgcgcgaccgcgagtttatggaaaacctgattaagcgcgcgaaggatgccaaatgttcggcattggtattgaccgctgatttgcaggttttggggcaacgccacaaagacatcaaaaacggcctgtccgcgccgccgaaaccgaccatcgccaatttaatcaatctggcgaccaagcccgaatggtgtatgaaaatgctgaacacggaacgccgcacgttccgcaatatcgtcggacacgcgaagaacgtcggcgatttgtcttcgctgtcttcatggacttccgaacaattcgacccgcgcctgagctgggacgatgtggcgcgcattaaagatttgtggggcggcaagctgattatcaaaggcattatggaacctgaagacgcggaaaaagcagcgaaaagcggcgcggacgcattgattgtttccaaccacggcggtcgacagctcgacgataccgtgtctgccatcaaagccttgcccgacatcgtcagcgcagtgggcagcgacatcgaagtttggatggacagcggcatccgcagcggtcaggatattttgaaggcgtgggctttgggcgcgaaaggtacaatgataggtcgggcgttcctgtatggcttgggcgcgtatggagaagaaggcgtaacccgtgcgctggaaatcctgtataaagaaatggatatatctatggcgtttacgggacaccgcgatattcaagatgtcgatgcttcgattttgagaggcaaagattggggcagggaaacggtttag

SEQ ID NO: 5434 - DNA, 447 bp, Neisseria meningitidis
atgagactgaccaccaaagggcgtttcgccgttaccgctatgctggatttggcgatgaacgcgcaaaccggcgccgtcaaactcagtgccatcagcgaacgccaaaacatatccctctcctatctcgagcaattgttcggcaaactccgccgcgccggacttgttgaaagcctgcgcgggcccggcggcggctacatcctcgccgcaccggcggcacgcatcaacatcgcccaaatcatcgccgccgccgaagaccggctggacgcaacccaatgcggcagcaaagccaactgccaccacggcgcgccctgcctgacgcacgatctttgggagaatttaaacaaaaccatcaacgactacctcggcagcgttaccctgcaaagcatcatcgaacagaaaaacaacggcgacggcagccgcgtcgtccaatttacacacatccattaa

SEQ ID NO: 5435 - DNA, 1215 bp, Neisseria meningitidis
atgaccgtcaaaacccccgtttacctcgactacgccgccaccccccccgttgacaaacgcgttgccgaaaaaatgattccctatctgaccgaaaccttcggcaacccagcctccaacagccacagcttcggctgggaagcagaagaagctgtagaaaaagcacgtgcagacattgccgccctgattaacgccgactctaaagaaatcgttttcaccagcggcgcaaccgagtccaacaacctcgctatcaaaggcgcggcgcacttctacaaatctaaaggtaatcacctcatcactgtaaaaaccgaacacaaagccgtactcgacaccatgcgcgaactcgaacgccaaggttacgaagtaacttatctggacgtacaagaaaacggtttggttgatttagacgtactgaaagccgccatccgcgaagacaccatcctcgtttccgtaatgtgggtaaacaacgaaatcggcgtggttcaagatattcctgccatcggcgaaatctgccgcgaacgcaaaatcattttccacgttgacgcagcacaagcatgcggcaaagtgcctgttgatgttgaagccgcaaaagttgatttgctgtctatgtccggccacaaagtatacggccctaaaggcatcggcgccctgtatgtacgccgtaaaccacgcgtccgcctcgaagcccaaatgcacggcggcggtcacgaacgcggtttccgttccggcacattgccgacccatcaaatcgtcggcatgggtgaagccttccgcattgccaaagaagaattggcacaagacactgcacactacctgaaactgcgcgatattttcctcaaaggtatcgaaggcatcgaagaagtctatatcaacggcgacctcgaacatcgcgtcccgaacaacctaaacgtcagcttcaacttcgtcgaaggcgaaagcctgattatggcagtgaaagaactcgccgtatccagcggctccgcctgcacctccgcctcgctcgaacccagctacgtcctgcgcgcgctcggccgcaacgatgaactggcgcactcatccctgcgcatcaccttcggtcgcatgaccaccgaagaagaagtgcaattcgccgccgaactgattaaatccaaaatcggcaaactgcgcgaactgtcgccgctgtgggaaatgttcaaagacgggattgatttgaactcgattgaatgggcagcgcattaa

SEQ ID NO: 5436 - DNA, 387 bp, Neisseria meningitidis
atggcatacagcgataaagtaatcgaccactatgaaaatccgcgcaacgtcggcacattcgacaagggagacgattccgtcggcaccggcatggtcggcgcgcccgcctgcggcgacgtcatgcgcctgcaaatcaaagtgaacgacgagggcatcatcgaagatgcgaaatttaaaacttacggctgcggctcggccatcgcttcgtccagcctgattaccgagtgggttaaaggcaaaagcctggatgacgcgctggcaatcaaaaacagcgaaatcgccgaggagttggaattgccgccggtaaaaatccactgctccatcttggctgaagatgcggtaaaagcggccgttgccgactaccgcaaacgtcaggaaaacagataa

SEQ ID NO: 5437 - DNA, 381 bp, Neisseria meningitidis
atgccgtccgaaccacccgccgcttcaggtccgtccggggcggtacaacaaggaagaaatatgattacccttaccgagaatgccgcaaaacacatcaatgactatctcgccaaacgcggcaaaggcttgggcgtacgcttgggtgtgaaaaccagcggctgctcggggatggcgtacaaccttgaatttgtcgacgaagccgatggcgacgacctgattttcgaaggacacggcgcgcgcatttatatcgatccgaaaagcctggtttatctggatggcacgcaagtcgattacaccaaagaaggtttgcaggaaggtttcaaatttgaaaaccccaatgtcaaagactcctgcggctgcggcgaaagcttccacgtttaa

SEQ ID NO: 5438 - DNA, 222 bp, Neisseria meningitidis
atgggcggcaaagtgcagcacaataaaggcaaaatacgcgacaatgctttaaaagccttagtgaaatccgatttgttccggcacaaggtggaacggaaaaggaaaggcaaaggcagctacaacaggcaggaagcgaaaaaatggcgggacggttttgatacggtcccgccgtttttatgccttaaacgtggaagctttcgccgcagccgcaggagtctttga

SEQ ID NO: 5439 - DNA, 501 bp, Neisseria meningitidis
atgtcccaatatttcaccctcttccggattgaacccgctttcgatatcgacaccgaaaacttggaacaaacctaccgcgccttggccgcccgtttccatcccgataaattcgcttcagcttccgcctttgagcaaaagcaggcagtgatgatgtcttccaccatcaacgatgcctaccgcaccttgaaaaaccccatcgaccgcgccgcctacctgctgaaaacatcgggcatcgatgccgacgcgccggagcataccgctttcgcccccgaattccttatgcagcaaatggaatggcgcgaaacgctgatggaggcacgggcaggcaacgaccttgaatccttgaaaaatctcgacaacgaaatccgcgacgaacaagaaaaactgttctgcggtctgaaacagtcgtttgcccgacaagattacgacacagccgcacaacaagtccgccaaggcaggtttctcgacaaactccgcaacgaaatttcctcggcattataa

SEQ ID NO: 5440 - DNA, 2751 bp, Neisseria meningitidis
atgaccgacgcaaccatccgccacgaccacaaattcgccctcgaaaccctgccggtaagccttgaagacgaaatgcgcaaaagctatctcgactacgccatgagcgtcattgtcgggcgcgcgctgccggacgttcgcgacggtctcaagccggtacaccgccgcgtactgtacgcgatgcacgagctgaaaaacaactggaatgccgcctacaaaaaatcggcgcgcattgtcggcgacgtcatcggtaaataccacccccacggcgataccgccgtatacgacaccatcgtccgtatggcgcaaaatttcgctatgcgttatgtgctgatagacggacagggcaacttcggatcggtggacgggcttgccgccgcagccatgcgctacaccgaaatccgcatggcgaaaatttcccacgaaatgctggcagacattgaggaagaaaccgtcaatttcggcccgaactacgacggtagcgaacacgagccgcttgtactgccgacccgtttccccacactgctcgtcaacggctcgtccggcatcgccgtcggcatggcgaccaatatcccgccgcacaacctttctgataccgtcaatgcctgcctgcgcctgctcgatgcacccgacaccgaaatcgacgaactgatcgacattatccaagcccccgacttcccgaccggggcaaccatctacggcttgagcggcgtgcgcgaaggctataaaacaggccgcggccgcgtcgttatgcgcggtaagacccatatcgaacccataggcagaaacggcgaacgcgaagccatcgttatcgacgaaatcccctatcaggtcaacaaagccaagctggtcgagaaaatcggcgatttggttcgggaaaaaacactggaaggcatttccgagctccgcgacgaatccgacaaatccggtatgcgcgtcgttatcgagctgaaacgcaacgaaaatgccgaagtcgtcttaaaccaactctacaaactgactccgctgcaagacagtttcggcatcaatatggtggttttggtcgacggacaaccgcgcctgttgaacctgaaacagattctctccgaattcctgcgccaccgccgcgaagtcgttacccgacgtacgcttttccggctgaagaaggcacgccatgaagggcatattgccgaaggcaaagccgtcgcactgtccaatatcgatgaaatcatcaagctcatcaaagaatcgcccaacgcagccgaggccaaagacaaactgcttgcgcgcccttggcgcagcagcctcgttgaagaaatgctgacgcgttccggtctggatttggaaatgatgcgtccggaaggattggctgcaaacatcggcttgaaagagcaaggttattacctgagcgagattcaggcagatgctattttacgcatgagcctgcgaaacctgaccggcctcgatcaagaagaaattgtcgaaagctacaaaaacctgatgggtaaaatcatcgactttgtggatatcctctccaaacccgaacgcattacccaaatcatccgcgacgaactggaagaaatcaaaaccaactatggcgacgaacgccgcagcgaaatcaacccgttcggcggcgacattgccgatgaagacctgattccgcaacgcgaaatggtcgttaccctgacacatggcggctatatcaaaacccagccgaccaccgactatcaggcgcagcgtcgcggcgggcgcggcaaacaggcggctgccaccaaagacgaagactttatcgaaaccctgtttgttgccaacacgcatgattatttgatgtgctttaccaatttgggcaagtgtcattggattaaggtttacaaactgcccgaaggcggacgcaacagccgcggccgtccgattaacaacgtcatccagttggaagaaggcgaaaaagtcagcgcgattctggcagtacgcgagttccccgaagaccaatacgtcttcttcgccaccgcgcagggaatggtgaaaaaagtccaactttccgcctttaaaaacgtccgcgcccaaggcattaaagccatcgcgctcaaagaaggcgactacctcgtcggcgctgcgcaaacaggcggtgcggacgacatcatgctgttctccaacttaggtaaagccatccgcttcaacgaatactgggaaaaatccggcaacgacgaagcggaagatgccgacatcgaaaccgaaatttcagacggcatcgaagatgaaaccgccgacagcgaaaacgcactgccgagcggcaaacacggtgttcgcccgtccggtcgcggcagcggcggtttgcgcggtatgcgcctgcctgccgacggcaaaatcgtcagcctgattaccttcgcccctgaaaccgaagaaagcggtttgcaagttttaaccgccaccgccaacggatacggaaaacgcaccccgattgccgattacagccgcaaaaacaaaggcgggcaaggcaatattgccattaacactggcgagcgaaacggcgatttggtcgccgcaaccttggtcggcgaaaccgacgatttgatgctgattaccagcggcggcgtacttatccgcaccaaagtcgaacaaatccgcgaaaccggccgcgccgcagcaggcgtgaaactgattaacttggacgaaggcgaaaccttggtatcgctggaacgtgttgccgaagacgaatccgaactctccgacgcttctgtaatttccaatgtaaccgaaccggaagtcgagaactga

SEQ ID NO: 5441 - DNA, 404 bp, Neisseria meningitidis
atgagaaaaagtcgtctaagccggtataaacaaataaactcattgaactgtttgtcgcaggtgtaactgcaagaacgacagcagagttagtaggcgttaataaaagtaccgcagcctattattttcatcgtttacgattacttatttatcaaaacagtccgcatttggaaatgtttgatggcgaagtagaagcagatgaaagttattttgctgaacgacaaaaccatatcaatggaattgagaacttttggaaccgggcaaaacgtcatttacgcaagtttgacggcattcccaaagcgcattttgagctgtatttaaaggggtacgaacggcgttttaacaacagtgagataaaagttcaaatttccattttaaaacaattagtaaaatcgagtttatcctag

SEQ ID NO: 5442 - DNA, 656 bp, Neisseria meningitidis
atggcatactctgcggacttaagaaacaaagctttaaactatagtggattaaatttaaatcaggacaaggcgacgaagccgcagacagtacaaatagtacggcaaggcgaggcaacaccgtactggtttaaatttaatccactatattacgaacaatgcaaaaacatcagccaaaccgcagcaacgtttaacttgtcaagaaacacgctttacctgtggattcgccttaaaaaacaaacaggcagcctaaaacatcaagttaccggtctaaatgccgtcaaatcggataggcaaaaaccggctcaatatgttgggcaacacccggatgcctatctgcatgaaatcgccaaacattttgattgtacggcagccaccatttgctatgcactcaaacagatggggataacgcgcaaaaaaagaccaccacttacaaagaacaagacccggccaaagtaacgcattatttgacacagccggccgaattttccgactaccaacgtgtttatttggatgaaacaggatttgaccgctacctgttccgtccctatgcccgcagcctgaaagggcaaatagtgaaagcgcagataagtggaaaaagatatagtggattaacaaaaatcaggacaaggcgacgaagccgcagacagtacaaatag

SEQ ID NO: 5443 - DNA, 552 bp, Neisseria meningitidis
atgccgtctgaacgccgaccgtttcaaacggcatttttatcgaacaggaaaaccgtcggtaaacttgcagagcgtgtgcaatcccgatatgatggtttgcataaatttaaacatatatgttccgcagctatggcactgattaaagagccgttggacaaagtgaaacaaaggaacgaagaacttgaagcggcagaagaagcggcggcgcaggaggcattgggtcgggagcaggaagccgcccgcgtatccgaatgggaagaacgctacaagctgtcgcgcagcgagttcgagcagttctggaaaggattgcctcaaaccgtacagaataagctgcaagcctcacagaaaacatggaaaagcgggatggataaaatctgtgccaacaatgcgaaagctgaaggtaaaacgccaaacggcataaaattcagcgaactggcatgcaaaacggcgaaaaccgaagcacgcttggaagagctgcacaaccgtaaaaaagcccttatcgacgaaatggccagggaagcggacaagaaagaactgtcaaagcggctctga

SEQ ID NO: 5444 - DNA, 1647 bp, Neisseria meningitidis
atgaaacaccttcacgacttacccgcatggtcgaaattgtggaatcactttgacgacagcaaaacattgcatatgcgcgaaatgttcgagcaagacccgcagcgtgcggaacgctactggctgcaagtcggcggactgacgctggactactccaaaaaccgcatcaacgacgaaaccatgtcgcttttgttcgagcttgcccgagaagcaggcgtgccggagcggatgcggcagatgttccacggcgaaaaaatcaataccaccgaaaaccgcgccgtcctgcatgtcgcccttcgcaaccgcaccaattcgccgattgtggttgacggtgaagatgtgatgcccaaagtcaaccgcgttttgcaacgtatgggcgaatttgcacacgaagtccgcagcggaagctggctgggctataccaaccaagtcattaccgacgttgtcaacatcggcatcggcggatcggatttgggtccgctgatgatgtgtaccgcgctcaaacctttcggtcatccgcgcctcaatatgcacttcgtctccaacgtggacggctcgcaactgcgcgacgtattgtccaaagtccaccccgaaaccacgttgttcatcatcgcctccaaaacatttaccacgcaggaaacgctgaccaacgcgctgaccgcgcgcgaatggtttttgaatcatgcgggcgacgaagaagccgttgccaaacacttcgccgccgtttccaccaatcaaaaagccgtcgccgaattcggcatcgacaccgccaatatgtttgaattttgggattgggtcggcggtcggtacagcctgtggtccgccatcggattgccgattatgctgtatctcggcgaagaaaacttcattgaaatgctcaacggcgcgcacctgatggaccaacacttcatcaacacaccgctcgagcgcaacctgcccgtcattctcgccctcatcggcatctggtatatcaactactacggcggcggcagccacgtcatcgcgccttacgaccaacatttgcaccgcctgcccaaattcatccagcagctcgatatggaaagtaacggcaaacaggttacgttggacggcaaagcagtcggacacgaaacctcgccgattatctggggcgaaacgggcattaacggccagcacgcctttttccaactgctgcaccaaggcacgcacattacccccatcgacctgattgcctcgcttgaaaaacgcagcaacctgcccggacaccacgaaatcctgcttgccaacgtcttcgcccaagcagaagcctttatgcgcggcaaaacccccgacgaagtccgcgccgaactcaaagcgcagggtatggatgaggtgcgcatcgaagagctggtcccgcacaaaaccttctccggcaaccgcccgaccaacctcattctcatggacaaggtcaacccgcgcaatatgggcagcctgattgccatgtacgaacacaaaaccttcgtacaaggcatcatttggggcatcaacagcttcgaccagtggggcgtggaactcggcaaacaactggctaaaaccattttgggcgaactgaccggcgaaaccgggccgcaaaagcacgacagttcgaccgaacgcctgatcaacctctacctgcagaccaaccgcaaataa

SEQ ID NO: 5445 - DNA, 849 bp, Neisseria meningitidis
atgttaagcaaaatcagcgaatcactggcaaacctttccggtgcggaacgcaaagtcgccgaatgtgcattggcggaacccaaatggttcgtccatgccgccgttgccgaaattgccgaacgtgcgtccgtcagccagccgaccgtcatccgattctgccgcagcttgggttataaagggctgcccgagttcaagctcgccttgtccgccagcatcggtcatgagggtatgccctatgtccacgaagaactcaacgccgacgacgatatggcaagcgtggtcgagaaagtgttgggcaatgccgccgcctcgctgttgggcgaacgccgcttcctgaaagagtcggagctggaaaacgccattgccacgctgatgcacgcccgtcgcgtcgagttttacggtgtcggcaattccggcattgtggcacaggacgcgcagcataaatttttccgtttcggcatgtccaccgtcgcctatgtcgatacgcacacgcagctgatggcggcatctgttttgagcgatcaggatgttttggttgccatttccaacacgggttcgtctatcgaacttttggatgcggtcagcatcgccaaagaaaacggcgcgtctgtcatcgcactgacccgcaacgattcgcctctggcgcaacttgccgactgcgtgttgagcgttgccacacaggaaaatgccgaactctacacgcccatggtttcccgcctcttgcagcttgccgtcatcgacattctcgccatcggacttgccctgcgcttgggcgatgctgccagcctgcaattgcagaaaagcaaaaaaagcatacacaacaagcacatcgattacgacaaagattga

SEQ ID NO: 5446 - DNA, 987 bp, Neisseria meningitidis
atgtcttctacgccgaataaacaagccggatatccccgactggtcgccgatatcggcgggacgaatgcacgctttgcgctggaaaccgcgccgcgcgtcattgaaaaagccgccgtgcttccgtgtaaagactacgatacggttaccgatgcggtgcgtgcctatctgaatcaaagcggtgcaacagccgtacggcacgcggcatttgccatcgccaacccgattttgggcgactgggtgcagatgaccaaccaccattgggcgttttccatcgaaaccacccgtcagactttggggctggacaccctcatccttttgaacgactttaccgcgcaggcattggcggtaacgcagacttcaagcaaagacctgatgcaggtaggcgggcaaaagcctgtcgaatttgcccccaaagccgttatcggccccggtaccggcctgggcgtgagcggattggtgcacagccacgcaggctgggtggctttggcgggcgagggcgggcataccagtttcccgccgtttgacgatatggaagtgctgatttggcagtacgccaaaaacaaatacggccatgtttccgccgaacgctttttgagcggcgcgggcttgagcttggtttacgaggctttggctgcaaaacagaaagccaaacccgccaaactgatgccgtctgaaatcacggaaaaggctttgagcggcgcgtcgcctttgtgccgtcagactttggacatcttctgcgccatgctcggcacggttgcttccaacctcgccctgacgctgggcgcgcgcggcggcgtgtacctgtgtggcggcattattccccgcgtgttggaatatttcaaaacttccccgttccgcagccgtttcgagaacaagggcaggtttgaagcatatcttgccgcgattcccgtgtatgtcgtcttgagcgagtttcccggaatttccggtgcggctgcggctcttgacaaccatttgagaaacgtttaa

SEQ ID NO: 5447 - DNA, 696 bp, Neisseria meningitidis
atgtttgtttggcacgaatacgaaaatgcggcagaagcggcgcagtctttggctgacgcagtggcggatgctttgcagggcgcactggacgagaagggcggtgcggtgttggcagtttccggcggacgttcgccgattgcatttttcaacgccctgtcgcaaaaagatttggattggaaaaacgtcggcatcaccttggcagatgaacgcatcgtgccgaccgtccacgccgacagcaataccggtttggtgcgcgaatacctgttgaagaacaaagcggaagcggcaatgtggattcctatggtggaagacggaaaaactgaaaccgaattacatcccgatgctgttgtcgattatgcactgaaacattacaaacagcccgatgttttggttttgggtatgggaaacgacgggcatacggcttcgattttcccgaaagctccgcagtttcagacggcaatcgacggttcggcaggtgtcgcgttggtgcataccacgcccgttaccgcgccgcacgagcgcgtcagtatgaccttggatgcgattgcccatacggggcatgtgtttttggcgatacggggcgaagagaaaaaagccgtgttcgaccaagccgcacaaggcgaaaaccgcgaatatccgatcaacctcgttttgaaccatcaaggagtgaactgccatgtcttctacgccgaataa

SEQ ID NO: 5448 - DNA, 1446 bp, Neisseria meningitidis
atgagtacacaaacaaattttgatttggtgttgttcggtgcgaccggcgatttggcgatgcgcaagctgttgccctgtctgtaccaggcgcatgttgccggtctgcttcatcccgaagggcgtattttgggggtcagccgcagcgagttggataccgaaggttttctggcgaaggtggaaaccagttccaaaatccatgtgaaagaaaatttttccgatgaggcttgggcatcgtttgtcgaacgtttcgcatatctcaaagtcgatgttacgcagccggacgattttgccgctttgggcgatttggtcaaagcgcgcaaagaaaccgacaacgtcgtcatctatctgtccaccgcgcccaaattcttcgcgcaagcctgtgaaaaccttgctgcgatcggtttgaatgccgacaatgtgcgcgtagttttggaaaaaccgttgggtacggatttggcttcttcccagcaaatcaataccgatgttgcgcgttatttcaaagaagggcaaatttaccgcatcgaccactaccttggcaaagaaagcctgcaaaacctgcttgcgctgcgttttgccaatgtaatgttcgagccgctgtggaacaataaatatatcgaaagcgtgcagttgaccatcgccgaacagctcggtgtggaagagcgcggtgagttttacgacattaccggcgcgttgcgcgatatggtgcaaaaccatttgatgcagatgttgtgcatgactgcgatggaagcccccgccagcttggatgccgacgcggtgcgcgatgaaaaagtcaaagtcatcaagtcattgaagccgctgaccgtcgagtctgtcaatgaaaacgtcgtgcgcggacaatataccgccgccagaggcatgaacggctatcttgaagaaatcaacgttccgcaagacagctttaccgaaacctacgtcgccattaaagccgaaatcgaaaacgaacgctggaagggcgttcccttctacctgcgtaccggcaaacgcatggcgggcaaagtggcggaaatcgttttgaacttcaaagatttgaacagccatatttttgaaggcagccgcaccgcgcccaaccggctcgttatcgagttgcaaccatatgaatccgtgcgcctctatacgcagatgaaaaccccgggggcaggaaataaggtcgaaaccgtgccgctggcaaccgatttgggcaaagcattggaaggccgccgcgcggaagcttacgagcgcctgctgctggatgtgattaacggcaaactcgctttgtttaaccgccgcgacgaacttgaagccgcgtgggaatatgtgatgccgattttggaaaactggacaaataacaccacgccgccgcacggctacggcgcacactcgtgggggcctgaagccgcgcgcgaactattggcgcgcgacggacacaagtggcacgaagagcagtaa

SEQ ID NO: 5449 - DNA, 1836 bp, Neisseria meningitidis
gtgaacactactcctatccactccaaactcgccgaaatcaccgggcgcattattgaacgcagccgtccgacgcgtgaaaaatatctggcgaagatccgcagtgccaaacaaatgggacgcttagagcgcaaccagctcggctgcagcaacttggcacacggctatgctgccatgcctaaaagtatcaaaatcgaaatgcttcaggaaaccgtccccaacttaggcatcatcaccgcctacaacgacatggtttccgcacaccagccgtttaaagacttccctgaccaaatcaaagacgaagcgcagaaaaacggcgcgaccgcccaagtcgccggcggcacgcccgccatgtgcgacggcatcacgcaaggctacgccggcatggaattgtcgctgttctcccgcgacgtgattgccatgagtaccgccatcgggctgtcgcatcaaatgtttgacggcagcctgtttatgggcgtatgcgacaaaatcgttccaggtttgatgataggcgcgctttcgttcggtcatattccgggtatcttcgtccccgcaggcccgatgtccagcggtatcggcaacaaagaaaaagcccgcacccgccagcttttcgccgaaggcaaggtcggacgcaacgaacttttgaaaagcgaaatgggttcttaccacagcccgggcacctgcactttctacggcacggcaaactccaaccaaatgatgatggaaatgatgggcgtgcacctgcctgccgccgccttcgtccacccttacaccgacctgcgcgaagcgctgacccgctacgccgccggacacctcgcgcgcggcatcaaaaacggcacgattaaacctttgggcgaaatgttgaccgaaaaatcctttatcaacgccttgattggcctgatggcaaccggcggttcgaccaaccacaccatgcacctcgtcgctatggcgcgtgcggccggcgtgattttgaactgggacgacttcgacgaaatttcctccatcatcccgctgctcatccgcgtttatccgaacggcaaggccgacgtgaatcactttaccgcagcgggcggactgcctttcgttatccgcgaattgctgaatgcaggcctgttgcacgacgatgtcgataccgtcgtcggacacggtatgcgccactacaccaaagagcctttccttatcgacggcaaactcgaatggcgcgaagcccccgaaaccagcggcaacgacgacatcctgcgcaaagctgacaacccgttctcccccgacggcggtctgcgcctgatgaaaggcaacatcggacgcggcgtgattaaagtgtccgccgtgcgcgaaggctgccgcattattgaagcgcctgccatcgtgttcaacgaccaacgcgaagtgttggctgcgtttgaacgcggcgagttggaacgcgattttgtgtgcgtcgtccgctaccaaggcccgcgtgccaacggtatgcccgaattgcacaaactgaccccgcctttgggcatcctgcaagaccgcggcttcaaagtggcgctgctgaccgacggccgtatgtccggcgcgtccggcaaagttccagcctccatccacatgacacccgaagccctgatgggcggcaacatcgccaaaatccgtaccggcgacctgatccgcttcgactccgttagcggcgaactcaacgtcctgattaacgaaaccgaatggaatgcccgcgaagtcgaaagcatcgacttgggcgcgaaccaacaaggctgcggccgcgaactcttcgccaacttccgcagcatgaccagcagcgcggaaaccggtgccatgagtttcggcggcgaatttgcctga

SEQ ID NO: 5450 - DNA, 639 bp, Neisseria meningitidis
atgtccaaactgaccccccgcgaaattttgaccgccggcgcagttgtgccggtaatggcgattgacgacttaagcaccgccatcgatttgtcccacgcccttgtcgaaggcggcatccctaccctcgaaatcaccctgcgcacccctgtcggcctcgatgccatccgcctgattgccaaagaagtgcccaacgccatcgtcggcgcaggtacggtaaccaatcccgaacagctcaaagccgtcgaagacgcaggcgcggttttcgccatcagcccggggctgcatgaatccctcgccaaagccggccacaacagcggcatccccctgattcccggtgttgccaccccgggcgaaatccaactggctttggaacacggcatcgacaccctcaaactcttccccgccgaagtcgtcggcggcaaagccatgctcaaagccctgtacggcccttacgccgatgttcgcttctgcccgacaggcggcatcagcctcgccaccgcgcccgagtacttggcactgcccaacgtcctgtgcgtcggcggctcttggctgacaccgaaagaagccgtgaaaaacaaagactgggacaccatcacccgcctcgccaaagaagcggcggcgttgaaacccaaagcctga

SEQ ID NO: 5451 - DNA, 1041 bp, Neisseria meningitidis
atgaaagcaatggtttatcacggcgcaaacgacatccgttttgaagaaaaaccccgtccgcagattatcgatccgaccgatgcggtggtgaaaatcgtcaaaaccacgatttgcggtaccgatttgggtatttggaaaggcaaaaaccccgaagttgccgacggccgtattctcggtcatgagggcatcggtattgtagaagaagtcggcgaggctgtaaaaaacatcaaagtcggcgataaagtcattatttcatgcgtcagcaaatgttgcacttgcgacaactgcaaaacccaactctattcacactgccgtaacggcggttggattttgggttacatgattgacggtactcaggccgaatacgtccgtacgccttatgccgacaacagcctcgttccgctgcccgataatgtcaacgaagaaatcgccctgttgttgagcgacgctttgccgaccgcccacgaaatcggcgtgcaatacggcgatgtcaaacccggcgacaccgtattcatcgctggggcaggccctgtcggtatgtccgccctgttgaccgcccaactgtacagtcccgccgccatcatcgtttgcgatatggacgaaaaccgtttgaaactggcgaaagaattgggtgcgacccataccattaaccctgcttccggcgaagtatccaaacaagtctttgccatcgtcggcgaagacggcgtggattgcgccatcgaagccgtcggtatccctgctacatggaatatgtgccaagacattgtgaaacccggcggccatatcgctgtggttggtgtacatggtcaatccgttgatttcaaactggaaaaactctggattaaaaagcttgccatcactaccggtctggtaaacgccaataccaccgaaatgctgatgaaggcgatttccagcagctccgtcgattacaccaaaatgctgacccatcatttcaaattcagtgaattggaaaaagcctacgacgtgttcaaacacgccgccgaaaaccaagtgatgaaagtggttttggaagcggattaa

SEQ ID NO: 5452 - DNA, 1050 bp, Neisseria meningitidis
ttgatattaatgaacacacccatccccttctccgaacggctcatccgctggcaaaaacaacacggtcgccaccacctcccttggcaggtcaaaaacccttattgcgtctggctttccgaaatcatgctccagcaaacgcaagtcgccaccgtgttggactactatccgcgcttcttagaaaaattcccgaccgttcagacgcttgccgccgcgccgcaagacgaagtgttgtcgttgtgggcgggcttgggctattacagccgcgcgcgcaacctgcacaaagccgcgcaacaagtcgtcaggcaattcggcggcacgtttccgtcggagcgcaaagacttggaaaccctctgcggcgtaggcagaagcaccgccgccgccatttgcgccttctccttcaaccgccgcgaaaccattttggacggcaacgtcaaacgcgtactctgccgcgtgttcgcccgcgacggcaatccgcaggacaaaaaatttgaaaactcgctctggacacttgccgaaagcctgctgccgtctgaaaacgccgatatgcctgcctatacacaaggtttgatggatttgggcgcgaccgtgtgcaaacggacgaaacccttgtgccaccaatgcccgatggcggacatctgcgaagcgaaaaagcaaaaccgcaccgccgagctgccgcgcaaaaaaaccgccgccgaagtaccgaccctgccgctttactggctgattgtccgcaaccgggacggcgcgattttgctggaaaaacgccccgccaaaggcatttggggcgggctgtattgcgtgccgtgttttgaaagtttgaacgggctttccgactttgccgccaaattctccctgaccatggcagatatggacgaacaaaccgccctgacccaccgcctgacgcaccggctgctattgattacgccctttgaagcacaaatgccgtctgaaagcccttcagacggcatttggataaagccggcgcatttgaaagattacggtttgcccaagcctttggaaatttatttaaacggtaataggttagaataa

SEQ ID NO: 5453 - DNA, 183 bp, Neisseria meningitidis
atgaacacaaacttaaatgacaaagacaaagccatggataccgcaatcaggtttcagaaaaggatgaggattccgaaatttttctttttaattctcggaatcacaatggttttggcatttatccaagacgtgataacgggttctaattttctgcaaataacaattaatgtaaaattttcgtaa

SEQ ID NO: 5454 - DNA, 561 bp, Neisseria meningitidis
atgaatatgaaaaccttattagcactagcggttagtgcagtatgttcagttggtgttgcgcaagcacacgagcataatacgatacctaaaggtgcttctattgaagtgaaagtgcaacaacttgatccagtaaacggtaacaaagatgtgggtacagtgactattactgaatctaactatggtcttgtgtttacccctgatttacaaggattaagcgaaggcttacatggtttccacatccatgaaaacccaagctgtgagccaaaagaaaaagaaggtaaattgacagctggtttaggcgcaggcggtcactgggatcctaaaggtgcaaaacaacatggttacccatggcaagatgatgcacacttaggtgatttacctgcattaactgtattgcatgatggcacagcaacaaatcctgttttagcaccacgtcttaaacatttagatgatgttcgcggtcactctattatgatccacacgggtggtgataatcactccgatcatccagctccacttggcggtggcggcccacgtatggcatgtggcgtgattaaataa

SEQ ID NO: 5455 - DNA, 975 bp, Neisseria meningitidis
atgattgccaaacacatcgaccgcttcccgctattgaagttggaccgggtgattgattggcagctgatcgaacaatacctgaaccgtcaaaaaacccgttaccttagagaccaccgcggccgtcctgcctatcccctgctgtccatgttcaaagccgtcctgctcggacaatggcacagcctctccgatcccgaactcgaacacagcctcattacccgcatcgatttcaacctgttttgccgttttgacgaactgagcatccccgattacagcaccttatgccgctaccgcaaccggctggcgcaagacaataccctgtctgaactgttggaactgattaaccgccaactgaccgaaaaaggtttaaaaatagagaaagcatccgctgccgtcgttgacgccaccattattcagaccgccggcagcaaacagcgtcaggccatagaagttgacgaagaaggacaaatcagcggtcaaaccacaccgagtaaggacagcgatgcccgttggataaagaaaaacggcctctacaaactcggttacaaacaacatacccgtaccgatgcagaaggctatatcgagaaactgcacattacccccgccaatgcccatgagtgcaaacacctgtcgccgttgttggaaggactgcccaaaggtacgaccgtctatgccgacaaaggctacgacagtgcggaaaaccggcaacatctggaagaacatcagttgctggacggcattatgcgcaaagcccaccgcaaccgtccgctgacggaagtgcaaaccaaacgcaaccgatatttgtcgaagacccgttatgtggttgaacagagcttcggtacgctgcaccgtaaattccgctacgcccgggcagcctatttcggactggttaaagtgagtgcgcaaagccacctgaaggcgatgtgtttgaacctgttgaaagccgccaacaggctaagtgcgcccgctgccgcctaa

SEQ ID NO: 5456 - DNA, 2229 bp, Neisseria meningitidis
atgcgttctgctgttttatttatatatttctttctacttaatatattccttttccagccagccgttatccacatccaatctaactatattttatttatgtctatcgtatccgcaccgctccccgccctttccgccctcatcatcctcgcccattaccacggcattgccgccaatcctgccgatatacagcatgaattttgtacttccgcacagagcgatttaaatgaaacgcaatggctgttagccgccaaatctttgggattgaaggcaaaggtagtccgccagcctattaaacgtttggctatggcgactttacccgcattggtatggtgtgatgacggcaaccatttcattttggccaaaacagacggtgagggtgagcatgcccaatttttgatacaggatttggttacgaataagtctgcggtattgtcttttgccgaattttctaacagatattcgggcaaactgatattggttgcttcccgcgcttcggtattgggcagtttggcaaagtttgactttacctggtttattccggcggtaatcaaataccgccggttgttttttgaagtattggtggtgtcggtggtgttgcagctgtttgcgctgattacgcctctgtttttccaagtggtgatggacaaggtgctggtacatcggggattctctactttggatgtggtgtcggtggctttgttggtggtgtcgctgtttgagattgtgttgggcggtttgcggacgtatctgtttgcacatacgacttcacgtattgatgtggaattgggcgcgcgtttgttccggcatctgctttccctgcctttatcctatttcgagcacagacgagtgggtgatacggtggctcgggtgcgggaattggagcagattcgcaatttcttgaccggtcaggcgctgacttcggtgttggatttggcgttttcgtttatctttctggcggtgatgtggtattacagctccactctgacttgggtggtattggcttcgttgcctgcctatgcgttttggtcggcatttatcagtccgatactgcggacgcgtctgaacgataagttcgcgcgcaatgcagacaaccagtcgtttttagtagaaagcatcactgcggtgggtacggtaaaggcgatggcggtggagccgcagatgacgcagcgttgggacaatcagttggcggcttatgtggcttcgggatttcgggtaacgaagttggcggtggtcggccagcagggggtgcagctgattcagaagctggtgacggtggcgacgttgtggattggcgcacggctggtaattgagagcaagctgacggtggggcagctgattgcgtttaatatgctctcgggacaggtggcggcgcctgttatccgtttggcgcagttgtggcaggatttccagcaggtggggatttcggtggcgcgtttgggggatattctgaatgcgccgaccgagaatgcgtcttcgcatttggctttgcccgatatccggggggagattacgttcgaacatgtcgatttccgctataaggcggacggcaggctgattttgcaggatttgaacctgcggattcgggcgggggaagtgctggggattgtgggacgttcggggtcgggcaaatccacactcaccaaattggtgcagcgtctgtatgtaccggagcagggacgggtgttggtggacggcaacgatttggctttggccgctcctgcctggctgcggcggcaggtcggcgtggtcttgcaggagaatgtgctgctcaaccgcagcatacgcgacaatatcgcgctgacggatacgggtatgccgctggaacgcattatcgaagcagccaaactggcgggcgcacacgagtttattatggagctgccggaaggctacggcaccgtggtgggcgaacaaggggccggcttgtcgggcggacagcggcagcgtattgcgattgcccgcgcgttaatcaccaatccgcgcattctgatttttgatgaagccaccagcgcgctggattatgaaagtgaacgagcgattatgcagaacatgcaggccatttgcgccaaccggacggtgctgattatcgcccaccgtctgtccactgttaaaacggcacaccggatcattgccatggataaaggcaggattgtggaagcgggaacacagcaggaattgctggcgaagccgaacggatattaccgctatctgtatgatttacagaacgggtag

SEQ ID NO: 5457 - DNA, 540 bp, Neisseria meningitidis
atgaagataacacactgcaaattaaagaaaaaagtacagaaagagctgctccgtttttttgtactcgaagttaccgcccgttctgctgccgatattttgggtatccatcccaattcggcagtcctgttctaccgcaaaatccgtatggtcatcagccattatctggccttggctgccaatgaggttttcgagggctctgtcgagttggacgaaagctatttcggcggacggcgtaaaggcaaacgtggtcgcggtgcggcaggaaaagtggttgtcttcggcattctgaaacgtaacggacgggtctataccgttgtcgtagataatgccaagtccgatactttaatgcctgttatcaaacagaaaatcatgccggacagcattgtttataccgacagcctgagcagttacgacaagttggacgtaagcggttttatccattaccgcatcaaccattccaaggaatttgctgaccgtcagaaccacataaacggcattgagaacttttggaatcaggcaaaacgcgtcttgcgcaaatag

SEQ ID NO: 5458 - DNA, 435 bp, Neisseria meningitidis
atggataacaaaaaagaatttattaataatttaacaaataggtatatgtggatctatccattggtcttaaatattctatttctacctttttaccagtcctaccaatctttttttattgcgcttggttgtttgtttgcactggttagaaaaatgcaaagcttagattttaaattacaaaatcatattgtattgttaaatataaaaagtgcttgggcagataaaaaagtatttttgattaggatagtagtgtcatggttggcagtaatggaaatatggatgtgttttatttcggaatcatcaacgtgggtatgcggtgctttttgtttaaatagtgaaatattggaaaaaatttttcgtggctttggttattctggtagtttatattttttatttatattgatgattgatctcaataagttaagagagagtatttga

SEQ ID NO: 5459 - DNA, 192 bp, Neisseria meningitidis
atgattggtagtggtgatactaaacaatgcaaaaaattttctgcgtgtgatggaaaataccacgtctacgatcccctcgccctagacttggacggcgacggcatagaaacagtcaccgccaaaggcttttcaggcagcctgaagactgagagagtgaatacgatgagtatacactctatgccactaaattga

SEQ ID NO: 5460 - DNA, 729 bp, Neisseria meningitidis; identical to SEQ ID NO: 973

SEQ ID NO: 5461 - DNA, 1203 bp, Neisseria meningitidis
atgagcgcacgctcatccgcgttagcagaatttggaaatatggttgctaatttagtttctgcaaaaaatgagaaagatatctcgaaacgtaatgaatattacaaacaagctggttatagtgcattattagcatttggtaatttggctagtaatattgcaccaggtagtacgtcatcgcatattgtaaacggaacaaatgcctctgtgattgcaagccgtctctctggaaatatatcttcagctattcaggagcataaagatggtaaagttaatatcaaccgttttcaaaatattttagcggatttatattcattgggagggttaggaagtacattaatagagaagaatggaaatatgcagagttgggggattccattagcaattgctggagatataattgcagcaacggctattgccacaggagatactggtacgatatctacagaggaattttataattttgacaactggaaaggttttgggtatgagctatttgaagactggtctcgttgggtatacgactggctgcccgacggctggaatctgtggaaagaattggacagaaaccgttcaggccaataccacatctacgaccccctcgccctagacctagacggcgacggcatagaaacagtcgccgccaaaggcttttcaggcagcctcttcgaccataacggcaacggcatccgcaccgccactggctgggtttctgccgatgacggtttactcgtccgcgatttgaacggcaacggcatcatcgacaacggcgcggaactcttcggcgacaacaccaaactggcagacggttcttttgccaaacacggctatgcagctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcacgaacaaaatgctatccattagccatgttcgggaaaacacgatttccccgtttgttttaggctgtctaaacaaataa

SEQ ID NO: 5462 - DNA, 363 bp, Neisseria meningitidis
atgattgctaaaagtttattttttagatgccaaaaaatatattttatatacttcatattgtttatatgtctttatttgaatatatcttacgatggggaaatatttatatattttataataaattttactcatttgctaatatgtcatggaatattacttgtattttgtagaatttttccatatgaaaatattccatttactatttttctgaactttattagtttatttttaatatttttacctcttatatttaccataagagagctaattgattcatattatattgagtcgataattaatttattcttaattttaattcctcacgttatttttttaatttacttgaaaggaaagcagatatga

SEQ ID NO: 5463 - DNA, 1130 bp, Neisseria meningitidis
atgacatctgcaaattttaatattaacggttttggagatgtgaaattaacaccctattcaccactcttgggatataaagcttgggattcatttattggttctattcaatccttatctgatttaatctataatgtggataacaatagaaataaaatggaaattactgttaataatgctattcaagctgcagatagctttttaagcagtaattggaagagataacaaaataacaaaataacaaaataacaaatactgcttctttacttgcatccttcgataacattttttaaatttaagaaatgtatctcgagatatacgagaaacaggaaaatttaaacctaatgatattcaacaagcaattggtgatatattcattgctgctggtgatggattacaatatataaaacaacaaacagaggcgatggctcaaagcaaattcttaccaactaaattaaaaactggtttaaatgatgtccttaattctagaatgctaaaatcctctactgttttacagcatgaattgaattaaataaggattatggaaacgagaggcttggcgaatctataatgaatatagatgattttacaccaagtaagatagcaaacttttttgcggatcctgatacatacagcaatgtattagaagaagtatctaggtttatatattccttagttcctgatgatgcaaacccttggaaagggggcgaagattatattggacgagggataagtgaatggggagagttactggaaaaatggtataaacaagattttctcccttatcttgaaaagaatgggaccaatttccgaaatttgaagattggctgcctgaattccctgaatgggcaagagagtggttgaaattagctctcaaacgttcaggcaaatataacgtttacgatcccctcgccctagatttggacggcgacggtatagaaaccgttgccaccaaaggcttttcaggcagcttatttgatcacaccaacaacggcatccgcaccgccacgggctggattgctgcatatgacggttttcctgtgcgcaaattaaacagtaacgggggcattattagcacgacagataccatattccaatctttgcatacatggcttgatcatcaaccaagatga

SEQ ID NO: 5464 - DNA, 495 bp, Neisseria meningitidis
atgaatgatcacatagtacaaattataagaaggttcgggctaggtaggatatttttttattcgtatagcaaatcatctataataattttttcttcgtatgttgtttattatataatttacaattatcaatttaattacctttcgcttttaatttatttattaccaatattgtgcagtatatatatgtttatattttttttagggaaaactaaggatacattaacgacagagcgaagaaaaaaattttttaattctatttttccacttagaattctaatgataataggttctgagaaaaagaggttaggcatcggtagtttttatttgctaaacctactatggattatttggtgtcttatgattcatagagaacaagtcccattaaataacttaaccctcctattatccttcatattttcattattttttttattatgtgattttgttttattattgaatgtttatgtttatttttttaaattaagagaggcttaa

SEQ ID NO: 5465 - DNA, 429 bp, Neisseria meningitidis
atgtcaactgattctaccaattatgcagccaaacatgaaagtttaggaaaatcggtacaacgtgaattacaaaaaacacaaagtcagttgagacaagttgtaagaaaaatgcagagtaaatataatataaataataaagcacgagtagcagaaatatctttgttaaggcaaatgcaaagccaattttctcgaaaatatgtaaacaaaaatcttggtaacagcaacactttggctcaacaaggcagctacaccaaaaaagacggcacaaccgcgcaagcaggcgatttgctgttggctgctgacaacctgcacagccgcctcacggacaaaatgctatccattagccatgttcgggaaaacacgatttccccgtttgttttaggctgtctaaaacaaataaccataaatgcatatcattatttaaaataa

SEQ ID NO: 5466 - DNA, 540 bp, Neisseria meningitidis
atggattttttggaaatttttattatgtctgcatttagaaaaatattattaataatatcttgcctattgattgctagctgcagttttgttgaaactattttttatatggctattagcccagaacctgttgtggtagactttcctcttggtaaaaaaacaaaaagatctattgaactcaaacagaaaattggtaaaccttatgcaatatcgttaggaactaattttatacattatgatccaaaacagggggagaggtggattgatgataagttaaactatccatataatatatcggttaaaatatttaaagtggaagaagatggtaaaaaacttattatagatgagttgcttacagagagaagtagaaaattaggaggcggagtatttggagctgggggaaaatacagtatgcatatttatgatttttatttgccggaaggggaatatttatttgagatttctgataatagtgaatatattccactttacgatgaaataaataattctataagaatagtagttaatgcacgaattcagtaa

SEQ ID NO: 5467 - DNA, 654 bp, Neisseria meningitidis
atgaagataacgcactgcaaattaaagaaaaaagtacagaaagaactgctccgtttttttgtgctggaagttaccgcccgttctgccgccgatattttgggtatccatcccaattcggcagtactgttctaccgtaaaatccgcacggttatcaaccatcatttggccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaaaaagaaaatcatgccggacagtattgtttataccgatagtctgagcagctgcgacaagttggacgtgagcggttttatccattaccgcatcaaccattccaaggaatttgcagaccgtcagaaccacattaacggcattgagaatttttggaatcaggcaaaacgcgtcttgcgaaaatacaacggaatcgatcgtaaatctttcccgctgttcttgaaagaatgcgaatttcgatttaacttcggcacaccgtctcaacagcttaaaatcctgcgggattggtgtggaatttag

SEQ ID NO: 5468 - DNA, 810 bp, Neisseria meningitidis
atgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcatcggaactatcataggtatggagagaacgattacagcactagcgtaggttcctgtattaacggtttcacggtacggtattacccgtttattcgggaaaagcagcagctcacacagcaggagttggtaggttatcaccaacaagtagagcaattggtacagagttttgtaaacaatccaagtaaaaaataa

SEQ ID NO: 5469 - DNA, 587 bp, Neisseria meningitidis
atgagaaaaagtcgtctaagccagtataaacaaaataaactcattgagctatttgtcacaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattatttatacggattgttatcgtagctatgatgtattagatgtgcgcgaatttagccattttagcttcgctgaaacttcgttttcgtatcaatcacagcacacattttgctgaacgacaaaaccatattaatggaattgagaacttttggaaccaggcaaaacgtcatttacgcaagtttaacggcattcccaaagcgcattttgagctgtatttaa

SEQ ID NO: 5470 - DNA, 774 bp, Neisseria meningitidis
atgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataa

SEQ ID NO: 5471 - DNA, 5490 bp, Neisseria meningitidis
atgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggtgtggaaaacctatgggatgatacggtcggtaaaaagacccgtttagagaaatttgatcgggttgcactgcaacatttcaggcaatatgcgcgtctaattaatcaaaataatggtagattacccaatactagtgaaattgagagaagttactataaagccgttaccgataatggcgtttcttccagtgcagctattgatttagttattaatcgttcacttccggatatggcggatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgatgatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaaggaaatgaagcttttaaaaatgaaatcaatagcttggttcatgatatgaaagctgctggcaaggaatttggagatgacttaaatacacagtggaataatctcactcaggctgccgaaataatctataatgacatagtagacaatactagtcaaggaatagaaaaaggtgtcaaagccattaaagaattgtctgaaaaaatgaaaaatgctgcttccgatttggctgacggttcagcagagaaagctaaacaagtagtggaagatttggctcaagccgccaaagaagcatacgaaaatgccaaatccacagccgagaaggctgctcaagcagctcgagaattttttaagggcttgcccagttttaaagatctggccgaaaaatttagagatctgttcccaaatccggaaggctggatcgatgatggtcaccaatgtttagctccttgggttaaagaaactaaaaaacgcaatggcaaatatcatgtctacgacccccttgccctagacctagatggcgacggtatagaaaccgttgccaccaaaggctttgcaggcagcttatttgatcacaccaacaacggtatccgcaccgccaccggttgggtttctgccgatgacggtttactcgtccgcgatttgaacggcaacggcatcatcgacaacggtgcggaactcttcggcgacaacaccaaactggcagacggttcttttgccaaacacggctacgcggctttggccgaattggattcaaacggcgacaacatcatcaacgcggcagacgccgcattccaaaccctgcgtgtatggcaggatctcaatcaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcaaagacaaagtggaactcactgccgaacaggcaaaagccgccaatcttgcgggcattggccgtctgcgcgatttgcgcgaagctgccgcattgtccggcgatttggccaatatgctgaaagcttattctgccgccgaaactaaagaagcacagttggcattgttagataatttgattcacaaatgggcggaaaccgattcgaactggggcaaaaaatcgccaatgcgactttcaaccgattggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcctacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaactaatccgcaaaaagcttttgtggatttggccgagatgcttgcatatggcgaacttcgttcttggtatgaaggccgaagactaatgaccgattatgtggaggaggcaaaaaaagcaggtaaatttgaagattaccagaaagtgttgggtcaggagaccgttgcattattagctaaaacatcgggtacgcaagcagatgatatcctgcaaaatgtaggctttggtcataataaaaatgtttctttatatggtaatgacggcaacgacactctaatcggcggcgccggtaatgactatttggagggcggcagcggttcggatacttatgtcttcggcgaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgccggtaatgattacttggagggcggcagcggttcggatacttatgtcttcggcaaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagtgactgttcagtactatttccagaacgatggctcaggagcttaccgtatcgacgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcaatggaggagaaggcaacgacgccctgtacggctataatggtaacgatgcactgaatggtggcgaaggcaatgatcatttgaacggcgaagatggcaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaagtaccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgcaggcaatgattacttggagggcggcagcggttcggatacttatgtcttcggcgaaggcttcggtcaggatacggtctataattaccatgtggataaaaactctgacactatgcactttaaaggatttaaagcagcagatgttcattttatccgttccggaagtgatttggtgcttagcgcttctgaacaagacaacgtacgtatttccggatttttctatggtgaaaaccatcgtgtagatacatttgtctttgatgatgcagctatcagtaatccagattttgccaagtatattaatgctggcaataatttggtacagtctatgtctgtgttcggttctaatactgctgcgacaggaggaaatgtggatgccaatatacaatccgtacagcagccgttattggtaacgccatctgcataa

SEQ ID NO: 5472 - DNA, 2604 bp, Neisseria meningitidis; identical to SEQ ID NO: 3149

SEQ ID NO: 5473 - DNA, 795 bp, Neisseria meningitidis
atgaccacgattttggctttcgatattgaaaccgtacccgatgtgcagggtatccgaacattgtacgagctgccgtcctcgctgcccgacgatgaagtggtgctgtttgcccagcaaaaacgccgtgctcagacgggcggcgattttatgcagcatcatcttcatcaggttgtggcgatttcgtgctgcatgcgttgggggcaggataaagtacatgtcggcaccatcggcgagatggatgacggcgaggaagtggtcattgctaaatttttcgaattgattgaaaaacatacgccgcaactggtcagttggaacggcggcggtttcgatctgcccgtactgcattaccgctccctgatatacggcatcaacgccgcgcgctattgggatatgggcgacggcgatttcggcgacagccgcgatttcaagtggaacaactacatcagccgttatcaccaacgccactgcgatttgatggatttgctcgcgctttaccagccgagggcaaacgtgccgctggacgatatggcgaaactgtgcggttttccgggcaagctgggtatggacggcagcaaggtttgggaggcattccatacgggcaggctgaaggaaatccgcaattattgcgaaaccgacgcggcaaacacttatctgatgtacctgcgtttctgtctggtcagcggcaggctggatgcggacgaatacgaaatggaaatcaaacggatgcggaattacctgtccgcacaagccggggaaaagccgcattgggaagagtttgtccgcgcgtgggaataa

SEQ ID NO: 5474 - DNA, 870 bp, Neisseria meningitidis
atgaaatttatattttttgtactgtatgttttgcagtttctgccgtttgcgctgctgcacaagattgccgacctgacgggtttgcttgcctaccttctggtcaaaccgcgccgccgtatcggcgaaatcaatttggcaaaatgtttttccgaatggagtgaggaaaagcgtaaaaccgtgttgaaacagcatttcaaacacatggcgaaactgatgttggaatacggtttatattggtacgcgcctgccggacgtttgaaatcgctggtgcgctaccgcaataagcattatttggacgacgcgctggcggcgggggaaaaagtcatcatcctgtatccgcacttcaccgcgttcgagatggcggtgtacgcgcttaatcaggatatcccgctgatcagtatgtattcccatcaaaaaaacaagatattggacgaacagattttgaaaggccgcaaccgctatcacaacgtcttccttatcgggcgcaccgaagggctgcgcgccctcgtcaaacagttccgcaaaagcagcgcgccgtttctgtatctgcccgatcaggatttcggacgcaacgattcggtttttgtggattttttcggtattcagacggcaacgattaccggattgagccgcattgccgcgcttgcaaatgcaaaagtgatacccgccattcccgtccgcgaggcagacaatacggttacattgcatttctaccctgcttggaaatcctttccgggtgaagacgcgaaagccgacgcgcagcgcatgaaccgttttatcgaagacagggtgcgcgaacatccggaacaatatttttggctgcacaagcgttttaaaacccgtccggaaggcagccccgatttttactga

SEQ ID NO: 5475 - DNA, 537 bp, Neisseria meningitidis
atggctgcaagcgtccgtatcttaggcatcgacccgggcagtcgcgtaacgggtttcggtgtcatcgatgtcagggggcgggatcatttttacgtcgcctccggctgcatcaaaacgcctgccgatgcgcctctggcagacaggattgccgtcatcgtccggcacatcggcgaagtcgttaccgtttacaagcctcaacaggcggcagtggaacaggtgttcgtcaacgtcaatccggcatcgacgctgatgctcggtcaggctaggggcgcggcattggcggcattggtcagccataagctgcccgtttcggaatacacggccttgcaggtcaaacaggcggtagtcggcaagggcaaggcggcaaaagaacaggtgcagcatatggtggtgcagatgttgggactttcgggaacgccccagccggatgcggcggacggtcttgccgtcgcgctgacccacgccttacgcaaccacgggcttgccgccaaactcaatccttcggggatgcaggtcaagcgcggcaggtttcaatag

SEQ ID NO: 5476 - DNA, 240 bp, Neisseria meningitidis
atgccccatacccttcccgatatttcccaatgcatcagacaaaatttagaacaatatttcaaagacctgaacggtaccgaaccttgcggcgtgtacgatatggtattgcatcaggtggaaaaaccgctgctggtgtgcgtgatggagcaatgcggcggcaaccagtccaaagcatccgtgatgctggggctgaaccgcaataccctgcgtaagaagctgattcaacacggtttgttgtga

SEQ ID NO: 5477 - DNA, 1011 bp, Neisseria meningitidis
atgcacatcggcggctattttatcgacaaccccatcgcacttgcgccgatggcgggcattaccgacaaaccgttccgccgactttgccgagattttggcgcaggttgggcggtgtgcgaaatgctgaccagcgacccgacgctcagaaatactagaaaaaccttgcaccgcagcgattttgccgatgaaggcggcattgttgccgtgcagattgccggaagcgatccgcagcagatggcggatgccgcgcgttacaacgtcagccttggggcgcagcttatcgacatcaacatgggctgtcccgctaaaaaagtctgcaatgtccaagccggtagcgcgctgatgcagaacgagccgctggttgccgccattttggaagccgtcgtccgtgcggcaggcgtacccgttaccctcaaaacccgtttgggttggcacgacgaccatcaaaacctgcccgtcatcgccaaaatcgccgaagattgcggcatcgccgcccttgccgtccacggacgcacgcgtacgcaaatgtacaaaggcgaagcgcgttacgaactcatcgccgaaaccaaatgccgtctgaacatcccggtctgggtcaacggcgacattacttcgccgcaaaaagcccaagccgtcctcaaacaaaccgccgccgacggcattatgatagggcgcggcgcgcaaggcaggccgtggttcttccgcgatttgaaacattatgccgaacacggtgttttgccgcctgccttgagtttggcagaatgcgccgccgctattttgaaccacatccgcgccatacacgcgttttacggcgacaccgccggtgtgcgcatcgcacgcaaacacataggctggtacatcgacgaaatgcccgacggcgaacagacacgtcgtgaaatcaaccgcttggacagtgcggcggcgcaatacgacatgcttgcaggttatcttgaaagacttgccgaaaaaaccgacagttgggcgtgcgcctaccgcccaaatgccttctga

SEQ ID NO: 5478 - DNA, 1374 bp, Neisseria meningitidis
atgagtaatccattttcctctttaggtttgggtacggaactcgtttccgcactgaccgcgcaaggttacgaaaacccgacgcccatccaagccgccgccattcccaaagcactcgccggtcatgatttgctagccgccgcgcaaaccggcacaggcaaaaccgccgcctttatgctgcccagtctggaacgcctcaaacgttacgccaccgccagcacctcgcccgcgatgcaccccgtgcgtatgctcgtcctcacccccacgcgcgaacttgccgaccaaatcgaccaaaacgtgcagggctacatcaaaaacctgccgctgcgccacaccgtcttgttcggcggtatgaatatggacaaacagaccgccgacctgcgtgccggctgcgaaatcgtcgtcgccaccgtcggacggctgctcgaccacgtgaaacagaaaaacatccatttgaacaaagtcgaaatcgtcgttttggacgaagccgaccgtatgctggatatgggttttatcgacgacatccgcaaaatcatgcagatgctgccccgccaacgccaaaccctgctcttttccgccaccttctccgccccgatacgcaaactggcgcaagacttcatgaacgcgcccgaaaccgtcgaagtcgccgcgcaaaacaccaccaacgccaacgtcgagcagcacatcatcgccgtcgataccattcagaagcgcaacctgctcgaacggctgattgtcgatttgcatatgaaccaggtcatcgtgttctgcaaaaccaaacaaagcgtcgaccgcgtaacgcgcgaactggtgcgccgcaacctgtccgcacaggcgatacacggcgaccgttcccaacaaagccggctcgaaacactcaacgccttcaaagacggcaacctgcgcgtcctcgtcgccaccgacatcgccgcgcgcgggctggacattgccgaactgcccttcgtcatcaattacgaaatgcccgcccagcccgaagactacgtccaccgcatcgggcgcacggggcgcgcgggcgcggacggcgtggcgatttccctgatggacgaatccgaacagaaaatgtttgaatccattaaagagctgaccggcaacaagctgctcatcgagcgcatcgagggcttcgagccgcaatggtgggaacagggcggcgcaaaaccggaaaaacccgaaatgcgcgaaccgagacaacgcaaccgctacgaatccgccaaagcgcaacgcgaaaaaaacacccggccggaaaatgcggcaaacgatgcgggcgcggcttgcggaaaaattgccggacgcagccgccgaagccgccgggaacaccggacgtgcgccctgctccaaccgcgttacggcgtaaaatag

SEQ ID NO: 5479 - DNA, 1128 bp, Neisseria meningitidis
atgagcaactggaaacccaatattccctataacgatttaccacccctgccgccaaaacaggatattgaaagcaaaaccatcctgaaacgttgtatagccgcccgtgcatcccttgcccgtttaaagcaggcggcagaattgataccgaatcaagccatgctgattaacacccttcctgttatggaagcccgtgcaagttcggaaattgaaaacatcgtaaccaccacggacaagctgtttcaatccctgcaaatggatacggaacggcaagaccctgccacgaaagaagccctgcaataccgcaccgccctgtttgcaggctatgaatcactgacgagccgccctttatgcacacaaaccgccatcatggtctgcaacgccatcaagcacccctacgaaatggccatccgcaaaacaggcggcacagccctaaaaggaggcaacagcggaaatgttgtctataccccgcccgaaggagaagaaaccatacgcggcaagctggcaaattgggagcggtttattcacgaaagcggcgatttagacccgcttatcatcatggcggcggcacattaccaatttgaagccatccatccgtttacggacggcaacgggcggacggggcgcatattgaacagcctgctattgattgaaaaagggcttttggatttgcctattttgtatttgagccgctacatcatcgaaaacagggcggactattaccgcctgcttttaggcgtaaccgaacggcaggactgggaaagctggataatctacatcttagacggcgtagctgacaccgccgattggacggtatcgaaaatagatgcgatacgccgcctgttcgagcagacacggcaacacatacggacacacgcacaaggaatctacacgcacgaactggtaaatcttctgtttgagcagccatatacacgcattgccaacctagaagcggcagggatagccaaacggcagacggcctctaagtacctgaaagagctttcagacataggtgtgctgcaagaaatcgtcatcggcagggacaaactattcattcatccgcgcctaatggaactattgcggggagagggcaacagctttacctcattccaatccctcgttaaagcatag

SEQ ID NO: 5480 - DNA, 1029 bp, Neisseria meningitidis; identical to SEQ ID NO: 3653

SEQ ID NO: 5481 - DNA, 1512 bp, Neisseria meningitidis
atgagcgaacaaaaccatccgcaaaccgagccgcagttggacgaaaaccaaatcatcgccctgcgccgcgaaaaactgcacaacatccgccaacagcgcaacgcctatcccaacgacttcaaacgcgacagcttcgccgccgatttgcacgcccaatacggcgaaatcggcaaagaagaactcgatccgcaaggcattcccgtcaaagtggccggccgcatgatgctgaagcgtcaaatgggcaaggcgagttttgccaccattcaagacgtgtccgggcaaatccagctttatctgaacaacaaaggcgtgagccaagaagttttggacgacttcaaccattgggatttgggcgacatcgtcggcgcggaaggcactttgttcaaaaccaaccacggcgaactgaccgtacgcgtgtccggcatccgcctgctgtccaaatccctacgcccgctgcccgacaaacacaaaggtttgagcgatcaggaaaccaaataccgccaacgctatgttgatttgattgccaatgaagaatcgcgcaatacctttatcaaacgcagccaaatcatccaatccgtgcgtaattttatggtgggcgagcattatctcgaagtcgaaaccccgatgatgcacccgattcccggcggcgcgacggcaaaacccttcgttacccatcacaatgccttagatattccgctttacctgcgtatcgcgcctgagctgtatttgaaacgcctggttgtcggtggtttggaacgcgtgtttgaaatcaaccgcagcttccgcaacgaaggcatgtccgtgcgccacaaccccgaattcaccatgatcgaattctacgaagccttctccgactacgaacgcatgatgcagatggcggaagacatcatccgcaacgcatcgcgcacggtaaacggcacggcaaacatcacttacaacggcaaagaagtcgatttggaaagcccgtttgaacgcctgaccattctcgaagccatcaaaaaatacaatccgcactacaccgacgagcagttgaacgatgcggaatggctgaaaaaagaaatcgtcaaacacggcgaaagcctgccgccgtccccgggcatcggcagcctgcaactcgcgctgtttgaaggttgcgccgagggcaagctgtggaatccgaccttcatcgtcgattacccggtcgaagtttcaccgttggcgcgcgcttcggataccaaacaaggtctgaccgaacgtttcgaattgttcgttgtcggccgcgaactggcaaacggctattccgagttgaacgaccccgaagaccaagccgaacgcttcaaagcgcaagtggtgcaaaaagacgcgggcgacgacgaagccatgcactacgatgccgactacatccgcgcgatggaattcggtttgccgccgaccggcggttgcggcatcggtatcgaccgcttggtaatgctgctgaccgattcgcaaaccatccgcgatgtgattctgtttccgcagatgcgccccgagtaa

SEQ ID NO: 5482 - DNA, 1254 bp, Neisseria meningitidis; identical to SEQ ID NO: 479

SEQ ID NO: 5483 - DNA, 180 bp, Neisseria meningitidis
atggaaaatatagtcaagtttgagcatgaagttctaatagtgtgtgttggcaggtatttggattacgttacaatacgtgttttcatcaaaatttccctaccgggcggtatcctgtttttgaagacggtaggatttgggtttgtttgggggcaatcccgcccaaattggagcaatagatag

SEQ ID NO: 5484 - DNA, 1797 bp, Neisseria meningitidis
atgaataccgtatcgaattatctgtccgcattacgcgaagccatgaaggcgcaaggcttggatgcactcgtcatcccttccgccgacccccacctgtccgaatacctgcccgagcattggcaggcgcgccgcgaattatcgggctttaccggctcggtcggcacgtttgtcctgaccaccgatgaagcgggcgtgtgggtggacagccgctattgggaacaagccgccaaacagcttgcgggcagcggcattgtgctgcaaaaaagcgggcaagtgccgccgtacaacgaatggctcgcggcaagcctgcccgaaaacgccgccgtcggcatcccttccgatatggtctcgctcaccggcaaacgcactttggcgcaatcactcgccgccaaaaacatccgcatcgaacacccggataatttactgaatcaagtgtggacaaaccgccccgccctccccgccgaaacggtgttcatccacgaccccgactatgtttctgaaaccgccgccgaaaaactcgcccgcgtgcgcgccgtgatggcggaaaaaggcgcggattaccacttggtttcctcgcttgacgacatcgcctggctgaccaacctgcgcggcagcgacgtgcctttcaatcccgttttcgtgtccttcctgctgattggcaaagacaacgccgtcctgtttaccgaccgatgccgtctgaacgccgaagccgccgccgcgctgcaaaccgccggcatcgcggtcgaaccttacgcccaagttgccgacaaactcgcgcaaatcggcggcgtgctgctcatcgagccgaacaaaaccgccgtcagcacgcttgtgcgcctgcccgaaagcgtgcgccttatcgagggaatcaacccatccacgctgttcaaatcctgcaaatccgaagccgacatcgcccgcatccgcgaagcgatggaacacgacggcgcggcgttgtgcggtttcttcgccgagtttgaagacatcatcggcaacggcggcagcctgaccgaaatcgacgtggacaccatgctttatcgccaccgcagcgtgcgcccaggcttcatttcattgagtttcgacaccatcgcaggcttcaacgccaacggcgcactgccgcattacagcgcgacacccgaaagccacagcaccatcagcggcaacgggcttttgctcatcgactccggcgcgcaatacaaaggcggcacgaccgacatcacccgcgtcgtccccgtcggcacgccgagtgccgaacaaaaaagcgacaacaccctcgttctcaaagcccatatcgcgcttgccgaagccgtgttccccgaaaacatcccctcgccgctgattgatgcgatttgccgcaaacccctgtggcaggcgcaatgcgactacggccacggcaccggacacggcgtaggctatttcctcaacgtccacgaaggcccgcagcgcatcgccttcgccgcccccgccacgcccgaaaccgccatgaaaaaaggcatggttacctccatcgaacccggactctaccgcccgggaaaatggggcatccgcattgaaaaccttgccgccaaccaagccgtcgccgcccctcaagaaaccgaattcggcagcttcctctgttttgaaaccctgaccctctgccccatcgacacccgcctgatggacaccgccctcatgaccgacggcgaaatcgactgggtcaaccgctaccacgccgaagtccgccgccgcctcgagccgctgaccgaaggcgcggcaaaagcgtggctgatcaaacgcaccgaaccgctggcgcgttaa

SEQ ID NO: 5485 - DNA, 1179 bp, Neisseria meningitidis
atgcgaaaaaaacttaccgccctcgtattgtccgcactgccgcttgcggccgttgccgatgtcagcctatacggcgaaatcaaagccggcgtggaaggcaggaactaccagctgcaattgactgaagcacaagccgctaacggtggagcgagcggtcaggtaaaagttactaaagttactaaggccaaaagccgcatcaggacgaaaatcagtgatttcggctcgtttatcggctttaaggggagtgaggatttgggcgacgggctgaaggctgtttggcagcttgagcaagacgtatccgttgccggcggcggcgcgacccagtggggcaacagggaatcctttatcggcttggcaggcgaattcggtacgctgcgcgccggtcgcgttgcgaatcagtttgacgatgccagccaagccattgatccttgggacagcaataatgatgtggcttcgcaattgggtattttcaaacgccacgacgacatgccggtttccgtacgctacgattcccccgaattttccggtttcagcggcagcgttcaattcgttccgatccaaaacagcaagtccgcctatacgccggcttattatactaagaatacaaacaataatcttactctcgttccggctgttgtcggcaagcccggatcggatgtgtattatgccggtctgaattacaaaaatggcggttttgccgggaactatgcctttaaatatgcgagacacgccaatgtcggacgtaatgcttttgagttgttcttgatcggcagcgggagtgatcaagccaaaggtaccgatcccttgaaaaaccatcaggtacaccgtctgacgggcggctatgaggaaggcggcttgaatctcgccttggcggctcagttggatttgtctgaaaatggcgacaaaaccaaaaacagtacgaccgaaattgccgccactgcttcctaccgcttcggtaatgcagttccacgcatcagctatgcccatggtttcgactttatcgaacgcggtaaaaaaggcgaaaataccagctacgatcaaatcatcgccggcgttgattatgatttttccaaacgcacttccgccatcgtgtctggcgcttggctgaaacgcaataccggcatcggcaactacactcaaattaatgccgcctccgtcggtttgcgccacaaattctaa

SEQ ID NO: 5486 - DNA, 477 bp, Neisseria meningitidis
atgcaaaaaatccccctgaccgtacgcggtgcggaattgctgaaacaggaattgcagcagctcaaaagcgtggcgcgtcccgaagtgatcgaagcgattgccgaagcccgttcgcacggcgatttgtccgaaaacgccgaatacgaagccgccaaagaacgccaaggctttatcgagggccgcatttccgagctggaacacaaactttccgttgcccacatcatcaatccgaccgaaatccacgccgaaggcaaaatcgtgttcggtacgacggttacgctggaagatttggaaacggaagaacacgttatctatcaaattgtcggcgaagacgaagccgacatcaaacagggcaaaatctatgtcggctcacccatcgcccgcgccttaatcggcaaggaagagggggatacggcggaagtccaagccccgggcggcgtgcgcgaatacgacattatcgaagtccgatatatttga

SEQ ID NO: 5487 - DNA, 252 bp, Neisseria meningitidis
atgaaaaatctcaggcttggcattttcggttttaaagtccgtaaatgtggttttttatgccgaaaattgattatttttaaattttttgtttctaaaatttctttgtcggcatattttcagcttttgttgcggacatggcgcgtttgccggcggcgcggcacgattgccaatttcatagaatttggtagaatagccgctgttcaacgacagacaagccgccgattttccgggcggcttgtatttttattttaa

SEQ ID NO: 5488 - DNA, 1302 bp, Neisseria meningitidis
atgaccgaatccgtccgcctccccgtcgcccgtctcaaaccttccaccgtcgccctgcccggctccaaaagcatcagcaaccgcaccctgctgcttgccgccttgtccgacaatgcttgcgaaatccattccctgctcaaatccgacgataccgaccgtatgctcgaagcactcgataaactcggcgttcaaatcgaatatcttgccgaagaccgtctgaaagtgcacggcacaggcggacgcttccccaaccgcactgccgatttgtttttgggcaacgcgggcacggcgttccgcccgttaaccgccgctctggccgttttgggcggcgattatcatctgcacggcgtgcctcgtatgcacgaacgtcctatcggcgatttggtcgatgcgttgcggattgccggggccgatgtcgaatatctcggcaaggaacactatccgccgcttcatatcggcgaacgccaagacaacggcgagcgcgtgattccgattaaaggcaatgtgtccagccagtttctgaccgcccttttaatggcgttgccgctgaccgggcaggcgtttgaaatccgtatggtcggcgaattgatttccaagccctatatcgacattactttaaaactgatggcgcaattcggcgtacaggttatcaatgaaggctaccgcgtcttcaaaattcccgccgatgcgcactaccacgcgcccgaacacttgcacgtcgaaggcgatgcctccagcgcgtcctacttcctcgcagccggtttgattgccgccacgcccgtccgcgttaccggtatcggcgcaaacagcatacagggcgatgtcgcctttgcccgcgagctggaaaaaatcggggcggacgtggtttggggcgaaaacttcgtcgaagtttcacgcccgaaggaacgtgccgtccaatcctttgatttggatgcgaaccatatccccgatgccgccatgaccctcgccatcgtcgcgcttgctacagggcaaacctgcacgctgcgcaacatcggttcgtggcgcgtcaaagaaaccgaccgcatcgccgcaatggcaaacgagttgcgcaaactcggggcaaaagtcgtcgaagaagccgaagcaattcacatcaccccgcccgaaacgctgacacccgacgccgtcatcgacacgtacgacgaccaccgcatggcgatgtgtttctcgctggtttcgctgttgggcgtacccgtcgtcatcaacgatccgaaatgcacccacaaaaccttcccgacttatttcgacgtgttctcatcgctgaccgaaacagcggaataa

SEQ ID NO: 5489 - DNA, 534 bp, Neisseria meningitidis
atgtttccccccgacaaaacccttttcctctgtctcagcgcactgctcctcgcctcatgcggcacgacctccggcaaacaccgccaaccgaaacccaaacagacagtccggcaaatccaagccgtccgcatcagccacatcgaccgcacacaaggctcgcaggaactcatgctccacagcctcggactcatcggcacgccctacaaatggggcggcagcagcaccgcaaccggcttcgattgcagcggcatgattcaattcgtttacaaaaacgccctcaacgtcaagctgccgcgcaccgcccgcgacatggcggcggcaagccgcaaaatccccgacagccgcctcaaggccggcgacctcgtattcttcaacaccggcggcgcacaccgctactcacacgtcggactctacatcggcaacggcgaattcatccatgcccccagcagcggcaaaaccatcaaaaccgaaaaactctccacaccgttttacgccaaaaactacctcggcgcacatactttttttacagaatga

SEQ ID NO: 5490 - DNA, 1527 bp, Neisseria meningitidis; identical to SEQ ID NO: 3957

SEQ ID NO: 5491 - DNA, 1407 bp, Neisseria meningitidis
atggaaaaaaacaccctatccgcccgcgcaccatccccttggctgccgcttctgctggcaattgccatttttatgcagatgttggatgcgaccattttaaataccgcactgcctgaaattgccgccgacctgaatgagtcgcctctggatatgcaactggcagttatttcctacacgctgacggttgccctgctgattcctttgagcggttatttggcggacaggttcggaacgaaaaaagtctttttcggttcgattgccgtttttatgctcggatcggcattgtgcgccgcatcgggttcgctgtttgaattgacgctttcccgtgtcgttcagggcatcggcggttcgatgctggttccgataccgcgtctgaccatcttgcgtgtgtacgacaagtccaagctgctcaatgccatcaattatgcggttatgcccgcattaatcgggccggttttagggcctttggcgggcggttatttggtcgaatacgcttcgtggcactggattttcctgctcaacctgcccatcggtctgctgggtttcatattgggacgcaacatcatgcccgatattaaaggcagtaatatctctttagacttcaaaggttatctgattttttctgccgccgcgtgcctcttgttactttcggcagaaagcctgtcgcacgcgctgcctccgtattttgcactgttgccgctgtgcggcggactgctgtttgcacgccgttatttccgacatatgaaaaccgcgtccaaaccgatttattccgccgacctgtttctgatacgcactttccgtctgggactggcgggcaatctgttcagccgtctcggcatcagctcgattccttttctgatgcccctgatgtttcaaatcgctttcggcttcggcgcaagcctgtcgggttggctggtcgcacccgtcgccctgtcttcgctgctggtcaaaccgctgattgcaccgctcatgaaacgtttcggctaccgcacggtactgctttggaacaccaagctgcttgccgccttcatcatgctgctcgccctgcctgacggaaactcgccgctgtggatttgggttttcctctcgctggcgatcggcgcgtgcaactccctacagttttctgccatgaacacactgaccctcgccgatttgcgcccgcaacaaacaggcagcggcaacagcctgatggcggtcaaccaacagcttgccatcagcatgggcattgttgccggcgcattaatccttaaaaactggacatttctgataccggcttcttcaggtctgcattccgccttccgtatgaccctgctcagcatcggcggcatcacccttgcatcatcgctggttttcaaacggctgcacgtttcagacggcaccaacctgacacggaacacaccgtcctga

SEQ ID NO: 5492 - DNA, 780 bp, Neisseria meningitidis
atgagcgcaaccattcccccaaaaatcatccgatacgacagcaatccgaccgatgtctattttttcggcacttgcgtccttgatctttttatgcccgaagcaggcatggatgccattaccctaatcgagcagcagggcatacgcgtccatttcccgatggcgcaaagctgctgcggccagcctgcctattcatccggccatccgaccgaagccttcgatgtcgccaaagcacaactcgaccttttccctgaaaactggccgatcgtcgtgccgtccggctcgtgcggcggcatgatgaaacaccactggccgacgctgtttaaaggcagcgagtacgaggaaagggctgtggattgcgccggccgcatcatcgagtttacccatttcctgcttgccatcggtttcaaacccgaagacaagggcgaaccgctcaaagtcgccgttcacacttcctgcgccgcccgccgcgaaatgaatgtccatctttcaggctggcaactgattgacggtatggaaaacgtcgaacgcatcgtccacgaccacgaaagcgaatgttgcggcttcggcggcacattctccgtcaaacaagccgatatttccggcgcaatggtaacagacaaagtcgccgcgctgaaagaaaccggcgcaaccgaaatcatcagcgcggactgcggctgtatgatgaacatcggcggcaaaatcgccaaggacgagccggatatgccgcgtccgaaacatatcgcatccttcttgttggaacgcaccggaggcaaagcatga

SEQ ID NO: 5493 - DNA, 702 bp, Neisseria meningitidis
atgagcgcgcgtgaaaatattttggcaaaactgaaaaaagccgacgcattgccgatggaagaacctgcggtttttgattattaccgtgaaatgggtgtttcttggggcagcgaagttgagcgtctgaaacattgggctgccgctatgcgtgcggtcaaaaccgaaatttattgggtgacgaaaagcaattggatgcaggttttccgcgaagcggcagaaggcaagggtttgaaaaacatcctgctgcccttggcgaccgaacacggacaaattgcccgtgccgcattggcggacagcaatatcgaaccgattgccttcgagcgcgaaatcgatacttggaaaaccgagtttttcacgaacatcgatgcgggcttcagcggcgcgcaatgcggcatcgcccgcaccggcacgctgatgctgttttccagccccgaagaaccgcgtactttaagcctcgttccgcccgtgcatttctgcctgttcgatacgtccaagatgtacaacgagtttcataatgccgtcgaaggcgaaaaactggtggaaaacggtatgccgaccaatgtattcctgatttccggcccgtccaaaaccgcagacatccaactgacgcttgcttacggcgcgcacggcccgcgcgatttggtcatcctcgccatcctgcccgaccacatttcccctgccgatttggaggaaaacgcatga

SEQ ID NO: 5494 - DNA, 1455 bp, Neisseria meningitidis
atgactacgcaaaccatcaaatttcacatgaagccggaaactttcaagcaaaacgccgcaatttcccttcaagacaagcctttgcgcaaaagcctgcgtaccgcgatggatatgctgatgaccaaacgcaaagccgttttgaccgacgaagaagagctgcaaagcctgcgcgatttgtgcgaacacgtccgtcagcgctcattgtctaaattgccagccctgctggagcagctggaagaaaacctgactaagttgggcgtgaaagtgcactgggcagaaaccccgaccgaagcctgccaaattatccacgacatcatcacagccaaaaacggcaagctgatggtcaaaggcaaatcgatggtcagcgaggaaatcgagctgaaccattatcttgaagcaaaaggcattaaagcggtagaaagcgacttgggcgagttcatcgtccaaatggcaggcgaaaaaccgacccatatcgtgatgcctgctatccacaaaaccaaagaacaggttagcgaactgttccaccaaaacctcggtacgccgctgacagacgatgtagaccaactgaccggcttcgcccgtaaagcactgcgcgatatttacagcactgccgatgtcggtttgagtggcgtaaactttgccgttgctgaaacaggtacgctgtgtctggtggaaaacgaaggcaacggtcgcttgagtaccaccgtaccgcccgtgcatatcgctattaccggcattgaaaaagtggtggcgaaattgtccgacatcccacccttgtacagcctgctgccgcgttctgccattggtcagaacattaccacttatttcaatatgattaccggcccgcgccgcagtgaagaattagacggtccgcaagaaatgcacttggttctgctcgacaacggccgcagccaggcttatgccgaagaccaaatgcgccgcaccctgcaatgtatccgttgcggcgcgtgtatgaaccattgcccggtttatacccgcatcggcggcgcggcatacggcacaacctatcccggtccgattggcgagattatttccccgcacctgttaggcttggatgccactcgcgacctgccgaccgcctgcacgatgtgcggcgcgtgcgtggaagtttgtccggtacgcatcccgattaccgaacaaatgcagcgtttgcgcgttgaagcgcaacgttcgccgaccgaaaccgtgccgcaccccatccgggggcaaggcgcatcgcataccttcggcgaacaaatggcgtggcgcacattcaacggtattttcagcggcagcaaaacctaccgcgccttcggttgggcagccaccaagttccgcaacctgaccccgcgcaaacagttgggttggacgcaaaaccgcgtgccgatgaaaccggcgaagaaaaccctgcacgaactaatggcagaaaaaatgcgccaaaaagaacaggcataa

SEQ ID NO: 5495 - DNA, 486 bp, Neisseria meningitidis
atgatacaaatcggcatcatcatgggcagcaacagcgattggcccgttatgcggcaggcagcgcagtttcttgaagagttcggcgtagaatatgaggcgcgcgttgtttccgcacaccgcaccccggatttgatgttccaatacgccgaaaccgcacgggcgcgcggcatcaaagccatcatcgcgggtgcgggcggcgcggcgcatttacccggtatggttgccgccaagaccaccgtccccgttttgggcgtacccgtccccagcaaatacctgcgcggcgaagattcgcttttatcgattgtacaaatgcccaaaggcgtacccgtcgccacattcgccatcggcgaggcaggcgcggcaaatgccgcattgttcgccgtttccatgctcgccaacgaaacccccgaactggcgcaaaaactggcagacttccgagccaaacaggaacaggctgttttgaatatggaattggaacaaatttaa

SEQ ID NO: 5496 - DNA, 714 bp, Neisseria meningitidis; identical to SEQ ID NO: 3649

SEQ ID NO: 5497 - DNA, 669 bp, Neisseria meningitidis
atgacgacccatctgtccaatgtcgcaccggacctgcaaaactatttgaacgccatcggcgaacccgaacatcccgttttgacgcggctgcgcgagaagaccgggcatcaccgtatgggcaaaatggcgattgcgcgcgaacaggcggcagttttggtttggctggcaaagctgatccgtgcggaaaaatatctggaaatcggcgtatttaccggatacagcagcaccgcgcttgcattggcactgcccgaacacgggcggattaccgcctgcgacatcaatgtaacctttaccgatacggcgcgtcaggtttggaacgaggccggtgtggcacataaaatcagcctgcacctgcaacccgcattgctgacattggatgatttgattgcacagggtgaagccggaagctacgatttggcactgatagacgcagacaaaccgcccacgccgcaatatttcgagcgttgcctcaaactcgtccgtcaaggcggcatcatcgccatcgacaatattttgctgaacggaagggtgatgcgcgaagcggcttccgatgcgccgcccagcgtcggcatcctcaaagatttcaatcaaaacctgccgaacgacccgcgcatcgtccccatcaccctgcccgtcggcgacggcttgaccctgcttctgaaaaaataa

SEQ ID NO: 5498 - DNA, 1977 bp, Neisseria meningitidis
atgtcccgaatcgccgccctgcccgaccatcttgtcaaccaaatcgccgccggcgaagtggtcgaacgccctgccaacgccttgaaagaaatcgttgaaaacagtatcgatgcaggcgcaacggcgattgaagtcgagctggcgggcggcggcatccgcctgattcgcgtcagcgacaacggcggcggcatccaccccgacgacatcgaacttgcgctccaccgccacgccaccagcaaaatcaaaaccttaaacgatttggaacacgtcgccagtatgggctttcgcggcgaaggtttggcaagcatcgcctccgtcagccgcctgaccctgaccagccgtcagaacgacagttcgcacgcgacccaagtcaaagccgaagacggcaaactcagcagccccaccgccgccgcccaccccgtcggcaccaccatcgaagccgccgaactcttcttcaacacccccgcacggcgcaagttcctcaaatccgaaaacaccgaatacgcccactgcgccaccatgctcgaacgcctcgcgctggcgcatccgcacattgccttctcgctcaaacgcgacggcaaacaagtgttcaaactccctgcacaaagcctgcatgaacggattgccgccattgtcggcgaagactttcagacggcatcattgggaatcgacagcggcaacggcgcgctgcggctctatggtgcgattgccaaaccgactttcgccaaaggtaaaaccgacaaacaatactgcttcgtcaaccatcgcttcgtgcgcgacaaagtgatgctccacgccgtcaagcaggcataccgcgacgtattgcacaacgcactcactcccgccttcgtcctctttctcgacctgccgcccgaagccgtggatgtcaacgtccacccgaccaaaaccgaaatccgcttccgcgacagtcagcaggtgcaccaacttgtgttccacacgctcaacaaagcccttgccgacacacgcgccaacctgaccgaaagcgtcggcaacgcaggcgaagtgttgcatgacattaccggcgttgtctccaccccaatgccgtctgaaaacgacagcgaaaatctgtttgatagcgtatccaactacccgacaggcaacaaatcagatacacacaatgcctttggttcatcaggcaaaaccgcgcccatgccctatcagtccgcatatgcgccgcaacaacgcagcctgtccctgcgcgaaagccgcgcggcaatgaatacttacgccgaactttacaaaaaaaccgacgacatcgaccttgagttaagccgattcgagcaggcacgtttcggcaatatgccgtctgaaacgcctgctccccaaacagatacgccgctttcagacggcatcccgtcccaatccgaactgccgccgctcggttttgccattgcccaattacttggcatctacattcttgcccaagccgaagacagcctgttgctcatcgatatgcacgccgccgccgaacgcgtcaactacgaaaaaatgaaacgccaacgtcaggaaaacggcaacctgcaaagccaacgcctgcttattcccgtaacctttgccgcgtcccacgaagaatgcgccgcccttgccgattatgccgaaacgctggcaggcttcgggctggaattatccgatatgggcggcaacaccctcgccgtccgtgcagttcccgccatgctcggcaaagccgatgtcgtctcgctcgccaaagacgtattaaacgaactcgcccaagtcggcagcagccaaaccatcgaggaacacgaaaaccgcatcctcgccaccatgtcctgccacggctcgatccgcgccggccgccggctcaccctgcccgaaatgaacgcccttctgcgcgatatggaaaatacgccgcgcagcaaccagtgcaaccacggcaggccgacttgggtcaaactgactttgaaagaattggacgcactgttcttgcgcggacagtaa

SEQ ID NO: 5499 - DNA, 2115 bp, Neisseria meningitidis
atggcctatcaagttctcgcccgaaaatggcggcccaaaacctttgccgacttagtcggtcaggaacacgtcgtcaaagccctgcaaaacgccctggacgaaggcaggctgcaccacgcctacctgctgaccggcacgcgcggcgtaggtaaaaccaccatcgcccgcatccttgccaaaagcctcaactgcgaaaacgcgcaacacggcgaaccttgcggcgtatgtgaaagctgtacgcagatcgatgccggacgctacgtcgacctgctggaaatcgacgccgcctccaacacaggcatcgacaacatccgcgaagtcttggaaaacgcccaatatgcaccgaccgccggaaaatacaaagtctatatcatcgacgaagtgcatatgctttccaaaagcgcgttcaacgctatgctcaaaacgctggaagagccgcccgaacacgtcaaattcatcctcgccaccaccgatccgcacaaagttcccgttaccgtcttgagccgctgcctgcaattcgtcttacgcaatatgaccgcgcaacaggttgccgaccacctcgcccacgtcctcgacagcgaaaaaatcgcctacgaacccgccgccctgcaacttttgggacgtgccgccgccggatcgatgcgcgatgccttgagcctgctcgaccaagccatcgccctaggttcgggcaaagttgccgaaaacgatgtccgccaaatgatcggcgcggttgacaaacaatacctttacgaactgctgacaggcatcatcaaccaagacggcgcagccctgaccgccaaagcgcaggaaatggcggcgtgtgccgtcggctttgacaacgccttgggcgaacttgccatactgctgcaacacctcgccctgatacaggcagtgccgaatgccttggcgcacgacgaccccgattccgatattttgcaccgcctcgcccaaaccataagcggcgaacaaatccagctttactaccaaatcgccgtccacggcaaacgcgacctcagcctcgcccccgacgaatacgccggctttatgatgaccctgctgcgtatgctggcgtttgcgcccttggcggcagcatcgtgtgatgcaaatgccgtgattgaaaataccgaactaaaatccccatcggcacaaaccgccgaaaaggaaaccgccgcaaaaaagccccaaccgcgccctgaagcggaaaccgcccaaacacccgttcagacggcatccgcagcagcaatgccgtctgaaggcaaaactgccgaacccgttaccaatcaagaaaacaacgatattccgccttgggaagacgcgccggacgaaaccgcagccggcacggcgcaagcatcggcaaaaagcattcagacggcatccgaagccggaacgccgcccaaaaaccaagtttccaagaacgaagcagccgacaacgaaaccgatgcccccttgtccgaagtgccgtctgaaaaccccattcaggcaacaccgaataatgaagcccttgaaacagaagcatttgcacacgaagctcctgcaaaacctttcaacggttacagctttccgaatgatgactacctcgtagaagacggcgcagaaatcccaccgcccgattgggaacacgccgcccctgccgatgcggaagaagaaaacaacgccgacgaaagcagcaacaacgaagaccacacgccatacgccccgccgcccgaattttccaccgaaaactgggcagccatcgtccggcacttcgcccgcaaactcggcgcggcgcaaatgccggcgcaacactccgcgtggacggaataccatcccgacaccggtctgatggttttggcaatgaccgccgaagcacgcgccaccgccgacaaaaaacgcctcgacaaaatccgcgacacccttgcccaagcctacgggctgcaactcaccctgcaaacccaagactggcgtgacgaagccggccgggaaacccccgcgatgcaggacaagcgcgtccaagccgaagacaggcaaaaagcacaagcattgctcgaagccgaccccgccgcacaaaaaatcctccaagcattcggcgcgcaatggcagcccgaatcactggaattggcggcaaaccggccataa

SEQ ID NO: 5500 - DNA, 336 bp, Neisseria meningitidis
atgttcggaaaagccggattaggcggcctgatgaaacaggcgcagcaaatgcaggaaaatatgaaaaaagcgcaagccaaactcgccgaaaccgaaatcgaaggcgaagcaggcaacggcctggtcaaaatcacaatgacctgcgcgcacgaagtacgcaaaatcgacatcagccccgatttgattcaagaagccgccgacgacaaagaaatgcttgaagacctcatcctcgccgccctcaaatccgcccgaggcaaagccgaagaaaccgcaaacaaaacaatgggcgcattcacgcaaggtctaccccccggagtgggcgacttcttccgctga

SEQ ID NO: 5501 - DNA, 1047 bp, Neisseria meningitidis
atgtcagacgacaaaagcaaagcacttgccgccgcactggcgcaaatcgaaaaaagtttcggcaaaggcgccatcatgaaaatggacggcagccagcaggaagaaaacctcgaagtcatttccaccggatcgctcggattagacctcgccctcggagtcggcggtctgccgcgcgggcgcatcgtcgaaatcttcggccccgaatcctccggcaaaaccaccctctgcctcgaagccgtcgcccaatgccagaaaaacggcggcgtgtgcgcctttgtcgatgccgaacacgcctttgatcccgtttacgcccgcaaactcggcgtaaaagtcgaagagctttacctgtcccagcccgataccggcgaacaggctttggaaatctgcgacacactcgtccgttcgggcggcatagatatggtagtcgtcgattccgtagccgcactcgtccccaaagccgaaatcgaaggcgatatgggggacagccatgtcggactgcaggcgcgcctgatgagccaggctttgcgcaaactgaccggacacatcaaaaaaaccaacacgctggttgtgttcatcaaccaaatccggatgaagatcggcgtaatgttcggcagccccgaaaccaccaccggcggcaacgcgctgaaattctattcttccgtccgcctcgacatccgccgcaccggatccatcaaaaaaggcgaagaggtattgggcaacgaaacccgcgtcaaagtcatcaaaaacaaagtcgcccccccgttccgtcaggcagagtttgacatcctctacggagaaggcatcagttgggaaggcgaattgatcgacatcggcgtgaaaaacgacatcatcaacaaatccggcgcgtggtacagctacaacggcgcgaaaatcggtcagggcaaagacaacgtccgcgtctggctgaaggaaaatcccgaagtcgccaatgaaatcgacgcaaaaatccgcgccctcaacggcgtagaaatgcacatcaccgaagggacgcaggacgaaaccgacggcgaacgccccgaagaataa

SEQ ID NO: 5502 - DNA, 765 bp, Neisseria meningitidis
atgtgttcctgccttgttgtcaaaaataccgttatcggaagcggacgcaccaaaatcgccgtgccgcttgtcgcccgcgatgccgccgaactttccgccgtacttgagcaaatcaaaaatatgcccttcgatattgcggagttccgcgccgactttttggaatgcgcgggcagtatcggcgaaatattgcaccacacgcagaccgtccgcgacgcgctgcccgacaagccgctgctgtttacgttcagacggcatggcgaaggcggctcgttcccgtgttcggacgattattattttgaactgctcgacgcgctgatcgaaagccgcctgcccgacatcatcgacatcgagctgttttccggcgaaaccgccgtccggtgcgccgtggcaaatgctcaaaaaaacggcatcgccgccctgctctgcaatcatgagtttcaccgcacgccgccgcaagaagaaatcgtatgccgtctgaaacagatggaggactgcggcgcggacatctgcaaaattgcggtgatgccgcaaagcgcggaagatgtgctgactttgctttccgccacgctcaaagcgaaagagcttgccgccaaaccgattgttacgatgtcgatggggcagacgggggcggtcagccggcttgccggacaggtgttcggctcaagcatcacgttcggttcgggaacgcaaaactccgcgccggggcaaatcggcgtatccgccctccgtgcgacactcgactgcctcgaaaacggcgcagactga

SEQ ID NO: 5503 - DNA, 2016 bp, Neisseria meningitidis
atgatgaaactcaatccccaacagctcgaagccgtccgctacctcggcggcccactgctcgtccttgccggtgcaggcagcggcaaaaccggcgtgattactcaaaaaattaagcatttgattgtcaatgtcggctacctgccgcataccgttgccgcaattacctttaccaacaaagccgctgcggaaatgcaggagcgcgttgccaaaatgctgcccaaaccgcaaacgcgcgggctgacgatttgcacgttccactctttgggcatgaagattctgcgcgaagaggcgaaccatattggttacaaaaaaaacttctccattctcgattctaccgacagcgcgaaaatcatcggcgaactcttaggcggtacgggcaaagaagccgtattcaaggcgcagcaccagatttccttgtggaaaaacgatttaaaaacgcctgaagatgtcgttcagacggcatcgaacatttgggaacaacaaaccgcacgcgtgtatgcgagctatcaggaaaccttacaaagctatcaggcagtggacttcgacgacttaatccgcctgcctgccgtgctgttgcagcaaaacagcgaagtgcgcaacaaatggcagcggcggctgcgttatctgttggttgacgaatgccaagatacgaatacctgccaatttacgttgatgaagctgctgaccggcgcggaaggtatgtttaccgccgtcggcgacgacgaccagtccatctacgcatggcgcggtgcgaacatggaaaacctgcgtaaaatgcaggaaaactatccgcagatgaaggtcatcaaactggagcaaaactaccgctccaccgcgcggattctcaaaatcgccaacaaagtcatcgaaaacaaccccaagctgtttaccaaaaaactttggtcgcaattgggcgaaggcgagccggtcaaagtcgttgcctgccaaaacgagcaacacgaagccgactgggtcgtcagccaaatcgtcaaacaaaaactcatcggcggcgacaaaacccaatatgccgatttcgccgtgttataccggggaaagcatcaggcgaggattttcgaggaagcattgcgcggcgcgcgcatcccctaccagctctccggcggacaaagctttttcgacaaagccgaaatcaaagacgtgttgtcttatgtgcggctgcttgccaaccccaacgacgatcccgcctttctgcgtgccgttaccacgcccaaacgcggcatcggcgatgtcacgctgggcaagctcaacacttacgcgcacgaacacgaatgcagcctgtatgaagccgcgcaaaacgaagaagcccttgccacgctgaacaataccaaccgccaacacctgcaaacctttatggatatgttcgtcagctacctcgccaaagccgaaaccagcgaagcgggcgagttcatcaacagcctgctcgaagaaatcgactatgaaaaccatttgatgcaaaacgaagaaggcaaagccggcgaaatcaaatggcgcaacgtcggcgatttggtatcatggtttgcgcgaaaaggcggggaagacggcaaaaacatcatcgaactcgcccaaaccgtcgccttgatgacgcttttggaaggaaaagacgaagaagaaaccgatgccgtctcgctatccacgctacacgccgccaaaggtttggagtatccgtatgttttccttgtcggttgcgaagaaggcgttttgccgcacaacgacagtatcgaagagggcaacgtcgaagaagaacgccgcctgatgtacgtcggcatcacccgcgccaaacgccaactcacactgacccactgcgtcaaacgcaaaaaacaaggcacatggcagttccccgaacccagccgattcatagacgaaatgccgcaggaagatttgaaaatcctggggcgcaaaggcggcgaaccgattgtcagcaaagaagaaggcagacgcaaccttgccgatataatcggaaggctcgacaacctaaaaaaaagcggcgcggcggattaa

SEQ ID NO: 5504 - DNA, 957 bp, Neisseria meningitidis
atgtcttcacgcaaaattatccacatcgacatggacgcattctacgcatcggtagagctgcgcgaacagccgcatttgaaagggcggccggtggtcgtcgcgtgggagggcgcgcgttcggtgatttgcgccgcatcgtatgaggcacggcagttcgggctgcattccgcgatgtcggtggcaacggcgaaaaggctgtgtccgcaagcggtgtatgtgccgccgcatttcgatttgtaccgtcaggtttccgcgcagattcacgccgtattcaggcgttataccgatttaatcgaacccttgtcgctggacgaagcctatcttgacgttacccgtaatttcaaaaacatcccttacgccggcgacgttgccaaagaaatccgtgccgccatttttgcggaaacaggtttgactgcatccgcaggcatcgcgccgaacaaatttctggcgaaaatcgcgtcggactggcgcaagccgaacgggcagtttgtgttgccgccgcacaaagtcatggcatttttggaaaccctgcctttgggcaaaatccccggcgtgggcaaggtaacgctgaaaaaaatgcagtcgctgggtatgcggacggcgggcgacttgcgccgtttcgagcgcggcgaactcttaaaccatttcggacgctacggataccgcctctatgatttggtgcgcggtacggacgaacgccccgtcaaagccgaacgcgaacgcctccaaatctccacagaaattaccctgcccgaagacctgccgctcgagcaggctgccggacacctcccccatcttgccgaagacttgtggcggcaaatcacgcgcaaaaacgtcgaagcccaaagcgtaacgctcaagctgaagacctacgatttccgcatcatcacgcgcacactgacttattcctccgtattgcccgactgcgcactctgctgcaggctgcgcaaatgttga

SEQ ID NO: 5505 - DNA, 3090 bp, Neisseria meningitidis
atgaatcaaaatcatttttcacttaaaattctgaccgttatgctgttatcggcttacggtggttcttttgcagacggtgttgtgcctgtttcagacggcaataccgtcagtctggatacggtcaatgtacgcggctctcatgctttgttgggcaagaccgaaaagacccgttcttatacgatagatcggatgtccaccgccacaggtatgaggattgcgggcaaggatacgccgcagtcggtcagcgtcatcacgcgcagccgccttgacgataaggcggtgcatacgcttgaagaggcaatgaaaaacacgacgggtgtcaacgttgtgcgcgattcaggcttgcagacgcggtttttgtcacgcggtttctatattgatcagattggtgaagacggtatgaccgtcaatgttgcaggccgttcgggatatacggcgaaaatcgacgtgtctccgagtaccgatttggcggtttatgaccatattgaagttgtacggggtgcaacggggttgacccaatccaattcagagccgggaggaaccgtcaatttgatccgtaagtgacctaccgcttctttcaaacataccggagagctgaccgccgaccatcgcggcagccggcgtgcagtgttggatgtttcaggcagcctgaataaggcgaataccttacgcggaaggttggtgggtgcggaagagtataaaaaatcgtttaaagaccgagtttggggcaggaaacatatggtttacggcattgccgaagccgatgcgggcgacagcagtgtgcttactttgggcggcatgtatcagaagagtagggaggttcctgatttttcgggcattattttgccctgtgaaaatcagaaaactgccccgttcagttcaacgcctgcctgcaaccggcctttgcaactgccgcgcaacacttatttgggggaggattggtcgcggttaagtgccgacaaatacaaccttttctcaggattcaaacatgtgtttgacaacggttggcagctcaatgccgaagtgtcttataccaagaatgaatccgatgcgaaggtggggcagttttttctgaaaaacgaatatgcggcgggtttgtcgggtgaggatgcggtaggctttttgactgaaaaaaacgaagtcatcccgttcgagccgaaagataaggcattggagaaactgaaagcatatcgtgatgaaaccgccaaggaataccgggagcgcaaagacgattttgttaaaaaccgtttcgataatactgctttcgaacagtatcgcagccgccgtgccgcagaacgcaaagccggttttgacaagtgtatgagtgaccctttcgcgctggactttatctgtcaaggttcttggggggatccgggcgttgatgccgacaaggcggaatttgtcgataaagcccttgcgaaggagggcatctttaataatgcggcacaacgttttccaaacagcctgtatgactcttcctttaatcggaaggctaccgccaaccgacgatacagttatatgccgttgcggcataccaaagacgaccgccaatggggaattaaacttgacctgaccggcacatatgggctgttcgggcgggagcatgatttctttgtcggctatgcctacggtgatgaaaagatacgttcggaatatctagaaatctacgaacgccgctacagagtacgtccgaatacgggggcaacgcacggcgtgtatgcgggaagttgtcaggaggagccggacggcgatttgtcgtctcctttggtcagggggcataaagaacccgattggcaggcgtacgatgaaaaaggcaaccgtaccgtttatgccgaagaatgcaggaacgccaagaaaataaaaaccgagcccaagctcgatgccgaaggcaagcaggtgtattactatgacgaatacagcggcagccggacaccggtatatgtcgatgtatatgagctggacgaaaaaggcaacaagattcaggagaccaatcccgacggcacgcctgcctttaccggtttttccggtacggtgccggtttggaaaaccgtcaaagtggcagacgaccatgttcctgcgctgtataactacgccaaatacctcaacaccaacaaaacccattcgctgactgccagcacgcgtttcaacgtaaccggccgactgcaccttttgggcgggctgcactacacgcgctatgagacttcgcaaaccaaagatatgcctgtccgctatgggcagccggcaagcgattttcagacggcatcgagcattagggcggatcaggaccattacacggccaagatgcaaggtcataaattgacgccctatgcaggcattacctatgacttgacaccgcaacagagtatttacggaagttataccaaaatcttcaaacagcaggataatgtcgatgtcagtgccaaaaccgttttaccgcctttggtcggcacaaactatgaggtaggctggaaaggcgcgttcttgcaaggacggctgaatgcttcgttcgcattgttttacctcgaacagaaaaaccgcacggtcgtcgatttcggctatgttcccggagcaggcggcaagcaggggtcgttccaaaccgttgccaaaccgataggcaaagtggtcagcaggggtgcggaattcgagttgtcgggtgagttgaacgaagattggaaagtctttgcgggttacacctacaacaagagccgctacaaaaacgccgccgaagtcaacgccgaacgccttgccaaaaattccagtgcagacccgtacaacttcagcaatttcacacccgtgcacatattccgtttcggaacgagcttccatataccgaatacggggctgaccgtcggcggcggcgtgtccgcacaaagcggcacaagcagtctgtataacatcaggcagggcggctacgggctgatagacggtttcgtccgttacgaattgggcaaacacgccaaattgagcctcatcggtacgaacttaaacggacgcacttattttgagaacaactacaaccgtacgcgcggcgcaaacaacttctacggagagccgcgcactgtcagcatgaaactggattggcagttttaa

SEQ ID NO: 5506 - DNA, 780 bp, Neisseria meningitidis
atggcagcctcgcccgaagcaaaattcaccgaagaaaagattttgtgggtcaaacaccacacgccgaaactcatcactttcgccatcagccgtcccgaatcctaccgctttaaagccggacagttctcccgactcggtttctacgaaggggaaggtttcatttggcgtgcctattccattgtttccgcagaatatgccgacacgctcgaatattttgccgtactcatccaagacggccccatgtcggcccgtttcgccaaaatgcaacagggcaacaccatcctgctcgataaaaatgccaccggcttcctcctgcccgaacgcttccccgacggcaaggatttggtgatgctctgcaccggctcgggcatcgcccccttcctttccattctcgaacaacccgaaatccgtcaacgtttcgataccgtcaacctgatacattccgtatcttttcccgaagaattgattttcaacgaccgactcgccgcattgactgaacatcccctggtaggcgaatacggacactctttccgtttcgtccctgttaccacccgtgccgccaacccctcgggcttaagcggaaaacgcattccggaactcttaaaaaacaacagcatcgaacaggcgctgcataccaagttcaccccggaatccacacggtttatgatttgcggcaacccggaaatggtcaaagacactttccaaacgctgctcgacatgggttacgccatgcaccgcaaccgcattcccggtcaaatcatgatggaaaacggcttctaa

SEQ ID NO: 5507 - DNA, 1413 bp, Neisseria meningitidis
ttgttgtttgaatttaaagagaataaaatgattgttgcttctcgctggcccttgctggaaaaggtatttttacggtttggaatgcctgttgccgtggttgatttggaatcgacgggcggcaatctgtatgaagacagggtaaccgaagtggctttggtcaagtttgagcagggaagggtggtgaggcatgagtggttggttaatcctcaaaaaccgattccgcagtttgtggcggggctgacggggatttcagacggcatggttgccgatgcgcctgtttttgcagagattgccggcgagttgttttcggtattgaagggttgtgtgctggttgcacataacagccgtttcgactatacgtttttaaagcatgagtttcatcgtgcgggtatcggattttcatcgcctgctttgtgcagtgtgcagctgtcccggtgtctgtatccgcaattttacaagcacagcctggacagtatcatcgaaaggttggggattgttgtggaagacaggcatcgtgcgatggcggatgtatcggcattgtgtgattatttggaatacagtctgtcggaacacggggttgaggcatggatcaggcagtgtttccgtttgatgaatccgaaaccgctgcctgccgcgctgcccgaacggttgagggaacagttgtacggtttgcctgacggtatgggggtgctggcttgtttcgacggcggagggaaagtaaattatatcggtacgtttgaacgggtatatagcgagatttcggctttattggactccggaaaagccccgtttgattggtgcaatacggaggaagtccgtttttttcccgcattgggcagcctgcatgcatataagattaaagcggaattggtcgggcgttatcattcggattgttatgtgtctgccaaaaatctgcttaaaacatttacgaccgtcaggtttgaaaaaggttcagacggcatgttgaatgcgaaaacagcggctttgaaaaacggtgtgacggataatccgcctaccggattatttgccaataaaaaggcagcgagacgggctttgtcgtcgtgggcggaaacatacggattgtgtcctgccgcagccggtatccttccggacggttatgcagaggatgagccttgtcccgtatatgtttcaggccgatgcgataaggcgtgcggccgttctgacgaacaggttttggcgtttgcacacaagttgcctgttttggattggggaaaaatgcatgaggtggaaattaccgaaaccgatcctttgacgggggaaaaagtcgttctgcacggaatgggcggcgcattggaaatggatgacgggctttggtatttcgataaagatttaccggatgcgtttaaggcgaagtttaaaacggacaggaaaaatattaaggaaatcggttaa

SEQ ID NO: 5508 - DNA, 1140 bp, Neisseria meningitidis
atgcagaatatttttgaccctttggttattcgtggaaaatcccttacccccatcgtgcaaggcggtatgggggtcggtgtttccgcatcgggtttatccagcgcggtggcgcgtgaaaacggtatcggaacgattgccagtgtggatttgcgccaccttcacgaagacctactcgccgaatcacaaatcaatccgagtgaagagaaatatacatctttgaactgtaccgcattagacagggaaatccaaaaagccaaaagcgcttcagagggaaaaggactgattgcggtcaacgtgatgaaggcggtcaaagaccacgccgcatatgtccgccaggcttgcgaatcaggggcggatgcggttgtaatgggtgccggcctgcctttagacctgccggaaatgaccgagggctatcataaagatgtcgcgctgctgccgattctgtccgaatcgcgcggtattaatatcgtcttgaaacgttggatgaaaaaaggcatattgcccgatgcgattgtagtcgaacatcctgcccacgcggccggacatttgggtgcatcaaccgttgaaggcgtaaacgatgccaagttcgacttcaaacgcgtgattgaggaaacgtttgaagttttcaaaagtttagggctggaaagcgaaaaaatcccgcttattcttgcgggaggcatggcaaattttgaaaaagtcaaaaccgccctaaagaactggggagcatccgccgttcaaatcggtacggcttttgccgttaccgaagaaggagatgcacaccttaacttcaaaaaaacgctcgccggtgcggaaactgaaaaagtagtcgaatttatgtctgttgccggtttgccggcgcgcggtgtccgcaccaaattcctagacagctacatcaagcgtgaaagcaaacttcagacaaacgccaaagccgacccgcgccgctgtacccaaggtttaaactgcctaaccagttgcggtctgcgcgacgggctttccaaagcaggacagttctgtattgatatccagcttgccgccgcattccgtggagaagtagataaaggcctgttcttcagaggtaaagaccgctgcccttcggcaatgccatccgcaccgtccgcgagacgatacaatatctgctga

SEQ ID NO: 5509 - DNA, 492 bp, Neisseria meningitidis; identical to SEQ ID NO: 2105

SEQ ID NO: 5510 - DNA, 1497 bp, Neisseria meningitidis
atgaccacggaaaaccaagccggcagtccggcatccggaatcggcacgtccgaacaaacaaaagccgcgccgaaagcaaaaaaaacattcgatccgcgagccagcgtgattcaaatccatcccgaaggcgaacgcatccatcccaaaaaggcggaaggacggttcgccaaactgcgtatcgccgccgtattggcgacgcagtttgtgttttacgtcattccgtggttcaactggagcggcaggcaggccgtcgttttcaatatccccgaacggcatttcttcattttcggattgtcgttgggggtgggcgatttgatttaccttgccttgctgctgatgatttgcgccttcgggctgttttggtggacgacgattgcagggcgactgtggtgcggctattcctgcccgcaaacggtttacaccgaaattatgctgtggattgacaacctggtcgaaggcgatagaaacaaacggctgaaactggaaaaatcgccgtggaatttcactaaaatccgcatcaaagccaccaaatacctgctgattttccttgtctgcgcgtggacgggcatcacgtttgcaggctggtttgtccctatccgccagttcgttcccgatttattcactggagcagcaggtggcggcgcgatgtttgccgcagcgttttatggctttatgaccttcttcttcgcccacattatgcgtgaaaaagtatgcctgcatatgtgtccgtatgcacgtttccaaagcgcgatgttcgacaaggacacgctgattgtttcttatgacgcggaacgcggcgaaccgcgcggcgcgcgcaagaaaacggtcaataaggaagaggcgggtttgggcgactgcatcaactgtgcgatgtgcgtccaagtctgccccgtcggcatcgacatccgcaacggtctgcaataccaatgtatcggctgcgccgcctgtatcgacgcgtgcgatgagattatggacaaaatgggctatccgcgcggattaatccgttatacgaccgaaagcgcgctggaacacgaatattctgaaaaagacattaaaaaacggctgctcagaccgcgcgtggcaggttacggcgcggtgttggcgttagttatcattgccttcctggccggtttgtccacgcgcaaaatggtcgaggtcgatattttgaaagaccgtggcgtactggtgcgcgaaaacgccaaaggctggctggaaaacgcatacagcctgcgtatcatcaacaaaagtgaaaaagaacagctgattaccgcaagtgtcaaaggctttgacgaaatcgccctgaccgggctgcccgaaggcggtatcaaggttgccccgcgcgaaacggtaacccttcccgtccaagtgtccaccattccggaatacgcggacaaaggcagccaccctatcgaatttaccttccaataccgcgaaagcggcgcgcccgacggcaagccggtcgtcttggaagaagatgcaacctttatcggagaataa

SEQ ID NO: 5511 - DNA, 120 bp, Neisseria meningitidis
atgtatccgccccatacatccggacggcgcataaagttgtacaatagcggaaatatattttgggaaaaacggattttctcaaaacttgaaacacaacgccttaaaaaacaagaaaaatga

SEQ ID NO: 5512 - DNA, 198 bp, Neisseria meningitidis
atgctttcaagaaaagggcggacgcgtgggaaggcggcggcaggggacaggcggggaaggattttcgatttgcgggcgaagcctgccattattccttttgaaataaaaagttatagattgtgtgccggattgtcgatagcgtttgtttatgagcttgcgccgtcggttctgccgatatgggggtgtcggtttttttag

SEQ ID NO: 5513 - DNA, 1980 bp, Neisseria meningitidis
atgtctcaactggcaaacgcaatccgcttcctctcggccgatgccgttcaaaaagccaattccggccaccccggcgcgcctatgggtatggcggaaatggcggaaacattgtggacgaaattcctcaatcacaaccccgccaaccccaaattctacaaccgcgaccgcttcgtcctctccaacggccacgcgtctatgctgttgtacagcctgctgcacctgaccggctacaacctaagcattgaagacttgaaaaacttccgccaactgcacagcaaaacccccggccatcccgaatacggctacaccgacggcgtggaaaccacgaccggcccgttggggcaagggattgccaacgcggtgggtatggcattggcagaaaaaatccttgccgccgaatttaataaagacggtttgaacatcgtcgatcattacacctacgtctttatgggcgacggctgtctgatggaaggcgtatcgcacgaagcctgttcgctcgccggcaccttgggcttgggcaaactgattgttttatatgatgacaacaatatttccattgatggtaaagtggacggctggtttaccgaaaacatcccgcaacgctttgaaagctacggctggcacgtcgttcccaatgtaaacggtcatgacaccgccgccattcaagccgccatcgaagccgcacgtgccgaaaccggcaaaccgtccatcatctgctgcaaaaccttaatcggcaaaggcagtgccaacaaagaaggcagccacaaaacccacggcgcacctttgggcgcggacgaaatcgaagccacgcgcaaacatttgggctggacttaccccgcctttgaaatcccgcaagaaatttacgatgcgtggaatgccaaagaacaaggcgcgaaactggaagccgactggaacgaactgttcgcgcaatatcaagccaaatatcctgccgaagccgcagaatttgtgcgccgtatggataaaaagctgccggacaatttcgatgaatacgttcaagccgcattgaaagaagtgtgcgccaaagccgaaaccatcgccacccgcaaagccagccaaaacagcatcgaaatcttggcaaaagagttgcctgaattggtaggcggttctgccgacctgaccccgtccaatctgaccgactggtcaaacagcgtctccgttacccgcgacaaaggcggcaactacatccactacggcgtgcgcgagttcggcatgggtgcgattatgaacggtttggtattgcacggcggcgtaaaacccttcggcgcgactttcctgatgttcagcgaatacgagcgcaatgccctgcgtatggctgcgttgatgaaaatcaaccctgtatttgtgtttacccacgattccatcggtttgggcgaagacggcccgacccatcaaccgattgagcaaaccgccaccctgcgcctgattccgaatatggacgtatggcggccgtgcgacaccgccgaatccttggtggcttgggcagaagccgtcaaagccgccgatcacccgtcctgcctgattttcagccgtcaaaacctgaaattccaagcgcgcagcgagcaacaactgaacgacatcaaacgcggcggctacgtcatcagcgaagcccaaggcaacgcccaagccgtcatcattgccaccggctcagaagtcgagctggctttggaagcgcaaaaagccctcgccgcgcaaaacatcgccgtgcgcgtcgtttccatgccgtccaccaacgtattcgaccgccaagacgccgcctatcaagccgccgtcctgcccgaaggcctgccgcgcatcgccgtagaagccggacacgccgacggctggtacaaatatgtcggactgaacggcgcagtcgtcggcatcaaccgcttcggcgaatccgcccctgccgatttactcttcaaagcattcggctttaccgtggacaatgtggttgatacggtgaaatccgtgctgtaa

SEQ ID NO: 5514 - DNA, 1389 bp, Neisseria meningitidis
atgagcacccgtaccgaacacgacacgatgggcaatgtcgaagtcccatccgaagcctattggggcgcgcagacccagcgcagccgcaacaatttcaaaatcggtggcgaaaccctgccgcagccgttgatttatgctttggcattggtgaaaaaagccgccgctgccaccaatgtttccctcggtaggattaagcctgaacaggcggatttgattacgcaggcggcggatgatgtgttgagcggcaagctcgacgggcagttcccattggtagtgtggcagaccggttccggcacgcagtccaatatgaacatgaacgaagtgctggcaaaccgcgccaacgaaatcgccggtacgggtttggcggcttatcagcccgtccatcccaacgaccatgtgaaccacgcgcaatcgaccaacgacgcattcccgaccgctatccacgttgccgccgcgattgaaatcaaccgccacctcatccccgccgtaaaagccctgcgcgacacgttggacaaaaaagcccaagctttcgcccctatcgtcaaaatcggccgcacccacttgcaagacgcgacgccgctgactttgggacaggaattttccggctacgtttcccagcttgatcacggtttaggccgtctgaacgatgcgcttaaagacttgtatgaacttgctttgggcggtacggcggtcggcacgggtttgaacagccatcccgaatacgccgaaaaagccgccgccaaactcgccgaattgtccggcttgccgtttgtcagcgcgccgaacaaatttgaagccctgggcggacgcgatgccgccgttgccgcttcgggcgcattgaaaacgctggcggcaagcctgaacaaaattgccaacgacatccgttggctggcaagcggcccgcgttgcggtttgggcgaaatcaaaatccccgaaaacgagccgggttcgtccattatgccgggcaaagtcaacccgacccaatgcgaagcaatgacgatggtgtgctgccaagtgttcggcaacgacgttaccatcggtatggcgggcgcgtcgggcaatttcgagctgaacgtctatatgcccgttatcgcctacaacctcttgcaatccatccacctgttgggcgacgcgtgcaacagcttcaacgaacactgcgccatcggcatcgaacccgtgccggaaaaaatcgactatttcctgcaccattccctgatgctggttaccgcattaaaccgtaaaatcggttacgaaaacgccgccaaagtcgccaaaaccgcctacaaaaacaacaaatcgttgcgcgaaaccgccgttgagttgggcttgctgacgggcgaagaatttgacgaactggtcgttcctgccgatatggttcatccgcgctaa

SEQ ID NO: 5515 - DNA, 924 bp, Neisseria meningitidis
atggaaaaccaaaggccgctcctaggcttcgcgttggcacttttggcggcgatgacgtggggaacgctgccgattgccgtgcggcaggtattgaagtttgtcgatgcgccgacgctggtgtgggtgcgttttaccgtggcggcggcggtattgtttgttttgctggcactgggcgggcggctgccgaagcggcgggatttttcttggtgctcattcaggctgctgctgctcggcgtggcgggcatttcggcaaactttgtgctgattgcccaagggctgcattatatttcgccgaccacgacgcaggttttgtggcagatttcgccgtttacgatgattgttgtcggtgtgttggtgtttaaagaccggatgactgccgctcagaaaatcggcttggttttgctgcttgccggtttgcttatgttttttaacgataaattcggcgagttgtcgggtttgggcgcgtatgcgaagggcgtgttgctgtgtgcggcaggcagtatggcatgggtgtgttatgccgtggcgcaaaagctgctgtcggcgcaattcgggccgcaacagattctgctgttgatttatgcggcaagtgccgccgtgttcctgccgtttgccgaaccggcacacatcggaagtttggacggtacgttggcgtgggtttgttttgcgtattgctgcttgaatacgttaatcggttacggctcgttcggcgaggcgttgaaacattgggaggcttccaaagtcagcgcggtaacaaccttgctccccgtgtttaccgtaatattttctttgctcgggcattatgtgatgcctgatacttttgccgcgccggatatgaacggtttgggttatgcaggcgcactgatcgtggtcgggggtgcggttacggcggcggtgggggacaggctgttcaaacgccgctag

SEQ ID NO: 5516 - DNA, 525 bp, Neisseria meningitidis
atgtcattgaacaaagtcatcctcatcggccgcctcggacgcgatcccgaagtgcgctatatgcccaacggcgaggcggtttgtaatttcagcgtcgccaccagcgaaacttggaacgaccgcaacggccaacgtgtagagcgtactgagtggcacaacatcaccatgtaccgcaaactggcggaaattgccgggcaatacctcaaaaaaggcgggctggtttatttggaaggcagaatccaaagccgcaaataccaaggcaaagacggcatcgaacgcaccgcttacgatattgtcgccaacgaaatgaaaatgttgggcgggcgcaatgaaaacagcggcggtgcgccttacgaggaaggttacggtcagagtcaggaggcttaccaacgccccgcgcagcaaagccggcagcccgcctccgacgcgccgtcccatccccaagaagcaccagccgcgccgcgccgccaacccgtgcctgccgccgccccggtcgaggacattgacgacgatatcccgttctga

SEQ ID NO: 5517 - DNA, 1386 bp, Neisseria meningitidis
atgatggcaagagacaaccgcatccaaatgtttccgcacgaatggcgcgccagtacgacgctttccggcgtgtacgcgctgcgtatgctgggtatgttcctcgtgctgcccgtattggcggtgtatgccgcctcgctgcccggcgcggaaggcaacaaaacgctggtcgggctggcaatgggcatttacgggctgacacaggctctgctgcaactgcctttgggcatcgcttccgacaagttcgggcgcaagaaaaccatttatgcgggactggtcgtgtttgcggcgggcagctttcttgccgccgccgccgatacgctgcccatgctggtcgccgcacgcgccatacagggtgcaggggcggtcagtgcggcggttaccgcgctgctggcggatttgacgcgcgacggcgtacgtacccgcgcaatggcgatgatcggtttgagtatcggtttgacgttttcggtcagcctcgtcgttgcccccgtgattgccgacgcggtcggcgttcgcggactgtttatgctgaccggcattctgaccgtcatcagcatcggcgtggtggcgtggatgactcccgatcccgaagtttccaagctgcacgaagatacgcaggcgcagccttcgcgcataggcgaagttttgaaaaaccgtaggctgctgacgcttgatttcggcattttcgccctgcacgccgcacaaatggcattgtttaccgcgctgcctttcgcgatgacccagctcggtttggaaaaaatacagcattggaaagtctatctgccttcgaccattacgggcttggtggtgatggttccgctgattatcgtcggcgagacgcgcaacaagcttaagcaggtttttgttttgggtatcgtctgtattgcggcggcgcagctcggtttgctgtccggtatgcgctcggtaggcttgattaccgcttatttggttgtttactttatcggttttaatgtgttggaagcgagcctgccgtctatggtttccaaaatcgcgccgtccgacctgaagggtacggcgatgggcgtgtacaacacgatgcagtcgctcggactgtttgccggcggcgcggcaggcggtttgctgtttcaaaaatacggcttttccggcgtgtttgccttttgcagtatattgatgctgctgtggctggtaattgccgttttatcgcctgcgcccaagcccgtcaaaaacctcagttaccctgtcggcggcgtgtggcagggcaatcaggaagggttataccgcgccttgtcggagcttgagggtgtggaagacatcggtttcagtttcgacgggcagaccgtctatctcaaagtgttgcagaagggtttcgatcaggctgccgctgaaaaaatcatcacaggagtttaa

SEQ ID NO: 5518 - DNA, 624 bp, Neisseria meningitidis
atgagaaaaccgaccgataccctacccgttaatctgcaacgccgccgcctgttgtgtgccgccggtgcgttgttgctcagtcctctggcgcacgccggcgcgcaacgtgaggaaacgcttgccgacgatgtggcttccgtgatgaggagttctgtcggcagcgtcaatccgccgaggctggtgtttgacaatccgaaagagggcgagcgttggttgtctgccatgtcggcacgtttggcaaggttcgtccccgaggaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttttggaaaaactacatcggcaaaccggcgcacaacctgttcgacatccgcaccaacctgcgttacggctgtaccatcctgcgccattaccggaatcttgaaaaaggcaacatcgtccgcgcgcttgcccgctttaacggcagcttgggcagcaataaatatccgaacgccgttttgggcgcgtggcgcaaccgctggcagtggcgttga

SEQ ID NO: 5519 - DNA, 406 bp, Neisseria meningitidis
ttgcagaacggcattatgcgcaaagcctgccgcaaccgtccgctgacggaggcgcaaaccaaacgcaaccgatatttgtcgaaaacccgttatagtggattaaatttaaatcaggacaaggcgacgaagccgcagacagtacaaatagtacggaaccgattcacttggtgcttcagcaccttagagaatcgttctctttgagctaaggcgaggcaacgccgtactggtttttgttaatccactatatgtggtcgaacagagcttcggtacgctgcaccgtaaattccgctacgcccgggcagcctatttcggactgattaaagtgagtgcgcaaagccatctgaaggcgatgtgtttgaaccttttgaaagccgccaacaggctaagtgcgcccgctgccgcctaa

SEQ ID NO: 5520 - DNA, 492 bp, Neisseria meningitidis
atgaaataccgtcgtttttaccgcaatggcggcacttacttttttacggttgtaaccaataaacggcagaagattttgaccgatgatgcggtgcgtttggctttacggcaggcggtaatggcggtgcgcgaacggtatccgtttgaaattttggcatgggtgttgatgcccgaccatctgcataccatatggcggctgccggacaatgattctgcttattcggaacgctggcggcaaatcaagcggcacagccaatatttaatcggcggcaatctcaggctttggcaaaaacgcttttgggaatatactatccgcgatgaggccgattttgcctggcattttgattatctgcatttcaatccggtcaaacatggctatgtaggacaaatttccgattgggggttttctacgtttcaccgttatgtcaaacagggtatttatccgcataattggggtggcggcaatgcggacttttctattggatacgattga

SEQ ID NO: 5521 - DNA, 830 bp, Neisseria meningitidis
atgaatccagcccccaaaaaaccttctcttctcttctcttctcttctcttctcttctcttctcttctcttctcttctcttctcttctcttccgcagcgcaggcggcaagtgaagacggcagccgcagcccgtattatgtgcaggcggatttagcttatgccgccgaacgcattacccacgattatccgaaagcaaccggtgcaaacaacacaagcacagtaagcgattatttcagaaacatccgtgcgcattccatccacccccgggtgtcggtcggctacgatttcggcggctggaggatagcggcagattatgccagttacagaaaatggaacaacaataaatattccgtaaacacaaaagagttgcaaaaaaacaatagcagtggcatctggcaagaactgaagacggaaaatcaggaaaacggtacattccacgccgcttcttctctcggcttatccgccatttacgatttcaaactcaacgataaattcgataaattcaaaccctatatcggtgcgcgcgtcgcctacggacacgttaaacatcaggttcattcggtgagaaaagaaaccacgactactttcagtccaccagcgcaaggcgctacagtgccaggcaaaatcgtacaaggtccgaccaacaaacctgcctatcacgaaagcaacagtatcagcagcttaggtcttggtgtcatcgccggtgtcggtttcgacatcacacccaagctgactttagacaccggataccgttaccacaactggggacgcttggaaaacacccgcttcaaaacccacgaagtctcattgggcatgcgctaccacttctga

SEQ ID NO: 5522 - DNA, 732 bp, Neisseria meningitidis
gtgtcgcgcgaaatcaatgcgggcaggcatcatttcctctacggcggcatcagcggcggcggcgtgcattattgggataacaaagatttcagcgaacagagcctgcgcctgtcgttcggctataaaaaccgttcggtaacgcgctcgttcggcatcgtgccgtttgtcgagcaaaacctcttaggcggcagccgatacaatttcgtcggcggcttcaatgccgatttctcccaacgcttgagcgaacgctggcggttgacactaaacgcgggcaatatgtggaagcattatcaggaagaccgcaccgccgcccgatacgacagccatatgccgctggcgggcgcgacgctgatgtattccgcgccgaaagactggctgctttacggcggtgcggactggtcgcacaacataacgaaagaggcggaacaggcttccatccgcaagggtttgcgtgtcggcgcggtcaaaacgttcgacggcggcttgggtctgcgggcaaacctgcgctatacccgcaggatgtttgacgcacccgggaccattgtgtaccgcttcccgcgcaaagaccacgaatatcaggcaaacctgtcgttgtggcatgacaaaatctcttggaagggctttacgccgcaactcaatttccgctatctgaaaatcgacagcaatatgaaaagtttttacacacgcaaaaacatgcagattttcatgagcgtggaaaaggatttcaaataa

SEQ ID NO: 5523 - DNA, 1509 bp, Neisseria meningitidis
atgaccaccacccccgcaaacgtcctcgcctccgtcgatttgggttccaacagtttccgcctccagatttgcgaaaacaacaacggacaattaaaagtcatcgattcgttcaaacagatggtgcgcttcgccgccggactggacgaacagaaaaatctgagtgccgcttcccaagaacaggctttggactgtctggcaaaattcggcgaacgcctgcgcggcttccgccctgaacaggtacgcgccgtggcaaccaacacattccgcgttgccaaaaacatcgcagatttccttcccaaagccgaagcggcattgggtttccccatcgaaatcatcgccgggcgcgaagaggcgcggctgatttataccggcgtgatccacaccctccccccgggcggcggcaaaatgctggttatcgacatcggcggcggttcgacagaatttgtcatcggctcgacgctgaatcccgacattaccgaaagcctgcccttgggctgcgtaacctacagcctgcgcttcttccaaaacaaaatcaccgccaaagacttccaatctgccatttccgccgcccgcaacgaaatccagcgtatcagcaaaaatatgaggcgcgaaggttgggatttcgccgtcggcacatcgggttcggcaaaatccatccgcgacgtgcttgccgccgaaatgccccaagaggcggacattacctacaaaggcatgcgcgccctcgccgaacgcatcatcgaagccggttcggtcaaaaaagccaaatttgaaaacctgaaaccggaacgcatcgaagtttttgccggcggacttgccgtgatgatggcggcgtttgaggaaatgaaactcgacaggatgaccgtaaccgaagccgccctgcgcgacggcgtgttttacgatttgatcgggcgcggtttaaacgaagatatgcgcggacaaacggttgccgagttccaacaccgctaccacgtcagcctcaatcaggcgaaacgcaccgccgagaccgcgcaaacctttatggacagcctctgccacgctaaaaacgttacagttcaagagcttgccttgtggcaacagtatctcggacgcgccgccgcgctgcacgaaatcggtttggacatcgcccacaccggctatcacaagcattccgcctacatcctcgaaaacgccgatatgccgggtttctcacgcaaagaacagaccatacttgcccaactggtcatcggtcatcgcggcgatatgaaaaaaatgagcggcatcatcggcaccaacgaaatgttgtggtatgccgttttgtccctgcgccttgccgcactgttctgccgttcgcgccaagacctgtctttcccgaaaaatatgcagttgcgcacggatacggaaagctgcggcttcatcctgcgtattgacagggaatggctggaacgccatcccctgattgccgacgcattggaatatgaaagcgtccaatggcaaaaaatcaatatgccgttcaaagtcgaggccgtctga

SEQ ID NO: 5524 - DNA, 324 bp, Neisseria meningitidis; identical to SEQ ID NO: 1799

SEQ ID NO: 5525 - DNA, 84 bp, Neisseria meningitidis
atgggcaaaatcagccgattgatggaacacggtccgatttttaagcaaaaccttaatcaacaactcaagaaggataagacatga

SEQ ID NO: 5526 - DNA, 546 bp, Neisseria meningitidis; identical to SEQ ID NO: 427

SEQ ID NO: 5527 - DNA, 1011 bp, Neisseria meningitidis
atgagcaaaaaacgagttctgaccggcgtaaccaccaccggcatcccgcatctgggcaactacgtcggcgccatccgccccgccgtccgcgcggcgcaaaacctcgataccgaatccttcctcttcctcgccgattaccacggtatcatcaaatgccacgagccggagatgattcaccaatccacccaagccgttgccgccacttggcttgcctgcggactcgaccccgagcgcaccaccttctaccgccaaagcgacactcccgaagtgatggaattgaactggattctgacctgcatcactgccaagggtttgatgaaccgcgcccatgcctacaaagccgccgtgcaggcaaatgcagaaaacgggcaggaagaccctgatttcggtgtggaaatgggtttgttcagttatccgattctgatgactgccgatattctgatgttcaacgccaacgaagtgcccgtcgggcgcgaccaaatccaacacgtcgaaatggcgcgcgacatcgccggccgcttcaaccaccgcttccgggaactcttcaccctgcccgaagtgaaaatcgatgaaaacgtcgaactcttggtcggtttggacggacgcaaaatgtccaaatcctacggcaacaccattccgctttgggaaaacgacaaaaaaacccaaaaatcggtcaacaaaatcatcaccaatatgaaagagccgggcgagccgaaacagcccgacgaaagcccattgtttgaaatctacaaagccttctccacgccgtctgaaacggtggaatttacgaaaatgcttgccgacggcttggcgtggggtgaagccaaaaaacttttggcggcgaaaatcaacgccgaactcgccgaaccgcgcgaacgctacaacgagctgaccgccgacccttcgcaaatcgaagagattttgcaggcaggcgcggcgaaagcgcgtaaagaagcacgcgaattattggacaaagtacgcgatgcggtcggcatccgcccgttgaaatga

SEQ ID NO: 5528 - DNA, 2580 bp, Neisseria meningitidis
atgcgatacgacaaattaaccgccaaattccaacaagcccttgcagaagctcagagtttggcgttggctgcggacggcagctatctggaagcgggctttgtgttaaaagccctgcttgacgaccaaaacagcggagccgccgcgctcttggctcatgcgggcgtgaacgtgccgcaggtgaaacagcgtttgcagcagcatttaaacagcctgccgaaagtgtccggtcagggcggcgatattctgcccagccgagaattgcaggcggtgttgaacctgatggacaaagctgccaccaaacgcagcgatgcctatattgccagcgaacttttcctgcttgccttggtacagcagaacgatgcgaccggcaaaattttgaaagaagccggcgcgaccgaacaaaacatcaatgccgcgattgacgcagtacgaggaggacaaaacgtgaacgatgccaatgccgaagaccaacgcgatgctttgaaaaaatatacgcttgacctgacccagcgcgcccgcgacggcaaacttgaccccgttatcggtcgtgacgacgaaatccgccgcgcgattcaggtattgcaacgccgtaccaaaaacaaccctgtgctgattggtgagccgggtgtgggtaaaaccgccattgttgaaggcttggcgcaacgtatcgtcaacggcgaagtacctgaatccctgcgtaacaaacgcttgctggttttggatttggcggctttgattgccggcgcgaaataccgcggcgaatttgaagaacgcttgaaaggcgtgttgaacgatttggcgaaagacgacggcaacactctgattttcattgatgaaatccatactttggtcggcgcgggcaaaaccgacggcgcgatggacgcgggcaatatgctgaaaccggctttggcacgtggcgaattgcactgtatcggcgcgaccactttggacgaataccgccaatacatcgaaaaagatgcggcactcgaacgccgcttccaaaaagtattggttggcgagccaagcgtggaagacaccatcgctattttgcgcggtttacaggagcgttatgaaatccaccatggtatcgatattaccgaccctgctatcgttgccgcagcggagttgagcgaccgctacattaccgaccgcttcctgcccgataaagcgattgatttgattgacgaagccgccagccgtgtcaagatggaaaaagaaaccaagccggaagcaatggacaaaatcgaccgccgtctaattcagcttcggatggaaaaggcgcacgttgaaaaagaaaaagacgatgccagcaaaaaacgtttggaactgatagacgaggaaatcaacggtctgcaaaaagaatacgccgatttagacgaaatctggaaagccgaaaaagcaatttcagacggtgctgctaatattaagaaacaaattgacgaagtcaaaattaaaatcgaacaggcaaaacggcaaggcgatttggcactggcttcaaaattgatgtatgaagatttggagcatttggaaaaacagcgtgcagccgccgaacgggcagatacggacagcacaaaaccggcaaacaaactcttgcgtaataatgtcggcgcagaggaaatcgcagaggtggtttcccgtatgaccggcattcccgtatccaaaatgatggaaggcgaacgcgacaaactgctgaaaatggaagaagtattgcaccgccgcgtggtcggacaggacgaagccgtgcgtgccgtgtccgacgctatccgccgcagccgctccggtcttgccgatccgaacaagccttacggcagcttcctgttcttgggcccgaccggcgtgggtaaaaccgagttgtgtaaagccctggcaggctttctgttcgacagcgaagatcatctgattcgcatcgatatgtccgaatatatggaaaaacacgccgttgcccgcttaatcggcgcgcctccgggctatgtcggctacgaagaaggcggctacctgaccgaacaagtgcgccgcaaaccgtacagcgtgattctgctggacgaagtggaaaaagcccatcccgatgtgttcaacatcctgctgcaagtattggatgacggccgcttgaccgacggacaaggtcgcaccgtggacttcaaaaataccgttatcgtgatgacttccaatattggtagccaacatatccaacaaatgggcattcaggattacgaagcggtgaaagaagttgtgatggaggatgtgaaagaacatttccgccccgaaatgatcaaccgcatcgacgaagtggtcgtgttccacggactggatcaggataatatccgcaacattgcgaaaatccagctcaaaggcttggaaaaacgtttggaaaaacaaaacctgcgcctggctgtttccgatgccgcactggacatcatcgccaaagccggtttcgacccgatttacggcgcacgtccgctcaaacgcgccatccagtcggaaatcgaaaacccgctggcaaaagccctgcttgccggaaactatgcgcccgaaagcgaaatcagggtggaagccgacggcgacagactgaaatttgcctga

SEQ ID NO: 5529 - DNA, 1215 bp, Neisseria meningitidis
atggataaatttcccaagtctgcaaagctcgatcacgtctgttacgacatacgcgggccggttcacaaaaaagcccttcagttggaagaggagggcaataaaatccttaaactcaatatcggcaaccctgcgccgttcggctttgaagcccctgatgaaatcttggtcgatgtcatccgcaacctgccgacttcgcaaggctattgcgattctaaagggctgtattccgcccgcaaagccattgttcactactatcagaccaaaggtttgcgcgatattacggttgatgatgtctatatcggcaacggcgtgtccgagctgattacgatgtctatgcaggcattgctcaacgacggcgacgaaatcctgattcccgcgcccgactatcccttgtggacggcggcggcaacgcttgcgggcggtacggtacgccattatctgtgcgacgaagaaaacggctggttccccaaccttgccgatatggaagccaaaatcacgcccaaaaccaaagccatcgtcgtcatcaatcccaataatccgacaggcgcggtgtacagcagggaaatcctgttggaaatcgccgaactggcgcgcaagcacggtttgattattttcgccgacgagatttacgacaaaatcctttatgacggcgcggttcaccaccacatcgccgcgcttgcccccgaccttttgacggtaacgttcaacggtttgtccaaagcctaccgtgtagccggattccgccaaggctggatggtgctcaacgggccgaaacatcatgcaaaaggttacatcgagggtttggatatgctctcgtctatgcgcctgtgtgccaatacgccgatgcagcacgcgattcagacggcattgggcggctatcagagcatcaacgaattcattttgcccggcggacggcttttggaacagcgcaacagggcgtgggaactggtcaaccagattcccggcgtatcctgcgtcaaaccgatgggcgcgatgtatatgttcccaaaaatcgataccgaaatgtaccgtatccgcgatgacatgaaattcgtttacgatttgctggtgcgcgaaaaagtcttgctggtgcagggaacggggtttaattggatcaagcccgaccatttccgcattgttacgctgccttacgtccatcagattgaagaggcgatgggcaggctggcaagattcctgcaaacctaccgccaataa

SEQ ID NO: 5530 - DNA, 210 bp, Neisseria meningitidis
atgccttatgtcaatattaaagtaaccggcggcaaggaagcaccgactgccgcgcaaaaagcggaactgatcggcggcgtaaccgaattgctggcacgcgtgctgggcaaaaatcccgaaacaacggttgtcgtgattgacgaagtggataccgataactggggaataggcggcaaaagcgtcagcgaacggcgcaaagagggcaggtaa

SEQ ID NO: 5531 - DNA, 807 bp, Neisseria meningitidis; identical to SEQ ID NO: 3785

SEQ ID NO: 5532 - DNA, 1266 bp, Neisseria meningitidis
atgtctgaagcccttgcaaaagaaaccctcaatccgtttgaaatcgcgcgcaaacaggtgaaaaccgcctgtgaccggctgaaaaccgatccggccgtttatgaaatcctgaagagtccgacccgcgtgttggaagtcaattttcccgtcaaactcgacgacgacacggtcaaaaccttcacgggctaccgttcgcaacacaacaacgccgtcggcccctataaaggcggcgtgcgcttccatcccagtgtgaatttggacgaagtcaaagccctgtcaatttggatgaccatcaaatgctgcgttgcgggtattccttacggcggcggcaaaggcggcattaccttggatccgcgcgattattccgaggcggaactggaacgcatcgcccgcgcttatgctgaagcgattgccccgctgattggcgagaaaatcgatattcccgcccccgatgtgaataccaacggcaaaattatgtcgtggatggtggatgcttatgaaaacgtggtgaaacattccgcgccgggcgtatttaccggaaaaccggttgagttcggcggctctttggcgcgtaccgaggctaccggttacggcgtgaacctcgccgccgtccaagctttggaaaaactgggcaaggacgtgaagggtgccacttacgccattcaaggtttcggtaatgtgggttaccacacaggttattacgcgcatcaatccggcgcgaaagttgttgcggtttctactgttgacgttgccatttacaacgaaaacggtttggatatggaagctttgtttaaagagttccaagaaaaaggcttcatcaccaacgaagccggttacggcaaagaaattaccaacgccgaacttttggctttggatgtggacgtactcgccccttgcgcgctggaaaaccaactgacttccgaaaacgccggtaaagtccgcgcgaaaatcgtagtcgaaggcgcgaacggcccgactacgcccgaagccgacgtgatcctgcgtcaaaacggcgtattggtcgtgcctgatattctggcgaactgcggcggcgtggtcgtttcctatttcgagtgggtgcaaaacctgcaaggctattattgggagtttgacgaagttcaagagaaagaaaccgtcgtcctgcgacgcgcgttccgcgatatatggaacttggcgcaagagtatgatgtcgatttgcgaaccgcgtcttacatgatgagtatccgccgtgttgaaaaagcgatgaaactgcgcggttggtattga

SEQ ID NO: 5533 - DNA, 186 bp, Neisseria meningitidis
atgtgttccgcttttttcagacggattccgtgcggcttgggaaataaaatcatatatagattaatcaaatcgggccgattccaactacacgctattacattttgcttgaaaattggttatagttgcgaacctgatggcttgttccattccgaacctctctttgtgaaaaggaagcaaaatgtctga

SEQ ID NO: 5534 - DNA, 707 bp, Neisseria meningitidis
atgaatgcagccatcgaacacgtccaagccgtcgccttcgatttggacggcacactgtgcgattccgtccccgaccttgccgccgccgcagaagcgatgttggaacaactcggtatgaaaccgctgcctgccaaagtggtcgaaagctatgtgggcgacggcatcggcaaactggttcaccgcgtcctcaccaacgaccgcgaccgcgaagccgattccgaactgtgggaaaaaggtttcgtatctatatgaaatactaccgcgaccatttgagcgtcttcacccgcccctatcccgaaaccgaagccgggctggcattgcttaaatctttgggcatcccgctcgccgtcgttaccaacaaaaacgaaatccttgcctccgagcttctaaaacaactgggactcgccgactattttagcctgatactcggcggcgacagcctgcccgagaaaaaacccagccccctgccgctgcggcacgccgccgaagttttgggtatcgatgttgcaaacatggttatggtcggcgactcgcgcaacgacatcatcgccgccaaagccgccggctgcctgagcgtcggcgttaccttcggttacggcgatatgacgctgctctcgcaagacgatgcgacccgccccgactggattatcggctcgctgcccgaaatttacgaaaacctgcaacctcagaaaaacaaagaagagtag

SEQ ID NO: 5535 - DNA, 462 bp, Neisseria meningitidis
atgaaaccgcaaaaatccctacgcgcccgcgcgatggacatcctctcgcgccaagaactcagccgcatcggtctgaaacgcaaacttgcaccgcacgccgaaagcgaagaggagttggaaaacgtgttaaacgaatttgccgaacgcaactggcagtcggatttgcgctatgccgaagcctatatccgcagcaaaagccgcaaacacggttcattgaggctgaaacaggctttggcgcaacagggcatagatgaagaaaccagccgcaacctgcttcccgaccgctcaagcgaaaaactggccgccatagccgtgttgcgtaaaaaattcaaacatccggccgccgaccttaaagaaaaacaaaaacaggcacgcttcctcgcctatcgcggttttgatgccgataccgttcagacggcattgaaacatgcctgggatgacggctgggaggaagactgctga

SEQ ID NO: 5536 - DNA, 162 bp, Neisseria meningitidis
atgtccgaacaatccgagaaaaatcacaacccacttcttgaagatgaacgcaaaaacccggtttaccgtatgggtcaggcagttgccggattcatgctcgtcgtttgggcaggcgtattggcactcgtgtttttcctagtcttccgtttttggctttcctaa

SEQ ID NO: 5537 - DNA, 135 bp, Neisseria meningitidis
atgccgtctgaaaccttcagacggcatcggcagcccatttcggcaggctatcccatcatagctttttttagcttgaattccactttcccattccctaaaatttttccacacccatttcaaaataccctttcttaa

SEQ ID NO: 5538 - DNA, 483 bp, Neisseria meningitidis
atgacacaacaacgccaactgccttcgcacgaactcattatgtccgaactgatgatgccggacaccgccaatttcagcggcaacgtacacggcggcgaactcctgctcctgctcgaccaagtcgcctattcctgcgccagccgttacagcggcaattattgcgttaccctgtcggttgacaaagtcctgtttaaagaacccatccatgtcggcgacctggttactttctacgccagcgtaaactacacggggcgtacctctatggaaatcggcatccgtgtcgaagcacaaaacatccgtacgggagaaatccgccataccaacagctgctacttcaccatggttgcagtcaaagacggcaaacccgtccctgtccctccgctggaaatcctgaccgaccgccaacgctgccgctacgaaaaagccaaaaaacgcagagacatcagcctgcaagcctccggagacgtgtcctgcggctgctga

SEQ ID NO: 5539 - DNA, 1248 bp, Neisseria meningitidis
atgttgaaacaaacgacacttttggcagcttgtaccgccgttgccgctctgttgggcggttgcgccacccaacagcctgctcctgtcattgcaggcaattcaggtatgcaggacgcgccgtcttcggcagtttacaacaacccctatggagcaacgccgtacagcccggctcctgccggcgatgcgccttatgtgccgccggtgcaaagcgcgccggtttatacgcctcctgcttatgttccgccgtctgcacctgccgtttcgggtacatacgttccttcttacgcacccgtcgacatcaacgcggcgacgcatactattgtgcgcggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgcgcaaccgcccgtacagtccgcacccgtcgacattaacgcggcgacgcatactattgtgcgcggcgacacggtgtacaacatttccaaacgctaccatatctctcaagacgatttccgtgcgtggaacggcatgaccgacaatatgttgagcatcggtcagattgttaaagtcaaaccggcaggatatgccgcaccgaaaaccgcagccgtagaaagcaggcccgccgtaccggctgccgtgcaaacccctgtgaaacccgccgcgcaaccgcctgtgcagtccgcgccgcaacctgccgcgcccgctgcggaaaataaagcggttcccgcgcccgccccgcaatctcctgccgcttcgccttccggcacgcgttcggtcggcggcattgtttggcagcgtccgacgcaaggtaaagtggttgccgatttcggcggcaacaacaagggtgtcgatattgccggtaatgcgggacagcccgttttggcggcggctgacggcaaagtggtttatgccggttcaggtttgaggggatacggaaacttggtcatcatccagcataattcttctttcctgaccgcatacgggcacaaccaaaaattgctggtcggcgaggggcagcaggtcaaacgcggtcagcaggttgctttgatgggcaataccgatgcttccagaacgcagcttcatttcgaggtgcgtcaaaacggcaaaccggttaacccgaacagctatatcgcgttctga

SEQ ID NO: 5540 - DNA, 747 bp, Neisseria meningitidis
atgaacgttttgatttccaacgacgacggctacctctccgaaggcattgccgttttggcgcgcgttacggcggaatttgccaacgtcagggtggtcgcgcccgaacgcgacaggagcggggtcagcaattcgctgacgctggaacgccctttgcagttgaaacaggcgcaaaacgggttctactatgtcaacggcacgccgaccgactgcatccacatcgggcagtctgtattttcggattttcaggccgattttgtcttttcgggcatcaaccggggcgcgaatatgggggacgacacgctttattcggggacggttgcggcggcaaccgaagcctaccttatgggcatacccgccgtggcgttttccttaaacgacgcttccggacgctattgggcgaccgcagaacaggcactgtggacattgttggcgcattttttcaaaaaccccccgcagtcccctattttgtggaacatcaatatccccgccgttgcgccggaagatgtgcggggcattaaaatcgcccgtttgggcaggaggcatcacggtcagaacgtcattcccgcgcgcaatccgcgcggcgaacagatttattggataggaccggtcggcgaagtttccgatcgggaagagggaacggatttcggtgaatgcggcgcaggtttcattaccgtaacgccgctgcaaatcgacctgaccgcctatccggacatggcggaaacagcggcgttctggcatgcggactga

SEQ ID NO: 5541 - DNA, 1557 bp, Neisseria meningitidis
atggatttcagttggttggcagaaccgcatacctggataggttttgccacgcttttggtgttggaagtcgtattggggatagacaatcttgtctttgtggcgattttggcaaacaaggtccagcccgcacggcgcgaccgcgcacggattatcgggctggggctggcagtcgtcatccgcatcattatgcttgcttttatggcgcacatcatcacgctgaccgagccgctgttccaaatcggcggcctcgccgtttccggcaaggacatgattatgctcgcgggcggtattttcctgctttacaaagccaccaccgaactgcatgaacgcctcgaagggcacaaccgttttaccgttgccgacagccaaaaaaaacacgcgccgttttggggcgtggtcgcgcaaatcctgatactggatgccgtgttttccatcgattcggtcattactgcggtggcgatggtcgatcatatcgtcgtggcgatgggtgcggtcgtcgtcgcgatggctgtaatgatttctgccagcaaactcttgaccgaatttgtcgacagacaccctaccgtcgtgatgctctgccttggttttttgttgatgatcggtttcagcctgattgccgaagccttccatttccacattcccaaaggctacctctacgccgccatcggcttctcgattttaatcgaattgtttaaccagatttcgcagcgcaacagccgcaaaaacgactacatcggcagctcgtggcgcaagcgcaccgccgaaaacgtcttgggtatgatgggtatacgcgaaagcgtgcttgccgacgcgggcggcgaatccggggacgacgcgcattttgaagaaaacgaaaaatcgatgatacgcagcgtgctgacgcttgccgaacgcccgattatgggggtgatgatcccacgccgcgacatcgaacggctggacatttcccaaagccgcgaagaacagtgtgcccaactgcaaaacacgccttacagccgcctgctcgttgtcggtaaggcgggcgtggacgaacctttgggctacatcaacaaaaaagacctgctgtcccaactgctggaaacaggcggtctcgacattcagacggcattgcgccagccgctcgtcctgcccgacagcaccaccgcgctgggcgcaatcgaactcttccgccaaagcagcgcggattatgctttggtggtggacgagttcggcgcggtattgggcatggtaaccatgaaagacctgctcgaaaccatcgcaggcgagttccccgaagaatttgagcgcgaagaagaaccagccgttcaggggaatcccgatgaaagcctgacggtggaaggcgcgttggaatatgtggaactcgcaccgcaactcaacctgccgcagcaggaggaagatgccgatttccatacggttgccgggctgattatggaagaattgcaaaccatccccgatgtcggcgattttgccgatttccacggctggcggtttgaagtggtcgaaaaagaagggcagcgcatcgagcgggtcaaaatcaccaaattgcccgaagaataa

SEQ ID NO: 5542 - DNA, 141 bp, Neisseria meningitidis
atggcgttttgccattgccccgataagctgttaaactatttaaattatttcgaccgaaggtacacgcacatgcaagaccccgagcagagcagcaagcccgcccgccgttttttgtgcgtaccgtctgttcaggcagcttga

SEQ ID NO: 5543 - DNA, 789 bp, Neisseria meningitidis
atgatggaaaacggaaaaacagtcccgagatggcgttttgccttgaaaagtgcgggctggcacctcttaatcagcctgtcggttgcagggctggcggcattgctggtttttaaggtttggtatccttatccttatgccgagctgacgggagggctgtcgctttatcagctggtggtggctgtcgatattgtatgtggtccgctgctgactttaattttggcaagcccgaagaaaaagacaaaggcacgcatggtcgatttttccatggtcggcatcatccagctggcggctttggtgtacggtctgcacagcgtttcgctggcgcgtcctgtggtggaagcgtttgaacaggatcgtatgaccattgttacggcggcggaagtcgtggtcgaagatttgcacaaagcccccgaagggctgcaaagcctgtcgtggttcggcatccgccgcattgcattgaaagaacctgaggatgcggatgagaagaacaagacgctggatttgtccctgaaaggtatcgagccgagtatgcgtcccgaccagtggctgccgtattccgacaaggaagcagaagaaatccgcaaacatctgaaaccgctgaaagtcttggcggatgcgagaaaaacgacggttgcggacattctgaaacaggcaggtctcgccgaaggggaggagctgtattacctgccgtttaccagcagcaggcagaaagagtggatagtcattaccgataaagagggcaacaccaaaggctacgcgccgatagacggcttcatcatcaccccttaa

SEQ ID NO: 5544 - DNA, 1434 bp, Neisseria meningitidis
atgaacgaatattcccaattaatcaagcatcccgatatttcccttcccccggtttcagacggcatcaaagtcgataatccggcaacgggcgagactttggcgtttgtccgcaagacggattcggacaagctgaaaaacctgattcaaaaagcagctgcagcacaaaaattatgggcggcaaaaactgcgttggaacgcgccgatgtgttgtggcgttggtattttcagattaaagaaaacaaagaagcattagcgcgcctgatgacgatggagcagggcaaaagcctgaccgaggcgcgtggcgaaatcgattatgcggcttcgtttgtgcgctggtttgccgaagaggcgcggcggattgacggcgatgtgctgacgagtgtgaaagcgtcgcaaaaactggtcgtgttgaaacagcccgtcggcgttaccgctgcgattacgccgtggaactttccgtccgcgatgattgcgcgcaaggccgcgcctgctttggcggtgggttgcgcgatgatcgtcaaacccgcatcgctcacgcctttgagtgcgtatgccttggcttcgttggcttacgaagcgggcataccgcaggatttgttgcctgttgtcagcggcagtgcttcggaaatcggccatgaatttgctacgaacccgattatccgcaaaatcagcttcaccggctcgaccgaagtcggcgcaaaaatttttgccgacagcgcggcggacattaaaaaactcagtttggagctgggcggcaacgcgccgtttatcgtgtttgacgatgccgatttggacaaagccgtcgaaggcgcgctcgccagcaagttccgtaacagcggtcagacctgcgtctgcaccaaccgcgtttacgctcaatccgccatttacgacgaattttgccgcaaattgagtgaaaaagcagccgcgctcaaattgggcaacggcttggaggatggtgtgaaccaagggccgctgattgaggaaaaagcggtggagaaagtcgagcagcacatcgccgacgcgcttgctaaaggtgcaagctgcctgaccggcggcaaacgcagcgcgttgggcggaacgtttttcgaaccgactgttttaagcggcgtaacggcgcaaatggcggtggcacgcgaagaaaccttcgggccgttgtgtccggtattccgttttgaaaccgaagccgaggtcatcgaggctgcgaacaatacggaatacggtttggcagcttaccttttcaccgccgacaccgcccgccaatggcgcgtcggcgaagccttggaatacggtatggtcggcatcaatacgggcttaatcagcaatgaagcggcaccgttcggcggcgtgaaacgtagcggtttgggacgtgaaggcagcaaatacggtgcggacgaatatctagaattgaaatatctgtgtatggatgtcgggtga

SEQ ID NO: 5545 - DNA, 495 bp, Neisseria meningitidis
atgatttttaaacagaatcaaaattattgggcagtttttgatgctaataaagaaactctgattgttcaaacatgttcaggtttggggttaacggcaatagaccacctatatcccccccatatcctgccattggataccgacaatgaaactttaggcacgacagtcttgcaagcgttggcaaacagcaggactttcgtttatgacagtccagaagaccaagatttttttgataccgaaaaaattcggcaacgctatgaggattgggttgccaagctatgcgggaacttgggctataaaaccagacgcgccctatttaaaaacatgatgagcgtggatatttggctgcacaacggctgcctgaaaatcagcccgagccgccatgtcaagctggaagcgtggaatgccattgatgcagacgatgtcattttatcattggataacagccctgaagaaatcggagcaggtttaaagttggcattgagccactgccgataa

SEQ ID NO: 5546 - DNA, 432 bp, Neisseria meningitidis
atgatgacggcggacgcgggcatatgccgcccgttcaaaaccaagccggcacggacgattttcgggcgttttcctgcgagaacggtttgtctgtgcgcgtccgccatttggacagcggcaaagtcgcgttgcggctggacggcaggcgtgccgtcctctcttccgacgttgccgcatccggcgaacgctataccgccgaacacggtttgttcggaaacgcaaccgagtggcaccagaaaggcggcgaagcctttttcggctttaccgatgcctacggcaattcggtcgaaacttcctgccgcgcccgttaaacggggcagcctgtttgaaccgccgtccagatttttcgggcggttttttgtgtcggacggacggttttttgtgtcggatttgttttgcagttcggcctccggcagggttcgggctgcctga

SEQ ID NO: 5547 - DNA, 90 bp, Neisseria meningitidis
atgaaacagtgcgcttgtcgggatttgtgccttatgcccgcatcaaacagtgcagggatgcgggcgcacaaaacgttaaacgccgaatag

SEQ ID NO: 5548 - DNA, 69 bp, Neisseria meningitidis
atgcctgaacggcgggaaacggccgaaccatctgccggcacgggcacaaaccggagtctgaatgattga

SEQ ID NO: 5549 - DNA, 2082 bp, Neisseria meningitidis
atgaaatcactcaaaaccttcctcatttggggcatagtggtactggtcggcttagcatcctttaccactctggccctcagccgaggcgaacaggtcagcgcggtatggatggtcaccgccgccatatccgtttactgcatcgcctaccgtttttacagcctctacatcgccaaccgcgtaatgcggctcgatcctgaccgcctgactccggcagaacgccacaacgacggcttggactacgttccgacgcacaaaggcgtattgttcggacaccactttgccgcaattgccggcgcgggccctttggttggtccggttttggcggcgcaaatgggttatctgcccggtactttgtggattatcttcggcgtggtatttgccggcgcggtacaggatatgatggtcttgttcgtctctatgcgccgcgacggtaagtctttgggcgatattgtgaaacaggaactcggcactgtccccggcgtgattgcctccatcggtattttgatgattatggtcatcattatggcggtgttggcgttgattgtcgtaaaagcattggttcacagcccttggggtacgttcaccattgcagcaactatgccgattgcgctgtttatgggtatttacacgcgttatatccgtccgggcaaaatcggcgagatttccatcgtcggctttattttgctgatgctggcggtaatttacggcgaagatgtggctaaaagttccatcgggcattggttcgaccttgacggcatccagctcacttgggcgattatgatttacggctttgtcgcctccgtattgcccgtatggttgctgctcactccgcgcgactatctctccaccttcctgaaaatcggtacgattgcggccttggctttgggtatcgtcatcgtcaatcccgctttgcaaatgcctgccgtaacccactttatcgacggttcgggtccggtattctcaggcgcattgttcccattcttgttcattaccatcgcctgcggtgcggtttcgggcttccacgcgctgatttcttccggcactacgccgaaaatgctggaaaacgaaacccacgtccgcatgatcggttacggcggtatgttgatggaaagtttcgtagccattatggcacttgccgctgccgcatcgcttgatcccggcgtgtacttcgccatgaacagcccagccgccctgatcggtacggatgccaataccgccgccgaagtgattaccaccaagctgcaattccctgtcgatgccgcaaccctgttgcacactgctaaagaagtcggcgaaaacaccatcctttcccgtgccggcggtgcgcccaccctcgcagtcggtatggcgcacattatgagccgcctgattccgggcgaggcgatgatggcgttctggtatcacttcgccctgttgtttgaagccttgttcatcctgaccgccgtcgatgccggtacgcgcgtcgcacgttttatgattcaagacttgggcagcatcttctacaaacctttcggcaacaccgactccatccccgccaacctgattgcgaccttcttcgccgtggcattgtggggctacttcctctacacgggcgtgaccgacccgttgggcggcatcaactcgctctggcctttgttcggcatcgccaaccaaatgctggcaggcgtagccttgattatgtgcgccgtggtgctgattaagatgaaacgcgaccgttatgtctgggtggtactcgttcccgccgtcggcgtactgttcgtaacctgctacgccggcctgcaaaaactgttccacagcgacccgcgcatcagcttccttgcccacgccggcaaatacagcgacgcattggctaaaaacgaaatccttgcgcctgccaaagacatcggcgaaatggcgcaaatcatcttcaacgacaagattaatgccggtctgaccatcctcttcttgtcggttgtcgtgattgtcgccgcgtacggtttgcgtaccgccctcaaagcacgcaaagtcggctggccgaccgccaaagaaatcccggcggtgtaccgcgacggcaaacagccggaggcacaaagtgaagcataa

SEQ ID NO: 5550 - DNA, 195 bp, Neisseria meningitidis
gtgaagcataagctcgcgtcttggtggaaaaccatcaagctgacggcaaacttgatggcaggcgtgcccgattatgaaaactacgttgcacagcagcgcaaacataatcccaacgcccccgtgatgaccaagctgcagtttcaagactattgccgcaaacgccgctgcggcgcaaacggcggacgctgctgttaa

SEQ ID NO: 5551 - DNA, 195 bp, Neisseria meningitidis
atgaatccttcgcaatatctgtttatcgacctcaattttgacaaaataccggatacgcgcctttgttgcttttccatcttccaaccaactgtaaatctcaaacagccggtacacgccatgcttcagtttcttttcctgtcggcggattgtttcgacaaagaattgaaaatccatttcatgcaccttaaaatttaa

SEQ ID NO: 5552 - DNA, 561 bp, Neisseria meningitidis
atgaaaaacctcatcgccttcaacaaaccctatggcgttatctgccaattttcaccgcacgaaaaacacaaaagcctcaaagactttatcaatcttcccggcttctaccccgccggacggctcgacaccgacagcgaggggctgctgctgctgaccgacgacggcaggcttcaggcacaaattaccgaccccaaattcaaacaccctaaaacctactgggcgcaactggagggcgtacccgacgaaagccgattggaaagcctaagaaaagggatagacttaggcggtttcgttacccgtccggcaagcatccgcatcttgaaacacggagaagcagattcgttatgggagcgcatcccgccgatacgcgtccgcaaaaccgttcccgatttttggattgaaattaccatttctgagggcaaaaaccgccaagtcaggcgaatgaccgccaaggcgggctatccctgcctgcgtctgatcagagtggcaagcggcaggctgaaactgtttgatttggatttaaaacccggggaatgggcatacgccccgtttaaaccataa

SEQ ID NO: 5553 - DNA, 2766 bp, Neisseria meningitidis
atgagatcttctttccggttgaagccgatttgtttttaccttatgggtgttacgctatatcattatagttatgccgaagatgcagggcgcgcgggcagcgaggcgcagatacaggttttggaagatgtgcacgtcaaggcgaagcgcgtaccgaaagacaaaaaagtgtttaccgatgcgcgtgccgtatcgacccgtcaggatatattcaaatccagcgaaaacctcgacaacatcgtacgcagcatccccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcatctgtcggtgtgctttacgggcacagcaggcgcagcgtggcgcaaaattaccgcgtgggcggcggcgggcagcacatcggaaattttggcgcggaatatttggaacggcgcaagcagcgatattttgtacaagagggtgctttgaaattcaattccgacagcggaaaatgggagcgggatttacaaaggcaacagtggaaatacaagccgtataaaaattacaacaaccaagaactacaaaaatacatcgaagagcatgacaaaagctggcgggaaaacctggcaccgcaatacgacattacccccatcgatccgtccagcctgaagcagcagtcggcaggcaatctgtttaaattggaatacgacggcgtattcaataaatacacggcgcaatttcgcgatttaaacaccaaaatcggcagccgcaaaatcatcaaccgcaattatcagttcaattacggtttgtctttgaacccgtataccaacctcaatctgaccgcagcctacaattcgggcaggcagaaatatccgaaagggtcgaagtttacaggctgggggcttttaaaggattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgctgccccaaaaatcaaccattgtccaaccggccggcagccaatatttcaacacgttctacttcgatgccgcgctcaaaaaagacatttaccgcttaaactacagcaccaataccgtcggctaccgtttcggcggcgaatatacgggctattacggctcggatgacgaatttaagcgggcattcggagaaaactcgccgacatacaagaaacattgcaaccggagctgcgggatttatgaacccgtattgaaaaaatacggcaaaaagcgcgccaacaaccattcggtcagcattagtgcggacttcggcgattatttcatgccgttcgccagctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatacattaggattaaaactggtcggctaccgcagccgcatcgacaactacatccacaacgtttacgggaaatggtgggatttgaacggggatattccgagctgggtcagcagcaccgggcttgcctacaccatccaacatcgcaatttcaaagacaaagtgcacaaacacggttttgagttggagctgaattacgattatgggcgttttttcaccaacctttcttacgcctatcaaaaaagcacgcaaccgaccaacttcagcgatgcgagcgaatcgcccaacaatgcgtccaaagaagaccaactcaaacaaggttatgggttgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatttccggcaactgggcaagcgttccatcaaacaaaccgaaactcttgcccgccagcctttgatttttgatttttacgccgcttacgagccgaagaaaaaccttattttccgcgccgaagtcaaaaatctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaattttgcacgcggacgcacctttttgatgacgatgagctacaagttttaa

SEQ ID NO: 5554 - DNA, 1218 bp, Neisseria meningitidis
atggcgttaatcgtacataaatacggcggcacatcagtaggctcgcccgaacgcatcaaaaacgtagccaaacgtgtcgccaaagcccgcgccgaaggacacgacatcgtagtcgtcgtatccgccatgagcggcgaaaccaaccgactggtcgcactggcgcacgaaatgcaagagcatcccgatccgcgcgagctggacgtcgtcttagctaccggcgaacaagtaaccatcggccttttggcgatggcattgaaagacatcggcgtggatgccaaaagctacacaggctggcaggtcgccctcaaaaccgataccgcccacaccaaagcccgcatcgaaagcattgatgacgaaaaaatgcgtgccgaccttaccgccggcaaagtcgtcatcgttgccggcttccaaggcatcagcagtgaaggcgatatttccacgctcggacgcggcggttccgacacttccgccgtcgcgcttgccgccgcgctcaaagccgacgagtgccaaatctataccgacgtagacggcgtttacacaaccgacccccgcgtcgtacccgaagcgcgccgcatggatacggttacatttgaagaaatgatcgaactggcaagcctcggttcgaaagttttgcaaatccgttcagtagaattcgccggaaaatacaaagtgcgcctgcgcgtactgagcagcctgcaagacggcggcaatggcaccttaattacctttgaagaggacgacaacatggaaagagctgccgtaaccggtatcgcattcgataaaaaccaagcccgcatcaacgtgcgcggcgtacccgacaaacctggcgtcgcctatcagattttaggcgcggttgccgatgccaacatcgaagtcgatatgattatccaaaatgtcggcagcgaaggcacaaccgatttttcctttaccgtaccgcgcggcgattacaagcagactttggaaatcctgtcggaacgccaagacagtatcggcgcggcttctattgatggcgacgacaccgtatgcaaagtctccgcagtcggtttgggtatgcgttcgcacgtcggtgtagccgccaaaatcttccgcacgctcgccgaagagggtatcaacatccaaatgatttccacctccgaaatcaaagtttccgtattgattgatgaaaaatacatggaactggcaaccagggtattgcataaagcctttaatttgggctga

SEQ ID NO: 5555 - DNA, 729 bp, Neisseria meningitidis
atgcctgattacatccgcatctcgcgcgccgccgacagcctgcgcgatatcaaaatcacccctcatttcctgccgcatacggacggttcgtgccttattgaatgcggcaataccaaagtgatttgtaccgcttccatagatgaaaacgtcccgccgtttctgcgcggtaaaaaccaaggctgggtaacggcggaatacgggatgctgcctgcctcaactgcttcccggatgctccgcgaagcttcggcgggcaaacagtccgggcgcacacaagaaatccaacgtttgatcgggcgttccctgcgcgcggtcgtggatatggaaaaactcggtgaacgacaaatcttgattgactgcgatgtgattcaggcagacggcggtacgcgcacggcttcgattaccggtgcgtttgtcgcgctgcaaatcgccgtcggcaaactggtttcagacggcattttgagtgaaaaccccatccgcgaagccgttgccgctgtgtcagtaggcgtagtgaacggcgtgccgcttttggatttggattatcccgaagactccggttgcgacagtgatgtgaatatcgtcatgaccgcatcgggaaaaatcatcgaaatacaggggacggcggaagacgcgccgttcagtttggacgaattgggcaaactggttgcactggcgcaaaaaggcataggcgaactgctgcaacaccagcaaaatgcgttgtccgccgcctga

SEQ ID NO: 5556 - DNA, 465 bp, Neisseria meningitidis
atgtacaaacatttggttgttgccgttgacggcagtgaaacgtccatcaatgccctgaaacatgccgccgagcttgccggggtcaacggtgcgcgcctgactttggtgcacgttgccaatcctgccgaatatatggcactcgcccccgaatttttgcaacacgaaagctacgaagccgccgccgtcgcgcaaggcaacgaagttttggatgccgccgagcgcaccgcccaggaactgggtgtggaaaataccgtcaaacacctgctggttgccaataagggtgcgcgtgaaatggcgcaggatttggttgattatgccgatgaaaacggtgccgacctgctggtgttgggtacgcacggacgtaccgggctgatgcaccttttaatgggcagttttgccgaaacggtaatgcgccaaagccacctgccgcttttgattatccgcagcaaagccgaagaggcgtag

SEQ ID NO: 5557 - DNA, 777 bp, Neisseria meningitidis
atgtccgacaacgctttgacctcttcgcgacgcttcggcggcatcgccagactctacggagactctgccttggcgcacttttcacaggcacacgtctgcgtagtcggcgtgggcggtgtcggctcgtgggcggtcgaggctttggcgcggacgggcatcggacgtttgactttgattgatttggacaacgttgccgaatcgaatgtcaaccgccagctgcacgccctgaccggcgacttcggcaaagcaaaagttaccgccttgcgcgaacgcattacacaaattaatccgcaatgcgaagtgtttgaaattgaagatttcgttaccgaagacaatttgccggaatacttcggaaaaggttttgatttcgtcatcgacgcgatcgaccaagtgcgcgtcaaagcagcaatggcggcttattttgtggaacgcaaacaaccgtttgtcctcagcggcggcgcgggcggacaaaaaaatccggcgttaatccaaaccgccgatttgagccgcgtaacccacgacccgctgcttgccaacctgcgctacaccttgcggaaacgctacggattcagccgcgatacgaaagcaaatatgcgcgtgccttgcgtgtattcgaccgaaaatatcgtgccgccgcagtctagggaggcttgttcggcagatgccgctccgcaaggcttgtcgtgcgccggctacggtgcaagcatgctcgttaccgcttcgttcgggctatattgcgcacaggcggcggtggaacacatcgcagacaaaaaataa

SEQ ID NO: 5558 - DNA, 528 bp, Neisseria meningitidis
atggaattcgttaataatttagttattttttcatttttattactaatgcttattccgatattttttgtagtatatggtatataccataagatacgttatcgcaaaatatgtatcctaagaacaagttttatattattagtggtaatactttgcagtatgtattacatatattgccgttatcttgaccaacaaaaagtagcttattattgcatagatgaacaatgtatttctattgttcatctatacaaagattatggtataaactctcccacatatgcgagaatttacgcaggaaaaatattgtttagatttcaagtaagagctaaaaattacgctgaattacttatggaagatgatatatcaattagtaaaaaaattttggggaataaatttatcatttatgggtcgctacctgtaatatacggtaatgtagataatattgaagtaaaagaagctactggttatatagatagatccagtactgattatattgtctcaagaaacttaaaattcagacatttatattaa

SEQ ID NO: 5559 - DNA, 210 bp, Neisseria meningitidis
atgccgtctgaacatctgcccgaccacattatacgtgaatgtcggcagattgttttcttttgtaaacttatattaaaatccacttaccgattcacgccatgccgcccatccctgccccatctgcaccatccgagcacactgtcgcatgggtattcggccaacccgttaccgatttgccccaggatttgtttattccgcccgatgcattga

SEQ ID NO: 5560 - DNA, 855 bp, Neisseria meningitidis
atgccgcccatccctgccccatctgcaccatccgagcacactgtcgcatgggtattcggccaacccgttaccgatttgccccaggatttgtttattccgcccgatgcattgaaagtcgtattgggcagcttccaaggccctttggatctactgctgtatctgatccgcaaacagaatatcgacgtactggatattccgatggtgaagattaccgagcagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgaacagatgaagctggcggcgcagggtttggacgcgctgccccgagccggacgggatttcgcgtgggcttacctgccgctggaaattgccgtcgaagccaagctgcccgaagtctatattaccgacttgacgcaagcgtggctgggtattttgtctcgggcaaaacacacgcgcagccacgaagtaatcaaagaaaccatctccgtgcgcgcgcaaatgacggcaatcctgcgccgtttgaacggacacggaatatgcaggtttcacgacctgttcaatcccaaacagggcgcggcttacgtggtcgtcaacttcatcgcactgttggagcttgccaaagaaggattggtcagaatcgtgcaggaagacggtttcggagaaatccgaatcagcctcaatcatgagggggcgcattcagacggcatttccggcacacgaggcgggcgcgatgtgttctaa

SEQ ID NO: 5561 - DNA, 1209 bp, Neisseria meningitidis
atgaccggcatcatacattcgctgcttgacaccgacctctacaaattcactatgctgcaagtggttctgcaccagtttccgcagacgcacagcctttacgaattccgctgccgcaacgcctcgaccgtctatccgcttgccgacatcagggaagacttggaagccgaactcgacgcgctctgccaactacgcttcacccacgacgaactcggctatctgcgctccctgcgtttcattaaaagcgactttgtcgattatctcgaactcttccagctccaacgccgctttgtcgaaatcggcacagacgataaagaccgtctgaacatccgcatcgaaggtccgatgatacaggcgatgttttttgaaatcttcatcctcgccattgtcaacgaactttacttccgccgcctggaaacccctgcagtcatagaagaaggcgaacgccggcttcaagccaaagccgcgcgcctcaaagaaatcgccgccgcacaaaaccccgacgaaccgcccttcctgatttccgacttcggcacgcgccgccgctacaagctcgcgtggcaggaacacgtcatccgcaccctgcttgaagccgcccccggcatcgtacgcggcaccagcaatgtctttctcgccaaaaaactcggcatcacccccatcggcaccatggcgcacgagttcctgcaggcattccaggccctcgacgtacgcctgcggaatttccaaaaggccgcgctcgaaagctgggtgcacgaataccggggcgatttgggcgttgccctgaccgacgtggtcggtatggatgccttcctgcgcgatttcgacctctatttcgccaaacttttcgacgggctgcgccacgacagcggcgacccttacgtttggggcgacaaagcctacgcccactatcaaaagctcaaaatcgacagccgcaccaaaatgctgaccttctccgacgggctggacatcgaacgctcttgggcattgcaccaatatttcaaagaccgcttcaaaaccggcttcggcatcggcaccaacctcaccaacgatatggggcatacgcccttgaatatcgtcttgaaactggtcgaatgcaacgggcagtccgtcgccaagctgtccgactctccgggcaaaaccatgaccaacaacagcaccttcctcgcctacctgcgccaagtgttcgacgtacccgaacccgaaacgccgtaa

SEQ ID NO: 5562 - DNA, 1719 bp, Neisseria meningitidis
atgaacctacatcaaaccgtcgaacacgaagccgccgccgcctttgccgccgcaggcatcgccgacagccctattgttttgcagccgaccaaaaacgccgaacacggcgatttccaaatcaacggcgtgatgggtgcggcgaaaaaagccaaacaaaacccgcgcgagttggcgcaaaaggtcgccgaagcattggcggacaacgccgtgattgaaagcgcggaagtcgccggtccgggcttcatcaacctgcgcctgcgccccgaatttctcgcgcaaaacattcagacggccttgaacgacgctcgtttcggcgtggcaaaaaccgacaaaccgcaaaccgtcgttatcgactattcttcgcccaatctggcgaaggaaatgcacgtcggccacctgcgttccagcatcatcggcgacagcatttcgcgcgtgttggcatttatgggcaataccgttatccgtcaaaaccacgtcggcgactggggtacgcagttcggtatgttggtcgcttatttggtcgagcagcaaaaagacaatgccgcgttcgagctggcggatttggagcagttttaccgcgccgccaaagtgcgctttgacgaagaccctgcctttgccgacaccgcacgcgaatacgttgtgaagctgcaaggcggcgatgaaaccgttttggcattgtggaaacagtttgtcgatatttcgctctcgcacgcccaagccgtttacgacacgctgggcttgaagctgcgtcctgaagacgtggcaggcgaatcgaaatacaacgacgatttgcagcccgtggtcgatgatttggttcaaaaaggtctggcggttgaggacgacggcgcgaaagtcgtgttcttggacgaatttaaaaacaaagaaggcgaacccgccgcatttatcgtgcaaaaacaaggcggcggcttcctctacgcctccaccgatttggcgtgcctgcgctaccgcataggccgtctgaaagccgaccgcctgctgtacgtcgtcgaccaccgccaagccctgcacttcgaacaacttttcaccacttcccgcaaagcaggctatctgccggaaaacgtcggcgcggcatttatcggcttcggcaccatgatgggcaaagacggcaagccgttcaaaacgcgcagcggcgacaccgtgaaactggtcgatctgctgaccgaagccgtcgagcgcgccaccgctttggtgaaagaaaaaaatcccgaattgggtgcggacgaagccgctaaaatcggtaaaaccgtcggcatcggcgcagtcaaatacgccgacttgagcaaaaaccgcaccagcgactatgtgttcgactgggatgccatgctctcgtttgaaggcaacaccgccccctatctgcaatacgcctacacccgcgtgcaaagcgtgttccgcaaagcaggcgaatgggatgcaaatgcgccaaccgttttgaccgaaccgctggaaaaacagcttgccgccgagctgctgaaatttgaagacgtactgcaaagcgtggcggacacggcgtatccgcactacctcgccgcctacctctatcaaattgcgaccctgttcagccgcttctacgaagcctgtccgatactcaaagccgaaggcgcaagccgcaacagccgcctgcaactggcaaaactcaccggcgacacgctgaaacaaggcttggatttgctgggcatcgatgtgttggacgtaatgtaa

SEQ ID NO: 5563 - DNA, 360 bp, Neisseria meningitidis
atgcgaaacaaacaaacgccaagcaagcaagcaagcaagcaagcaagcaagcaagcaagcaagcaaaaaattataacccccttcctgccgacgcacgcactttccgcgcggcgcattccccttttcccgcccctcaaatccgccttttcttcaggcagggtttcagcccgcctcttttccctgttttcctttccccgacacgcgtgcgctccccctgccgcactgtgctgcactttcgcgcccggacggcatcgttccgccatccggttctctgttttacatacccctgtttcagaaagaaatgcagatgtttcaacacacaggacgacacataaagcaccgccctatgtgttgccctga

SEQ ID NO: 5564 - DNA, 1458 bp, Neisseria meningitidis
atgtccgagtggcgaagtttcaaccgaaaaggaaatacgatgaatattcacaccctgctctccaaacaatggacgctgccgccattcctgccgaaacggctgctgctgtccctgctgatactgcttgcccccaatgcggtgttttgggttttggcactgctgaccgccaccgcccgcccgattgtcaatttggactatcttcccgccgcgctgctgatcgccctgccttggcgtttcgtcaaaattgccggcgtattggcgttttggctggcggttttgtttgacgggctgatgatggtgatccaactcttcccttttatggatctcatcggcgccatcaacctcgtccccttcatcctgaccgcccccgccccttatcagataatgaccgggctgttgctgctgtatatgctggcgatgccgtttgtgttgcagaaagccgccgccaaaaccgacttccggcacattgccgtctgcgccgccgttgtggcggcagccggctatttcaccggccatttgagttactacgaccggggtcggatggccaatatcttcggcgcaaacaacttctactacgccaaaagtcaggcgatgctctacaccgtcagccagaatgccgactttattaccgccggcctggtcgatcccgtcttcctccccttgggcaatcaacagcgtgccgccacgcatctgaacgagccgaaatctcaaaaaatcctctttatcgtcgccgaatcttgggggctgccggccaatcccgaacttcaaaacgccacttttgccaaactgctggcgcaaaaagaccgtttttcggtttgggaaagcggcagttttcccttcatcggcgcgacggtcgaaggcgaaatgcgcgaactgtgtgcctacggcggtttgcgcgggttcgcactgcgccgcgcgcccgacgaaaaatttgcccgctgcctccccaaccgtttgaaacaagaaggttacgccacctttgcgatgcacggcgcgggcagttcgctttacgaccgcttcagctggtatccgagggcgggctttcaagaaatcaaaaccgccgaaaacctgatcggtaaaaaaacctgcgccattttcggcggcgtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatatggcctgcccgccgaaaccgacctctgccgcaatttcagcctgcacacccaattcttcgaccaactggcggatttgatccaacgccccgaaatgaaaggcacggaagtcatcatcgtcggcgaccatccgccgcccgtcggcaacctcaatgaaaccttccgctacctcaaacaggggcacgtcgcctggctgaacttcaaaatcaaataa

SEQ ID NO: 5565 - DNA, 747 bp, Neisseria meningitidis; identical to SEQ ID NO: 837

SEQ ID NO: 5566 - DNA, 702 bp, Neisseria meningitidis; identical to SEQ ID NO: 3979

SEQ ID NO: 5567 - DNA, 672 bp, Neisseria meningitidis
atgacgacacaagacgaactcaagcgcatcgccgccgaaaaagcagtcgaattcgtacccgaaaatgaatatatcggcatcggtaccggctcgaccatcaactttttcatcgaagccttgggtaagagcggcaaaaaaatcaaaggcgcggtatctacttccaaaaaatccggcgaactgcttgcccagtacgatattcccgtcgtttctttgaacgaagtatcggggttggcggtctatatcgacggtgcggatgaagtgaaccacgccctgcaaatgattaaaggcggtggcggcgcgcacctcaacgaaaaaatcgtcgccagcgcgtccgaaaaattcatctgcattgcggatgaaagcaaatatgtttcacgtttgggcaaattccctctgcctgtggaagtcgtcgaaagcgcgcgctctcttgtttcgcgcaaactgctcgctatgggcggacagcccgaactgcgtatcggctacaccacgttttacggcaaccaaatcgtcgatgtccacggcttgaatatcgatcagccgctgacgatggaagacgaaatcaacaaaatcaccggcgtgctcgaaaacggcatattcgcccgcgatgccgccgatgtgttgattttggggacggaagagggtgcgaaagtcatctatccctgccaagggtaa

SEQ ID NO: 5568 - DNA, 483 bp, Neisseria meningitidis
atgacgaacatccgtatcggacagggctacgatgtccaccaactgaccgaaggcagaaagctgatacttggcggagttgaaatcccatttgaaaaagggctgctcggacactccgatgccgatgcgctgctgcacgccgttaccgacgcgctgctcggtgcggcaggtttgggcgatatcggcagccatttccccgacaccgccgcagagttcaaagatgcggacagccgcgtccttttgcgtgcggcgtatcaaagcgttcaggcgcagggttggcaggcggtcaatgtcgatacgaccgtgattgcacagaaacccaaactcgcgccgcacattccgcaaatgcgtgccaacatcgccgccgatttgggcatagacatttcgtgcgtcaacatcaaaggcaaaaccaacgaaaaactcggctatctcgggcggatggaaggcatagaggcgcaggcggcggtattgctggtacgcatttga

SEQ ID NO: 5569 - DNA, 690 bp, Neisseria meningitidis
atgaagcgcaaaaatatcgcgctgattcccgccgccggcatcggggcgcgtttcggtgcggacaaacccaagcaatatgtcgaaatcggaagcaaaaccgttttagaacatacgattgggatttttgaacggcatgaggccgtcgatttgaccgtcgttgtcgtctcgcccgaagacacgtttgccgataaggttcagacggcatttccacaggttcgggtgtggaaaaacggcggacagacccgcgccgaaaccgtccgcaacggtgtggcaaaactgttggaaaccggtttggcggcggaaaccgacaatattctggtacacgatgccgcgcgttgctgcctgccgtctgaagctttgacgcggttgatagaacaggcgggcaacgccgccgaaggcgggattttggcaattcccattgccgatacgctcaagtgcgcggacggtgggaacattagtgcaaccgtcgagcggacgagcctttggcaggcgcaaacgccgcagcttttccgcgccgggctgctgcaccgcgcattggctgcggaaaacttggacggcattaccgatgaagcgtccgccgtggaaaaattgggtgtgcgtccgctactgatacagggcgacgtgcgcaatttgaaactgacgcagccgcaggacgcatacatcgtcaggctgctgctcgatgccgtctga

SEQ ID NO: 5570 - DNA, 735 bp, Neisseria meningitidis
atgacgacacgccaaatcatcctcgataccgaaaccaccggtctgtatgccgacggcggcgaccgcttggtcgagtttgccggtttggaaatggtcaaccgccaaatgaccgacaaaaacctgcacctctatgtccaccccgagcgcgatatgcccgaagaggcggcacgcgtccacggcttgacgatacaggttttggaagggaaaaacgcgccgccgtttgcagaggtcggcaggcagattgccgatttcctgcgcggtgcggaactgattatccacaatgccaaattcgacgtgggcttcctcaatatggagttccgccggatggggttgccgaccgttgaggaactcggctgtaccgttaccgataccctggcgatggcgcgcgaaatgttccccgggcagaaagccagcctggatgccttgtgcaaccgtttttccgtcgaccgcagcaagcgcgtcctgcacggcgcattgatcgactgcgaacttttgggcgaagtctatcttgctatgacgcggcggcagttcgacctgatgggtgcggccgcagaggaaaaaatggaaaccaaacccgtggtgcataccgaaaccaaacgcagcggcaaactgaaagtcatcagggcggacgaaaacgagttggcggcgcacgggcaatatttggacggcttgggcgaagcctgtatctggcgcaaggaagccgtgccgtctgaaaacggcgggacggacgcatga

SEQ ID NO: 5571 - DNA, 1311 bp, Neisseria meningitidis
atgtacgctaaaaaaggcggtttgggactggttaaaagccgccgtttcgcacctcttttcgctacgcagtttctcggcgcgttcaacgacaatgtgttcaaaaccgcgctgtttgtgatgattgggttttacggtttggggcaaaacggcttcctgcctgccggacagatgttgaacttgggcgcgttgctgtttattttgccgtatttcctgttttcctcgctgtcggggcagttgggtaacaaattcgacaaggccgttttggcgcgttgggtcaaggtgctggaaatgatcattatggcggtggcggcatacgggttttatatccggtctgccccgctgcttttggcgtgtctgttttgcatgggcgcgcaatcgacgctgttcgggccgctgaaatacgccatcctgcccgattatctcgacgacaaagagttgatgatgggcaacagcctgattgaatcgggtacgtttgtcgccatcctgttcggtcagattttgggaacggcggtggcaggtgtaccgccttatattgtcgggatactggttttgctggtcgccgtcggaggcacggtcggcagcctgtttatgccgtccgtacccgccaaggctgccgatacacaaattgagtggaatattgtccgtggcacaaaatccctgctgcgtgaaacggtgcggcacaagcccgtttttaccgccattatcggtatttcgtggttttggtttgtcggcgcggtttataccacgcaactgccgacctttacccaaatccatctgggcggcaacgacaatgttttcaacctgatgcttgctctgttttccatcggtattgccgccggttcggtactgtgtgccaagttcagcagggaacgcctgatgttggcttgggtaacggttggtgcgttgggtttgacggtttgcggcttggttttggtgtggctgacgcacggacaccgttttgaagggctgaacggcattttttggtttttatcgcaaggatgggcatatcccgtgatggcggtgatgacgctgatcggctttttcggcggatttttctccgttccgctctatacctggctgcaaaccgccagtagcgagactttccgcgcccgcgccgttgccgccaacaatatcgttaacggtatttttatggtttccgctgccgttttgagcgcggtgttgctgtttttgtttgacagcatttccttgttgtatctgattgtcgctttgggcaatattccgttgtcggtatttttgattaagcgcgaaaggcggtttttaggcgcggcggcaatcaggaaaaaaccttga

SEQ ID NO: 5572 - DNA, 189 bp, Neisseria meningitidis
gtgatggaaagcatgtttatattggtgcccatcagcattattttggcgtttgtcatcggctggtttttttggtggtcgggcaaaaacgggcagtttgacgacttggaagggccggcgcaccgcatcctgatggatgatgattcgacaagtaaactgattgaaaaagagagggaaaacgatgtacgctaa

SEQ ID NO: 5573 - DNA, 300 bp, Neisseria meningitidis
atgcattatttcagtattcatgaccaatcgggacggcatataggctttttcatcctgcttgccgacgacgaatcggaagcacggccgcaaagcgggcgttttgccgtcaaacttgaaggcggaatggaaaatcatgtcctgtcgccgttcggtcagacggaaatcccccaatattggcgcgtggtcaaagaccgtatcgagctgttttttgacgaagctcccgtcggaactttgcgtaacgaatatctgaccgtgtcggggcagacttttgttttgaacgatttgacagggaatatgtga

SEQ ID NO: 5574 - DNA, 1197 bp, Neisseria meningitidis
atgtcccaaaaattgatcttggttttgaactgcggcagctcgtccctcaaaggcgcggtcctggataacggcagcggcgaagtcctgctcagctgccttgccgaaaaactcaacctgcccgatgcctacatcacattcaaagtaaacggcgaaaaacacaaagtcgatctgtccgcacatcccgaccacaccggcgcggtcgaagccctgatggaagaactcaaagcccacggcctcgacagccgcatcggcgccatcggccaccgcgtcgtcagcggcggcgaactgtacagcgaatccatcctcgttgacgacgaagtcattgccggcatcgaaaaatgcatcccgctcgcccccctgcacaaccccgcccacctcttgggcctgcgtgccgcgcaaagcattttcaaaggcctgcccaacgtcgtcgtattcgatacctccttccaccaaaccatgcccgaagtcgcctacaaatacgccgttccgcaggagttgtatgaaaaatacggcctgcgccgttacggcgcgcacggtaccagctaccgcttcgtcgccgacgaaaccgcgcgcttcctcggcaaagacaaaaaagacctgcgtatggtcattgcccacttgggcaacggcgcgtccattaccgccgtcgccaacggcgaatcgcgcgacaccagtatgggcctgaccccgctggaagggctggtaatgggtacgcgcagcggcgacatcgatccttccgtattcggcttcctcgccgaaaacgccaatatgaccatcgcccaaatcactgaaatgctgaacaaaaaatccggtctgctcggcatttccggcctgtccaacgactgccgcaccattgaagaagaagccgccaaggggcataaaggcgcgaaattggccttggatatgtttatctaccgccttgccaaatacatcggcagtatggcggttgccgcaggcggtttggacgcactggtctttaccggcggcatcggcgaaaactccgacatcatccgcgaacgcgtgatcggctacttgggcttcctcggtctgaacatcgaccaagaagccaacctgaaagcccgcttcggcaacgccggcgtgattaccactgccgacagcaaagccgttgccgtggtcattccgaccaacgaagagctgatgattgcccacgacactgcccgtttgagcggtctgtaa

SEQ ID NO: 5575 - DNA, 1806 bp, Neisseria meningitidis
atgaaaaaactgatttgcctgttcgccgtatttttgatgttgtgcggacgagctttcgcgctggatgcgaacgatctgctgccgccggaaaaggcattcgtgccggagcttgccgttgccgacgacggtgtgaacgtccgtttcaggattgccgacggatactatatgtatcaggcgaaaatcgtcggcaagaccgatccggcggatttgttgggacagccttctttcagcaagggcgaagagaaggaagacgagtttttcggcaggcagacggtttaccatcacgaggcgcaggttgcctttccttatgcaaaggctgtcggcgaaccgtataaattggttttgacctatcagggctgtgccgaagccggcgtgtgctatccgcccgtggataccgagtttgatattttcggcaacggcacttaccatccgcaaaccgacgaaccggcatccgccaaagaccgctttttgcagccttcctctcaaaacggcagcggggcgctgccgcccccgaagggggatgagggcggcgacagccgtttcaagctgtcttgggatacgctcaacgccaatcttttggcgttttttctcgctggtttgggcctgagttttaccgcctgtatgtatcccctgttgccgattgtttccagtattgtggtcggcgacaaaaaggcgggcaaggcgcgggcgtttgtgctgtccgtcgtttatgttcagggtttggctctgacttatacgctggtcggcattgttgccggactgacgggcgcactgctgaccgtatggttgcagcaggcttgggtggtattggcggcatcggctttaatggtcgtcttggcactgtctatgttcgggctgttcaacatccagcttcccaacgccgtgcagtcgtattttcagaatcaaagcagcaggctttcaggcggtaaaatcgtttccgtctttattatgggcatattgtccgcgctgattgtcgggccgtgcgtcgccccgccgctggcatttgctttgggctacatcggtcagacgggcgatgcggttttaggcggtttggcactttacactttggcgttgggcaccggcgttccgctgattgccatcggcacgttcggcgggcatatcctgcctaaggcaggcgattggatgaatgccgtcaaatacgcattcggcttcatcctgctagccgtcgccgtttacctcgccacgccgcacttgccctattatctcgtcgtcgcgctgtacacgctgctgatgctggttcctgcctttatgctgctggtcaacggacgcaggcagaaacgccgtccgaaagctgtggcattcgcattgggcggtatattgctgataggcggcgcgtggttcggctggcagggcgcaaacggcaaaacgaccgcgctgcaccatttcctgaccctcaatccaccagccgaagcaggcaaatcttcggaacacggcaaaatgtttgccgatactgccgcgctgaaggcagcgatggatacggcgttgaaagaacatcccgacaaacccgtcgttttggatttttatgccgactggtgcatttcctgcaaagaaatggcggcttacacgctcaatcagccggaagtgcatcaggcagtcgatatggaacgctttttccaaatcgacgtaaccgccaacacgcccgaacatcaggcgttgttgaaagaatacggtctgttcgggccgccgggcgtgtttgtcgtccgctccgacggcagccgcagcgagccgctgctgggttttgtcaaagcagacaagtttatcgagtggtatgaacaaaaccgctga

SEQ ID NO: 5576 - DNA, 522 bp, Neisseria meningitidis
atgcgggttcaatctggcttgatcttctgcacccaagccgatgagtttgcgcagtcgggtcatgtagaaattgacatccaaaccggtgccgtagcgttgcgccgtccacagtgtttccgccagtgcctccatcatttcgtgttcggcttccagccagccgcgtttggcgcacagggtgtcgtggattgcgcgtatgccgtgcggctggtctatgcccgcctgttcttggacggacagatgcagcgacatatgcaggaaggggttgctttcgccgttttcgggcagccagtcggtgtccagatggtcttcgatgcgttcgagataacggtggtattcgggatgggcttcgacaatgcggagggctttctgttccagtgcgctcagttgcagcggattgagccgctgctgccacacgcgggcgaaaaagcggcggacatcgtgggtattgacatcgtacatggcgggttcgataagatgtttatggaaataggttcggataatggcgggttttacataaattaa

SEQ ID NO: 5577 - DNA, 828 bp, Neisseria meningitidis
atggatggagaaggtatgtcggttgggcattatgagaattttcccgtcggttcgctgattttgccgcgcaggttgaggaagccggttcacgcggtgtacgcgtttgcacggacggcggacgatatggcggacgagggcagtatgccgtctgaagccaggttggcggggttggagggtttgcagcgcgagttggacgtgttggcatcgggcggccggtcggcgcatcctttgattgcacgattggatgccgaggcggttgtgccgttcggtttggatttgcagccgttttatgatttgctttctgcattttctcaggatgtggttaaaacaaggtatggaaatttcggcgagctggccgattattgtcggcgttccgccaaccctgtcggacgcattatgctggctttgtacgggaaaacggatgcggtgtgcgtggcgcaaagcgacggcatctgtacggctttgcaactggtgaatttttggcaggatgtggctgtggattggcaaaaaggcagggtttatattccgcaggacgatttgttgaaattcggtgtttctgaggaacagatcgcggcaggacgggcggatgcggcgtttcagcggctgatggcgtatgagtgtcggcgtgcgttccgtatgctgaaggcgggttcgcctttggcaagggaactgaatgggcgtatcggtttggaactccgtatgattgtgttgggggcgcagttgattttgcagaaactggacgcgtgccgatacgatgtgtttgcacaacgccccgttttggataagaaggattggttgattatgctgaaaaaggcgttgtggaaatga

SEQ ID NO: 5578 - DNA, 483 bp, Neisseria meningitidis
atggctatcgtgaaaaattccgtggtttcgctgcattatgagatgtatgatgccaacaatcagcttttggacaaaaccgaagaaccgattgcgtatctgcacggcggttacgacggcattttccctttggtggaagaggcgttgcacggtaaggatgccggcgatacggtcgatgtggcgctgtcgcccgacgatgcgttcggcgagcaggatccggagttggtccgtatcgaagatgcgggcgtgttccctgttgaagtcgaagtcggcatgatgtttgaagccgacgatcctgaaaccggcgatgttgtcgtctatcgtgtaaccgatgttgccgacggcaaggcggtggtggacggcaaccatcctttggcaggcatgaaaatccgctttaaggctacagttgaaagcgtgcgcgatgcatccgatgaggaaatcgcacacggtcatgtccacggcccgcacggtcatcaccaccactga

SEQ ID NO: 5579 - DNA, 297 bp, Neisseria meningitidis
atgaaaaaatccctgtttgccgctgctttgttgtctttggttctggcagcctgcggcggtgaaaaagccgctgaagctcccgctgctgaagcacctgccgccgaagctcccgctactgaagcacctgccgccgaagctcccgctgctgaagcacctgccgccgaagctcctgctgctgaagctgccgctaccgaagcacctgccgctgaagctgccgctaccgaagcacctgccgctgaagctgccgctaccgaagcacctgccgctgaagctcctgctgccgaagctgcaaaataa

SEQ ID NO: 5580 - DNA, 1368 bp, Neisseria meningitidis
atgcttgaccttcataccgaattttcccgactcctaccggcagatgaaattgccgaaccttctccgacgcttttaaaagaccagcgcaaccgctttacgtctgcaccagacatcattttgcagccgctcagcgttaaaagcgtgcaaaccattatgcgtttctgccaccaacaccgtattccggttacgccgcaaggcggcaatactggtttgtgcggcgcggcagtatcggaaaacggcgtattgctgaacctttccaaactcaaccgcatccgcagcatcaatttgtcagacaactgcataaccgtcgaagcaggttccgtactccaaaccgtccaacaggcagccgaagcctcaaacaggctgttcccactcagtctcgccagcgaaggctcgtgccaaatcggcggcaacatcgcctgcaatgccggaggtttgaacgtattgcgttacggcacgatgcgcgacctggttatcggtttggaagtcgtcctccccaacggcgaactggtttcccatctccatcccctgcataaaaacaccaccggctacgacctgcgccatctgtttatcggtagcgaaggtacattgggcattatcactgccgccacgctcaagctgtttgccaaccccttagacaaagcaaccgcatgggtcggcatacccgacatcgaatccgccgtccgcctgctgaccgaaacccaagcacactttgccgaacgcctatgcagttttgagctgatcggccgttttgccgccgaattgtcttccgaattcagcaaactccccctgccgacacattcagaatggcatattttacttgagttgaccgactcattacccgacagcaatcttgatgatcggcttgtcgaatttctttataaaaaaggctttaccgacagcgtgttggcgcaaagcgaacaagaacgtatccatatgtgggcgttgcgcgaaaacatctccgcatcgcaacgcaaactgggcaccagcatcaaacacgatattgccgttcctatcgggcgcgttgccgactttgtccgccggtgcgccaaagatttggaacagaatttcaaaggcatacaaatcgtctgcttcggacatctgggcgacggcagcctgcactacaatactttcctgcccgaaatcctcagcaatgaagtctatcgttacgaaaacgacatcaacagcacagtctatcgcaacgtccttgcctgcaacggcacgattgccgccgaacacggcataggtatcatcaaaaaacagtggctggacaaagtacgcacgcctgccgaaatcgccctgatgaaaagcatcaaacaacaccttgatccatataacattatgaatccgggcaaactgcttccgtaa

SEQ ID NO: 5581 - DNA, 2033 bp, Neisseria meningitidis
atgaaactcgaagcaagcaagcaagcaagcagaagtttaaaaaatcatttattgtaagtctatttttttctattctttatacctctccgcttttggctgttgattacgtttacgacaaaaccaagctcactaatgatgaaattacccgcttaaaaaaactccgcgataaaacgagtgaatattggaaaaaagaaacttatcttataaccgaggataatccaaaagttccaccctttcccgcactataccctagaacataccaattcgaaaacatcaataactcaaaaaagatttctttttatgatcaagaatataccgaaggttacctagttggcttcgcccgaggtttaggggttgcaaaaagaaatggggacacagaagaacaaatacggaaatattttaaggaatgttttaattctaacactaagatacgtgattatagtacttgccaagctgaaaaatttggatcccatcctcttatagtaaaaagtcatatattctccttaggtccaaaaataaaaaatagtcatatcaacagcgaaattttatctgtcgggaattatacagaatgggctaatcaagtaattcatcatattgaaaattatgtttcttttgcagcacatctatattctggtttagatccattccactatattgaggttacagacaactcgcacgttatcgggcaaacgattagtttggatgaattccgcttagaaaattctctctgggagccccgttgggattctaatgttgggaaattaaaaacaacgaatgcagacatccgttttaatactaaaagtgaaagtttactcgtaaaagaagattatgctggcggagctcgttttcgttttgcttacgatcctaaagaagcgaaaaatactgcattaatttttgagaaaaatgttactggcacttccgacatcatcttcgaaaatccaatagacgatttaaaaagcctcgatgggcatcaaattatcaaagtaaatggcacagcagataaacacgcattccgtctttctggcaaacaccaaaagggaatttatacgctttctttacaacaacgcccagagggcttttttaccaaagtgcaagaacgcgatgatatggcgatttatgcacaacaggctcaagccgccaataccttattcgccttgcgtttgaacaacaaaaacagcgatattttcgaccgcactttaccacgcaaaggcttgtggttgcgtgtgattgacggacattccaaccaatgggtgcaaggcaaaacagcacctgtagaaggctatcgtaaaggtgtgcaactcggcggcgaagtattcacatggcaaaacgaaagtaatcaactttctattggcttaatgggcggacaagcagaacaacgtagcactttccacaacccagatacagacaatcttacaacgggaaatgtgaaaggctttggtgcaggcgtttacgccacttggcaccaacttcaggacaaacagacaggtgcgtatgcggatagctggatgcaatatcaacgcttccgccaccgtatcaacactgaagatggtacagaacgttttacttcaaaaggtattactgcctcaattgaagcaggttacaatgcgttattggcggaacacttcactaaaaagggcaacagccttcgtgtttacctacaaccacaggcacaattgacttatttgggggtaaacggaaaattcagcgatagcgaaaatgcccacgtgaatttacttggctcccgccaattacaaactcgggttggcgttcaagctaaagctcaattttcactctataaaaatatcgctattgaacctttcgccgctgtgaacgcgctttaccacaacaaacctttcggtgtggaaatggacggagagcgtcgagtgataaacaataagacggcaattgagagccaattaggtgtagcagtgaaaatcaaatctcacttaaccttacaagccacattcaaccgccaaacaggcaaacatcatcaagctaaacaaggtgcgttgaatttacagtggacgttttaa

SEQ ID NO: 5582 - DNA, 447 bp, Neisseria meningitidis
atggctattgcgaacaataaaaaagcatttcacgattttttcattgaagaccggattgaagccggtttggtcttggaaggctgggaagtcaaagcaatccgcgccgcgcgcgtacagcttaaagagagttatatctattggaaaaaagacgcgttttatctggtcggctgccatattacggctttgcccacagcctcgacacacattaaaccagatgccgtacgtccgcgcaagctcttgttgaaccagtcggaaatcaacaaattaatcggcaaaaccgaacgtgccggctacaccatcgtgccgctggatttgcatttttcacgcggaaaaatcaagatggaaatcggtttggcaaaaggtaagaaacagcacgacaaacgccagagtatgaaagaggcggattggaaacgcgagaaacagcggttgattaagcatacgcgctga

SEQ ID NO: 5583 - DNA, 1011 bp, Neisseria meningitidis
atgtccatcaaaatcctgattatttcccccagttggataggcgactgcgtgatgacccagcccttgttccgccgtttgaaggaacttcaccccggttgcacgattgatgtgttcgcaccgaagtggtcgatggcggtgttcgagcgtatgccggaagtgaatgaaattcttgagaattcgttcggacatggtgcgttggagttgaaacgccgttggcgggtcggtagggatttggggcggcgcggatacgatcaggttatcgtgttgcccggttctttgaaatcggcaatcatcgcgctggcgacaggtatcggtaaaaggacgggttatgtcggtgaaagccgttattttctgttgaacgatatacgcaggctggataaggaacgtctgcctttgatggtggatcgatatacggctctcgcgcatccgagtcaggaagattttgacgggcattcgggattccccgagttttccattgatgaacggcggcgggaaatttctgtcgaaacctttggcttggatattggaaagcctgttctggctttttgtccgggtgcggaattcgggccggcaaagcgttggccgacaaggcattttgccgagttgggcaaacattatctggcggcgggttggcaggtttggctgttcggttcgcaaaaagatgatgaaattgccgaggaaatcaaccgcctttcagacggtatgtgtgtcaatttgtgcggcaaaaccgatttgtcgcaggcaatggatttgctgtcgttggcggacacggtcgtgtgtaacgacagcggattgatgcatttggcggcagctttgggcaggaaggtggtggcggtttacggttcttccagcccgacgcatacgccgcctttgagcgatagggcgaaaatcgtcagcctgcacttggaatgttcgccgtgttttaagcgggaatgtccgctggggcataccgactgcctcaacaggctgtatcccgagaagattgtgcaggcggttgaagaggcggtatga

SEQ ID NO: 5584 - DNA, 810 bp, Neisseria meningitidis
atggcaaaaattggggattttgccgtcaaatctatgatagggatacggagcaaacaaatgattaccctgccttccttaaacaatctgccgtcaaaatgggatgaaatccgccattggctcgaatctcgggtttttgagtgcggcgttatgccgcatcccaatctgacggaatgcgaagccaaacagttcgagcgggatttttgggacaatatcggctgcgcgcctgaagaatatgtccgcatccgccgcgccatccgtctgttggaagcgcgttatcccgacagtttgaacgagctggtgtgtgccgccattgccacgcctttgggcgagatgctggcggtgttcggtagcaggggtttgtgtttgctggaatttgtcggacagaagcatttggaacaggaaattgccgccgtccaaaaagccttgcgcggacggtttgtgtttcgggaggatgagcggacgcaacttttgcggcaggaattggacttatacttcaagggtcgtctgaaaacctttgccacgcctttggagcagattggcaccgagtttcaaaagcaggcatgggacgcgctcttggcgattccttacggcgaaacgcgcagctacaaggagcaggcgcagcgtttgggcaaccccaaagccgtccgcgccgttgccgccgccaacgggcagaacaaagtatctatcctgattccctgccaccgcgtcatcggcagcgacggcaaactgaccggctacgcgggcgggttgaaccgcaaacagtttttactggctttggaacacggcgaagttcagacggcattgttttaa

SEQ ID NO: 5585 - DNA, 816 bp, Neisseria meningitidis
ttgacagcctataatgaatccacttattcatcaagcaaaggaatcatctatgcaaaccctcatcctctccgccgtactgctggctttttcaaccgctgcctttgccgggggcgcattcacgctgcaattcgacaacccgtccgaagacggcggcttcacgcaaaaccagcttttgagcgcgccttacggcttttgctgttcaggcgacaatgcttcgcccgcgctgtcgtggaaaaatccgcccgccgggacaaaagtttcgtcctgaccgtttacgataaagacgcgccgaccggactgggctggatgcaccgggtggtcgccgacattcccgccgatgtccaccgccgcaacgcgacctcgctgcaattaagccgctgcgccaacatcgccgaccggactgggctggatgcactgggtggtcgccgacattcccgccgatgtccgccgccgcaacgcggcctcgctgcaattaagccgctgcgccaacatcgccgacgaccagtccgcagccatatcggcggtaatcagtttgcggatttgccgcatcaggttgacgccttcgtacacggcaaaaccgatgccgtcatgctgcaaccacgccaacacgccgcaaagcgcggcctccgcagcattgtgcggcacttcttcatccgccagtaccgcagcctcataatcaaacgccgcgcccatacgcccggaatacggcagctttaccgcatcgcacactgcctgcgccgtcccgtattgtgcggcgaacctttctacggtttcctgttcgaaagcaatccattgcgcctgatagaggccgtctga

SEQ ID NO: 5586 - DNA, 1146 bp, Neisseria meningitidis
atgaccgaaactcaatccctagagcttgccaaagagctgatttcccgaccatccgttacccctgacgacagggattgccaaaaactccttgccgaacgcctgcacaaaatcggttttgcggctgaagaactccatttcggcgacaccaaaaacatctggttgcgacgcggcacgaaagctcccgtcgtctgttttgcagggcataccgacgttgtaccgacaggtcctgtcgaaaaatgggattcgcccccgttcgaaccggccgagcgcgacggaagattatacgggcgcggcgcggcagacatgaaaaccagcattgcctgtttcgttaccgcctgcgaacgcttcgttgccaaacatcccaaccaccaaggcagcattgcgcttctgattacttccgacgaagagggcgacgcgttggacggcacgaccaaagtcgtcgatgtattgaaagcgcgcgacgagcttatcgactactgcatcgtcggcgaaccgaccgccgtggacaaattgggcgatatgattaaaaacggtcggcgcggctcgctgtcgggcaacctgaccgtcaaaggcaagcaaggccatattgcctatccgcatttggcaatcaatcccgtgcatacttttgccccggccttgttagagctgacgcaggaagtctgggatgaaggcaacgaatatttcccgccaaccagctttcaaatttccaatatcaacggcggcacaggcgcgaccaacgtcattccgggcgagctgaacgtcaaattcaatttccgcttctccaccgagtccaccgaagcagggctgaaacaacgcgtccacgccattttggacaaacacggcgtgcaatacgatttgcagtggtcgtgttcggggcagccctttctgacccaagcgggcaaactgaccgacgtggcacgcgcagccattgccgaaacctgcggcattgaggccgaattgtccaccaccggcggcacttcggacggacgcttcatcaaagccattgcgcaagaacttatcgaattaggcccgtccaatgcgaccatccaccaaatcaacgaaaacgtgcggctaaacgacattccgaagctgtctgcggtgtatgaggggatattggcgcgcttgttggctggaaatgccgtctga

SEQ ID NO: 5587 - DNA, 621 bp, Neisseria meningitidis
atgctgaccccgaaaagttgcgatttgttcaatatcccgtttttccaattttcccagcttaaaaaataccagcctgaaagcattccgcaaatcaaggctgactataaagaaaactggcagatatggcagcagctgattcagcaggttgccgccgaattgggtgcgccgtttgcgccgccgcacatcgaacgctggtgtaacggctggcaggttcgcgcccatttctttgcctacttcaaatacgaacaatataaaaattccgcagcgattttgtcgatactgctcaaccgccgccgtctgagcgtcagcttggattggcactgctataaagccgatgtttcccccatcgcgctgcctgattacaaccgctggttggataattttgataccgaaaaatacgcttctttcgatatgtggcacggtgcggaaagcgaatacgacgactaccgcaccgtcgcgcaacaaaacgagtccgaccgaaagttgcaaaacgacgaagactttttctgcatcggcaaacacatcgaacgcgacgatttgggcaggcaggatgtcgcgaaatggatagcggaaacggtggaagatttgctgccgctttacgaagcctgccacggcaaatga

SEQ ID NO: 5588 - DNA, 510 bp, Neisseria meningitidis
atgaatccgtttgaaaccaaaagcgttacctttgccgaaccgattgaaatgctgtatgcctgccacggcaaagtgcgccgtttttgcggacaagtcgccatgctgtcggactatatcgccgaaaacggctgcaatcagattgttttgcaaaccatccgccaaatcgcccagtatttcaacgttgccgcgccgctgcaccatgaagacgaagaagaaaacttcttcccgctgctgctgcaatatgcgccgcaagcccaagaaagcgtggacgagcttttgcgccaacatatcgggctgcacgacaactgggcggctgtttccgccgaatttgccaaactcgaagcagacaacgcttatgtccccgatgaggaagcgttcaaacgttttgtggcgggatatgatgttcatttggcgattgaagagccgctgtttgatatgggcaacacctttatcccaaaagaaaaactgaccgaaatcggcgaaattatggcggcgcgccggcgcaaataa

SEQ ID NO: 5589 - DNA, 552 bp, Neisseria meningitidis
atgaaagcgtatctggctctgatttctgccgccgttatcggtttggctgcctgctctcaagaacctgccgcgcctgctgccgaggcaactcctgctgctgaagcacccgcttccgaagcgcctgccgccgaagctgctcctgcagatgctgccgaagcccctgctgccggcaactgtgcggcaactgtcgaatccaacgacaatatgcagttcaacaccaaagacatccaagtcagcaaagcatgtaaagagttcaccatcactctgaaacataccggtacgcaacccaaagccagcatgggtcacaatctcgtgattgccaaagctgaagacatggacggcgtatttaaagacggcgtaggtgctgccgataccgactatgtcaaacctgatgatgcacgcgttgttgcccataccaaactgatcggcggcggcgaagaagcttccctgactctggatcctgctaaattggccgacggcgaatataaattcgcttgtaccttcccaggtcacggtgctttgatgaacggcaaagtgactttggtcgattaa

SEQ ID NO: 5590 - DNA, 141 bp, Neisseria meningitidis
atgaaatttgtagcaaaatgccgctccgaaacatctgtttgtgcaacgcggcggaatctttttcaaggttttgttaatggcggttgcactttgatttctgtaaaaccgaatattattttatcgattggagatttgttatga

SEQ ID NO: 5591 - DNA, 474 bp, Neisseria meningitidis
atgtttacacaaattcccgtatacattttatgcgccatgccttctaaccaagtttgccaatgcctccgccaattcgggatgccgtttttccaactttgccgccgccgaaccgaaactctccagcgcagccttactcaaatgcagggtattggttttcggcggtttttccggtttcgggaccagcctgaccgaaacagagcgtatcgaagcatcaagccctgccaactgcggcaataccgacggtgcaatcattttcaagcgcgatgccgccatattgtttgccgccaaaaggacaagcctgccgtcttcgatacatgccgtctgaaaatgcgggtgcaggttggcaggcagcagttttttcacggcggcatccaaccgccgccactgtcccgcctgtttcaaaagtccggaaagcagcgcgtcccgcctgcccaactgttccaaattcataaaacatacacccaaaaagattga

SEQ ID NO: 5592 - DNA, 2751 bp, Neisseria meningitidis
atgctgacaaacattgccaagaaaatcttcggcagccgcaacgaccgcttgctgaaacaataccgtaaatccgttgccagaatcaacgcgctcgaagaacagatgcaagccctaagcgatgctgatctgcaagccaaaactgccgaattcaaacaacgcctcgccgacggtcagactttggacggcattttgcccgaagccttcgccgtctgccgcgaagcgtcccgccgcaccctcggtatgcgccacttcgacgtgcagcttatcggcggtatggtgctgcacgacggcaaaatcgccgaaatgcgtaccggcgaaggcaaaaccttggtcgccaccctcgccgtctatctcaacgcgctggccggcaaaggcgtacacgtcgttaccgtcaacgactacctcgcctcacgcgatgcgggcattatggagccgctctacaatttcctcggccttaccgtgggcgtgattatttcagatatgcagccgttcgaccgtcaaaacgcctatgccgccgatatcacctacggcaccaataatgaattcggcttcgactacctgcgcgacaatatggttaccgaccaatacgacaaagtgcagcgcgaattgaattttgccgttgtcgatgaagtggattccatcttgattgacgaagcgcgcactccgctgattatctccggtcaggcggatgacaacatccagttgtaccaaatcatgaacaccgttccgccccacctcgtccgtcaagagacagaagaaggcgaaggcgactattgggtcgacgaaaaggcacatcaggtcatcctgagcgaagcaggtcacgaacacgccgagcaaatcctgacccaaatgggattgctggcagaaaacgactccctctattccgccgccaatatcgccctgatgcaccaccttatggcggcattgcgcgcgcattccctcttccacaaagaccaacattacgtcatccaagacggcgaaatcgtcatcgtggacgaattcaccggccggctgatgtccggccgccgctggtcggagggtctgcatcaagccgtcgaagccaaagaaggcgtggaaatcaaacgcgaaaaccaaacgcttgcatctattaccttccaaaactatttccgcctgtacaccaagctctccggcatgaccggcacagccgataccgaagccttcgagttccaaagcatctacaacctcgaaaccgtcatcattccgaccaaccgccccgtacagcgcaaagacttcaacgaccagattttccgttccgccgaagaaaaattcgaagccgtcgttaaagacattgaggaatgccacaaacgcgggcagcccgtcctcgtcggcaccaccagcattgaaaactccgaactggtatccaagctgctgacccaagccggactgccgcacaacgtcctcaacgccaaagaacacgaacgcgaagccctgattgtcgcccaagccggcaaagtcggcgcgattaccgttgccaccaatatggcgggacgcggtacggacatcgttttaggcggcaacctgaagcaccaaaccgatgccatccgcgccgacgaaaccttgagcgacgaagagaaacaggcacaaatcgccgcactcgaagacggctggcaggcggaacacgacaaagtgatggaagcaggcggtttgcacatcatcggtacggaacgccacgaaagccgccgcatcgacaaccaattgcgcggacgttccggccgtcagggcgaccccggatccagccgcttctatctctcctttgaagacccattgctgcgcttattcgcactcgaccgcgccgccgccatcctcaaccgcctcgcccccgaacgcggcgtcgccatcgaacacaacctgctgacgcgccaaatcgaaggggcgcaacgcaaagtcgaaggcagaaacttcgatatgcgcaaacaggttttggaatacgacgacgttgccaacgaacagcgcaaagtcatttacagccagcgcaacgaaattctgaccagcaaagacatcagcgacctgatgcaggaaatccgttctgatgtcgtcagcgacctcgtggatacctatatgccgcccgacagcatggaagaacaatgggacatcccgactttggagaaccgtctggctgccgaattcagactgcacgaagacatccaatcctggctgaaggcggacaatgcgattgacggtcaagacatcaaagaacgcctgatcgaacgcatcgaaaacgaatatgccgccaaaaccgaactggtcggcaagcaggcaatggccgatttcgagcgcaacgtgatgttgcaggtcatcgacaaccaatggcgcgaacacctcgccgctatggactacctgcgacaaggcatacacctgcgcagctatgcccaaaaaaatccgaagcaggaatacaaacgtgaagcctttaccatgttccaagacctgtggaacggcatcaaattccatattgcctccctgcttacctcggttcaaatcgaacaaaaccctgtcgcggtggttgaagagcaacccatcggcaacatccagtccatccattccgaatcgcccgatatggaagaacttttgggtcagtcgcaaaccgatctggttaccgaagcctttaatcccgatgggacagatttcagccccgaagccttggaagcgcgggggcaaatcgtccaccgcaacgacccctgcccctgcggcagcggtttgaaatacaaacaatgccacggcaaactggcttaa

SEQ ID NO: 5593 - DNA, 1773 bp, Neisseria meningitidis
atgattccatccgacttcattgacgagcttttagccaaaaccgatattgtcgatattatcgacgagcaggttccgctgaaaaaaggcggggcgaactatatggcgtgttgcccgttccacaaggaaaaaacgccgtcgttttcggtcagtccaaccaagcagttttaccattgtttcagttgcggggcacacggctcagcgattggttttgtgatggaacatcagggactgtcgtttccggaggcggttcagttccttgccgaccgcgtgggtatggtcgtgccgaaagtgcacgggcaaaacgataatcccgaagtccgtgccgaacgtaagaaaaaacagcagacactggaggaaacgacggctgcggcagctgatttttacgcgcaacagctaaaattcaatccagcggcaaaagcttatttggacaagcgcggcttgagtgcagaagttatcgcgcattatggtttgggctatgcgcccgacggctggcagcctttgacgcaagtgttccaaccgtatcctaataccgcgttagtggatacggggatggtgattgacaatgagggacggcattacgaccgcttccgccatcggattatgttccccatccgcaatccgcgcgggcaggttatcggtttcggcggcagggtgctggacgactcgaagccgaaatatttaaattctcccgatacgcctttgttcgataaggggaaaaacctttacggactgtatgaagggcgtgccgctgtcaaggaagcggggcggattttggtggtcgaaggctatatggacgtggtcgcgctggcacagttcggcgtgggctacggcgtggcggctttgggtacggcgacgacggcggaacacgtcaaaatcctgatgcgtcaggcagacagtatttatttctgtttcgacggcgacagcgcggggcgaaaagcggcttggcgcgcgctggaaaacgcgctgccgcagttgaaggacgacaaatcgctgcattttttgttcctgccggaagaacacgaccccgacagctacatccgcgcctacggcaaagcgcaatttgaagacgcgcttctgaatcaaagcaagcctttgtcggagtatttctgggaacacctttcagacggcattcatctcaatacgcaggaaggcaaggcggaattggtaaaaaccagttcgccgcttttggcgcagattaccgcgccggcattggcttatttgttaaaacaacggcttagcgagctggtcggcatcgaccccgacaacctcgcgcaactgctaggacaggaagcgccgaagcggcacgtcaaacaaaaaaactacaaactgcctccgatttccgtcaaacagcccgtcatgctgacgctggtacagcggcaaatccgcagcctcttgataaatccggattgggctgcatatatagacctgcccgattatctggcgttggacggtgatttcgcctgccttgccaatcttgccgaatcgattaaaaaccatgccgccgtacccgaaaccgctcaggttttagagtatatgcgcggctcgccttacgaagaaacgataacccgaatcttccattcaacgcaccaatcggaagaaatgaacagcagcagtgaagaagattgcgagaatttccaaatcggcatgaaaaaactgctcaatgagttaaaatacagccaaatcgaaacattaaaacaaaaaagcctgcaatccggcttaaatgaaagcgagaaaaaacttttgctgtcgctgctgaccgcaaaacaaaattga

SEQ ID NO: 5594 - DNA, 1929 bp, Neisseria meningitidis
atgtccagaaaccaaaatcacgaagaatatcaagacgacacccgtccgttaagcattgaagagcaacgcgcgcgcctgcgtcagctcatcatcatgggtaaagaacgcggctacatcacctactccgaaatcaacgacgccctgccagacgatatgtctgatgccgaccaaatagacaatatcgtcagcatgatttccggtttgggcatccaagttaccgaacacgcccccgatgcggaagacatattgttaagcgacaatgccgccgttaccgacgatgatgccgtcgaagaagccgaggccgccctttccagtgcagattccgagttcggcagaaccaccgaccccgtccgtatgtatatgcgcgaaatgggacaggtcgacctgctgacccgcgaagacgaaatcatcatcgcaaaaaaaattgaaaacgccctgaaaaatatggttcaggccatctccgcctgcccgggatccattgctgaaatcttagaactcatcgaaaaaatccgcaaagacgaaatccgcgtcgacgaagtcgtagaagccattatcgacccgaatgaagtattgctcaacgaattgggcttggggcacttggaaaccacagcgcccgagaaaccttccaacgacaattcggacgaaaacgaagacgacgaagaatcggaagaagatgcggatgaaatctcggcagccaatctcgccgaattgaaacaaaaagtcatcggccactttgcccaaatcgaaaaagactacaaaaaaatgattggccgtttggaaaaacaccacagccggcacaaagactatctcgcctaccgcgacgcgattgccaacaaactgctggaagtccgtttcgccacccggcaaatcgacagcctcagcagcagcctgcgcgggaaagtagaaaacatccgcaaactcgaacgcgaaatccgcgacatctgcctcgaccgcgtccatatggaacgcgactacttcatccaaaacttcctgcccgaaatcaccaatctagaatggattgaagaagaaatcgccaaaggcagggtttggagcgacgcgctcgaccgcttccgccacgccatcctcgaaaaacaaaccgagttggcggatatggaaaaagaaacccgcatttccatcgaagagttgaaagaaatcaacaaaaatatggtgtcgagcgaaaaagaaaccgcagccgccaaacaggaaatgattcaggcaaacttgcgcctcgtgatttccatcgccaaaaaatataccaaccggggcttacaattccttgatctgattcaggaaggcaacatcggtttgatgaaagcggtcgataagttcgaataccgcagaggctataaattctccacctacgcaacctggtggatccgccaggcaattacacgctcgattgccgatcaggcgcgtaccatccgcattccggtacatatgattgaaaccatcaacaagatgaaccgcatctcgcgccaacaccttcaagaaaccggcgaagaacccgattccgccaaacttgccgaactgatgcagatgcccgaagacaaaatccgcaaaatcatgaaaatcgccaaagagccgatttcgatggaaacccccatcggcgacgacgacgattcgcacttgggcgacttcatcgaagatgccaacaatgttgcgccggccgatgcggcaatgtacaccagcctgcacgaagtaaccaaagaaatcctcgaaagcctgacaccgcgtgaggcaaaagtcctgcgtatgcgtttcggcatcgatatgaacaccgaccacacgctggaagaagtcggcagacagtttgacgtaacgcgcgaacgcatccgacaaatcgaggcaaaagcactccgcaagctgcggcatccgacaagaagcgaccgtttgagaagtttcttggacagcgaagacagcaagctgtaa

SEQ ID NO: 5595 - DNA, 1008 bp, Neisseria meningitidis
atgagcaccttctttcagcaaaccgcacaagccatgattgccaaacacatcgaccgtttcccactattgaagttggatcaggtaattgattggcaaccgatcgaacagtacctgaaccgtcaaagaacccgttaccttcgagaccaccgcggccgtcccgcctatcccctgctgtccatgttcaaagccgtcctgctcggacaatggcacagcctctccgatcccgaactcgaacacagcctcatcacccgcatcgatttcaacctgttttgccgttttgacgaactgagcatccccgattacagcaccttatgccgctaccgcaactggctggcgcaagacgacaccctgtccgaactgttggaactgattaactgccaactgaccgaaaaaggcttaaaagtagagaaagcatccgccgccgtcgttgatgccaccattattcagaccgctggcagcaaacagcgtcaggccatagaagtcgatgaagaaggacaagtcagcggccaaaccacaccgagtaaggacagcgatgcccgttggatcaagaaaaacggcctctacaaactcggttacaaacaacatacccgtaccgatgcggaaggctatatcgagaaactgcacattacccccgccaatgcccatgagtgcaaacacctgtcgccgttgttggaagggttacccgaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttatcgaagacccgttatgtggtcgaacaaagcttcggtacgctgcaccgtaaattccgctacgcccgggcagcctatttcggactgattaaagtgagtgtgcaaagccatctgaaggcgatgtgtttgaacctgttgaaagccgccaacaggctaagtgcgcctgttgccgcctaa

SEQ ID NO: 5596 - DNA, 2832 bp, Neisseria meningitidis
atgaataagaaacacggttttccgctgactctgactgccttggccattgcaaccgcttttccggcttatgctgcccaagcggggggggcgacacctgatgccgcgcagacccaatccctgaaagagattaccgtccgtgccgccaaagtgggacggcgatcgaaagaggcgaccggtttgggcaaaatcgtcaaaacgtcggaaacgttgaacaaagaacaggtactcggtatccgcgacctgacgcgctacgatccgggcgtggcggttgtcgaacagggcaacggcgcgagcggcggctactcgatacgcggcgtggataaaaaccgtgtggcggtttcggtcgacggtgttgcccaaatacaggcgtttaccgtgcagggatcgttgagcggatacggcggacgcggcggcagcggtgcaatcaacgaaatcgaatatgaaaacatcagcacggtggaaatcgacaaaggtgccggttcgtccgatcacggcagcggcgcactcggcggcgcggtcgccttccgcaccaaagaggcggcagacctgatttcagacggcaaaagttgggggatacaggcaaaaaccgcctacggcagtaaaaaccgccaatttatgaagtcgctcggcgcggggttcagcaaagacggttgggaagggctgttaatccgaaccgaacgccaagggcgggaaacgcgcccgcacggcgatattgcggacggggtggaatacggcatagaccgtttggacgcgttccgtcagacatacgatattaaacgcaagacaagagagccatttttctcagtagagggcgagcgtgaatccaagcccgtggcaaaattggcgggctacgggaaatatttgaacaaccagctcaaccgctgggtaaaagaacgtattgaacaaaatcagcctttaagtgctgaagaagaggcgcaggtgcgggaggcgcaggcgcgccacgaaaatctgtccgcccaagcttacacgggcggcggcaggatattgcccgatccgatggattaccgcagcggctcttggcttgccaagctgggctaccgcttcggcggcaggcattatgtcggcggcgtgtttgaggataccaaacagcgttacgatatccgcgatatgacggaaaaacagtattacggtacggacgaggcggaaaagtttagagacaagagcggggtgtacgacggcgacgatttccgcgacggcttgtattttgtgccgaatatagaagagtggaagggcgataaaaatttggtcaggggcataggtttgaaatattcccgcaccaaatttattgacgaacatcaccgccgccgccgtatgggtttgctgtatcgttatgaaaacgaagcgtattctgacaattgggcggataaggcggtgttgtcgtttgacaaacagggcgtggcaaccgataacaacacgctgaagctgaattgcgccgtgtatcctgctgtggacaaatcctgccgcgcgtcggcggacaaaccgtattcctacgacagcagcgaccgtttccactaccgcgaacagcacaatgttttgaatgcctcgtttgagaaatcgctgaaaaacaaatggacgaaacaccatctgactttgggcttcggttacgatgcttccaaagcgatttcccgccccgaacagctttcccacaatgcggcaaggatttcggaatccacgggattcgatgaaaacaatcaagataagtatcttttgggtaagcccgaagtcgtcgaagggtcggtctgcggctacatcgaaaccctgcgttcccgcaaatgcgtgccaagaaaaatcaacggcagcaatatccatatttctttgaacgaccgtttttcaatcggcaaatatttcgatttcagcttgggcggcaggtacgaccggaaaaacttcaccacgtcggaagaactcgtccgcagcgggcggtatgttgaccgttcgtggaacagcggcatcttgttcaaaccgaaccggcatttttccgtgtcttaccgtgcctccagcggcttcagaacgccctcattccaagaacttttcgggatagacatttatcacgattatccgaaaggctggcagcgtcccgccctgaaatcggaaaaggcagccaaccgggaaatcggtttgcagtggaagggcgatttcggctttttggaaatcagcagcttccgcaaccgttataccgatatgattgccgttgccgatcacaaaaccaaattgccgaatcaggcaggacaattgacagagattgatatacgcgattattacaatgcccaaaatatgtcgcttcaaggcgttaatatattgggaaaaatcgactggaacggcgtgtatggcaaactgcccgaaggtttgtacaccacattggcgtacaaccgcatcaaaccgaaatcggtatccaaccggccgggactgtccctccgcagctatgctttggatgcggtacagccgtcgcgttatgttttggggttcggatacgaccagcctgaggggaaatggggcgcaaacattatgctgacctattccaaagggaaaaaccctgacgagcttgcttatctggcaggcgatcaaaaacgatattcgacaaaaagagcgtcgtcttcttggtcgacggcagacgtttccgcctatctgaatctgaaaaaacggctgaccttgagggcggctatctacaatatcggcaactaccgctacgttacttgggaatccttgcgccagactgcggaaagcacggcaaaccggcacggcggcgacagcaactatggaaggtatgccgcaccgggcaggaacttcagtctcgcgctcgaaatgaagttttaa

SEQ ID NO: 5597 - DNA, 2214 bp, Neisseria meningitidis
atgtgtaaaccgaattatggcggcattgtcttgttgcccttacttttagcatcttgtatcggcggcaatttcggcgtgcagcctgttgtcgaatcaacgccgaccgcgtaccccgtcaccttcaaatctaaggacgttcccactccgccccctgccgggtcttcggtagaaaccacgccggtcaaccggcccgccgtcggtgcggcaatgcggctgccaaggcggaatattgcttcctataaacaagacggtacggaaattcccgacaagcatcaggcagaggagcatctgccgcttaaagagaaggatatcctgtttttagacggtacgctgaaagaacaggctgacaaacttaaaaagaaaatcaacgaacggtattctgatgtgagggttatcacatcgaaaaaagaagaagaaaaatatcaatatcaatttgtccgtgcgggctatgtgtttaccagggcggaaggaaaggataatgaaaaagaaaagacttctgatggtaaggagtttgttaaccgatttagttatgacggttttgtatattattccggagaacgtccttcccaatctttaccgagcgcgggaacggtgcaatattccggtaactggcaatatatgaccgatgccaaacgtcatcggacaggtaaggcggtttccagtacggatttgggttataccacatattatggtaatgaaattggggcaacttcttatgaggctagggatgccgacgacagggaaaagcatcctgccgaatatacggttgattttgataacaaaaccctgaatggcaagctgattaaaaatcagtatgtgcaaaataaaagtaatccaaatgagcccaaaaaaccgctgaccatttacgacattaccgcaacattggacggcaaccgctttaccggcagtgccaaagttagcaccgaggtgaagacgcaacacgctgataaagaatatttgtttttccataccgatgccgatcagcggcttgagggcggttttttcggcgataacggagaagagcttgccggacggtttatcagcaacgacaacagcgtattcggcgtattcgcaggcaaacaaaaaacagagacagaaaacgcagcagatacaaaacctgccctgtcgtctggaaaacacaccaaaatcttggattctctgaaaatttccgttgacgaggcaagtgataaaaatccccgtgagtttgccatttcctctatgcccgattttggtcatcccgacaaacttcttgtcgaagggcgtgaaattcctttggtaaacaaagaacaaaccatcgagcttgccgatggtaggaaaacgacaatccgaacctgctgcgattttctgacctatgtgaaaatcggacggatgcaaaccgaacgtcccgccgccaaaccgaaggcgcaggacgaagagagggacgaagaggatacaggcgttgatagcgtcgaagaaggcgaagacgaaatcgacgatgaagaaggcaccgaagacgcagccgtaaaagacgaaggcagcgaagaagacgaagccgtagaaggtgaagatgaagctgaagaacccgaagaagaatcgccgacagaagaaggcggcagcggttcagacggcatcctgcccgctccggaagcccctaaaggcaggaacatcgaccttttcctgaaaggtatccgcacggcggaaacggatattccgaaaactggagaagcacactataccggcacttgggaagcgcgtatcggcaaacccattcaatgggacaatcaggcggataaagaagcggcaaaagcagtatttaccgttgatttcggcaagaaatcgatttccggaacgctgacggaggaaaacggtgtagaacctgctttccatattgaaaacggcaagattgagggcaacggtttctacgcgacagcacgcactcgggagaacggcatcaatctttcgggaaatggttcgaccgaccccaaaaccttccaagctagtaatcttcgtgtagaagggggattttacggcccgcaggcggaggaattgggcggtattattttcaataatgatgggaaatctcttggtataactgaaggtactgaaaataaagttgatgttgaagctgaagttgatgctgaagttgatgttggcaaacagttagaatctgaagttaaacaccaattcggcgtggtattcggtgcgaagaaagatatgcaggaggtggaaaaatga

SEQ ID NO: 5598 - DNA, 222 bp, Neisseria meningitidis
atgtcagcagtaaatgtaatattttcctgttcttattggagaatatttaaaaaatcagattcttgtgttttgtgtttttatcagttcagacatggcgaaccgcataaactcattaatcaagagaatttttcaaagctttatcaggcgttcgattatatagattcggttggttcgaattttccagtgattatcacaacggatggttgtggtcttttttgttga

SEQ ID NO: 5599 - DNA, 1215 bp, Neisseria meningitidis
atgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggaggtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaaagcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaa

SEQ ID NO: 5600 - DNA, 312 bp, Neisseria meningitidis
atgtttaatcaaactcaaactgtaacttatcctgcaacttttttgggagccaaaaaattcaaaggcgaaattgatggctctaatatcgacacttgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttga

SEQ ID NO: 5601 - DNA, 201 bp, Neisseria meningitidis
atgaaatttgaagaacgtttcatagttcaagacttggaaacgcatgactttatttatcccgatcctttcggtgatgtggggtttactcaaaatattaaatcagcaggtcaatttgaaagctacgaagatgcgttgaattcaggcataaatgaaataggcggaggattccagatatttcagttcttcgtaaaatcggaataa

SEQ ID NO: 5602 - DNA, 285 bp, Neisseria meningitidis
atgaagcaagtcaagaagtcgtcttattttaaatatcaaaaaaggaaaaaaacgatgaacatcgttaaaaaatacgctgtaaaagcagccttggcagccggtatcttcacaccggccattgttatggcagatacctttgatccatccgcgattggtacgcaagtagcgaatgtaatcatgggtttcgtgtcaatggtttccgccgtgggtatggcggccattaccgtgattcttgcaatccaaggcttcaaaatggcttggagcatgattaaatctgtcaaataa

SEQ ID NO: 5603 - DNA, 303 bp, Neisseria meningitidis
atgggctatcgtgtcggcataaattgttttgatacaagattgcaggcagacgactatttattgtcgtcccttcctcctactgttacccaggacggaaaaatcatcaggccggaaagggtgggcgataaatggattttgaacggaaagccggttacgttgtcttatccggaatgttccaattttgagcagataaagcaaggttcttatgtcggttcgacggttctaattctgtttgtagtcatttacggtttcaggcttctgattaattttttaaaagacataggcaaggttgggactgattga

SEQ ID NO: 5604 - DNA, 1647 bp, Neisseria meningitidis
atgaagcaaaatgttatgtttattatcctagggcgaaattttttaaagattatcctatgctttagtttttttgtatctaaatttgcattggcatcagtaaatgctccgggtaaatttgatagggttgaagtttatgatgatggcagatatttaggtattcgaggttcagatgacaaaagaagaagaatttggaaaggtgtatttgatagagaatcgggaagatatttaacttcagaagctcaagatttaaaagttaggcatgtatctactggagcatcaagtacgggtaaagttagttcggttgtatcttcatcagtttcccgcgctggcgtattggcgggggtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatagttgcacatttgattggaacggcggagattgtgtggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccgggacgcacaaacggcagggacggcaaagacggaaaggacggcaaagatggcggccttttgtgcaaattcttccccgacattctcgcttgcgacaggctgcccgagtccaatccggcagaagatttaaatctgccgtctgaaaccgtcaatgtagagtttcagaaatcaggaatctttcaagattccgcacagtgtcccgcacctgtcactttcacagtgactgtgcttgattcaagcaggcagttcgcgttcagctttgagaacgcatgtaccatagccgaacggctaaggtacatgcttctcgcccttgcttgggcggttgccgcctttttttgtatccgcacagtatctcgtgaagtctag

SEQ ID NO: 5605 - DNA, 153 bp, Neisseria meningitidis
atgtcgcaaatagccgagaagcgcggggggattggcgataagcgcgaggggggtgtccccacagcgccgccgcgccgcgaatgcggcgcaaaatctttcagattaagaaacatttgtttaatgaggcaaccgtgccttttaagaaagggatag

SEQ ID NO: 5606 - DNA, 285 bp, Neisseria meningitidis
atgaaattgttggccgcattgattccgcttttgatgagcgtggcaggccgtatattgactgcattaggcttgatggcggtaacctattcaggggtggatagattggtagcccattttcagcaggcgataaccaatagcataacgggcgcgcctcaagcgatgttgcagcttttttatataagcggcggtggaaccgttcttaatatcctgtttggcgcgatcgcctttattctgtcattcaaacaaatgacaaaactagcaacctcaatcgggaagaaaaaataa

SEQ ID NO: 5607 - DNA, 1104 bp, Neisseria meningitidis
atggcagagatctgtttgataaccggcacgcccggttcagggaaaacattaaaaatggtttccatgatggcgaatgatgaaatgtttaagcctgatgaaaacggcatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgaaagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccacattgggcggaaaaccgtag

SEQ ID NO: 5608 - DNA, 957 bp, Neisseria meningitidis
atgaatataatcgggctggacatctcaaaggacaccatagacgcaacattgcataaaacaaacggaagtatccattacattaaatttaagaataatgatgatggattaaaacagtttagattgtggataaagggaaacagaatcagaaaagtctatatcggcatggaggcaacaggcatctattacgaaaaggcagcagatatgctttcttcctactatactgtttacgttattaatcccttaaaaatcaaggactacggaaaaagcaggtttaaccgtaccaaaaccgacaaagcagattcaaacctgatagcagactacataaaaaggcatcaagatacattgataccgtatcagatacccaaaaacaaagcactgcaaaaactgattaaccttaaaaatcaattacatcaacatcagaagcaaattaaaaaccgtcttcatagcactgaagaagacttcataaggaacatacatcaagacttgatagataccatacaggacaagatggaacaggtaaaaatagccatatccgaacaaatcaaaaaacaaacggacaataaccattaccgcaatcttcaaaccatcccgagcataggcaaagacaccgcatcagttctttatgcgcaactgacagaaaaacattttaaaaccgcaaaccagtttgtatcctatgccggattaaatcccgccatcatacaatcagggacaagcgtaagaggtcggggcagattgagccgatacggaaacagacgattaaaaagtacgctgtatatgcccgccctttgtgcttaccgttttaacgcatttccgaaattaataaataatctgaaaaaagcgggtaagccaaagatggtaatcatcgttgccatcatgcgcaaactggcgaagctcgcctattacattgttaaaaccggccagccttacgatgcggaaagacaccgattgaatcaataa

SEQ ID NO: 5609 - DNA, 318 bp, Neisseria meningitidis
atgagcaccttcttccagcaaaccgcccaagccatgattgccaaacacatcgaccgcttcccgctattgaagttggaccgggtgattgattggcagctgatcgaacaatacctgaaccgtcaaaaaacccgttaccttagagaccaccgcggccgtcctgcctatcccctgctgtccatgttcaaagccgtcctgctcggacaatggcacagcctctccgatcccgaactcgaacacagcctcatcacccgcatcgacttcaacctgttttgccgtttcgacgaactgagcatccctgattacagtatagtggattaa

SEQ ID NO: 5610 - DNA, 1635 bp, Neisseria meningitidis
atgaccaaattcattttcgtcaccggcggcgttgtctcctcactgggtaaaggtatcgccgccgcttctattgccgccatcctcgaatcgcgcggcttgaacgttaccatgctcaagctcgatccttatatcaacgtcgatcccggcacgatgagcccgttccaacacggcgaagtgttcgtaaccgacgacggcgcggaaaccgacctcgacttgggacactacgaacgctttatcgattccacgatgacccgccgcaacagcttcagcacgggacaggtgtacgaaaacgttatcgccaaagaacgacggggcgactacctcggcggtacggttcaagtcattccgcacattaccgacgaaatcaaacgacgcatccacgaaggcgcggcaggttacgatgtggcgattgtcgaaattggcggcacggtcggcgacatcgaatcgctgccgtttttggaagccatccgccagatgcgaagccagttggggcgcaacaacaccttgtttgcccacttgagctacgtcccctacatcgccgccgcaggcgaaatcaaaaccaagccgacccagcacaccgttaaagaaatgttgagcatcggtttgcaacccgacatcctgatttgccgtatggacaggacaatgcctgcggacgaacgccgcaaaatcgccttgttctgcaacgtggaagaacgcgcgattgtcggcagctacgatgtggacagcatctacgaatgccccgaaatgctgcacgaccaaggcatcgacaacatcattaccgagcagttgcagcttaatgtgcagcaggcggatttgaccgcgtggaaaaaaatcgtccacgccatccaaaacccgaaacacaccgtcaaaatcgccatggtcggcaaatacgtcgatttgaccgagtcctacaaatcgctgatcgaagccttgaaacacgcaggcattcacaccgaaaccgacgtgcagattacctttgtcgacagcgaaaacatcgagaaaaacaagggcgacgtttccatgcttaaagacatggacgccatcctcgttcccggcggtttcggttcgcgcggtgtggaaggcaaaatcgccgccgtgcgctacgcccgcgaaaacaacgtgccatacttgggcatctgcctcggtatgcagattgcgctgatcgaatacgcccgcgacgtggcaggcttgaaaggcgcgaattccaccgagttcgacctcaaatgcgccgcgccagtcgttgccctgattgacgaatggcaaactgccgacggcagcgtcgaaacccgcgacgaatccaccgatttgggcggcacgatgcgtttgggcgcgcaagaagtcgaattgaaagcaggcagcctcgccgccaaaatctacggcagcggacatatccgcgaacgccaccgccaccgctacgaagtcaacaacaactacgttcctacactggaacaggcaggtttggtcatcggcggtgtatctgccggacgcgaacgcttggtcgaaaccatcgaactgccgaaccatccttggttcttcgcctgccagttccaccccgagtttacctccaatccgcgcaaagggcatcctttgttcaccgcgtttgtcaaagctgcgttgaacaataaaaaagcctga

SEQ ID NO: 5611 - DNA, 1671 bp, Neisseria meningitidis
atggaaaaaatctggttagacagctacgagaagggcgtcagtgccgaaatcgacatcacgcaatacaattccgtcagcgacgtattccgccaaagcgtggaaaaatttgccgaccaacctgcttttcaaaacatgggtaagacgctgacttatgccgaaaccggcaaactggcaacagattttgcttcttatctgcaaaacgtccttaaattgcctcgaggagagcgcgtggcaataatgttgcccaatgtactgcaatatccggttgcccttttcggcattttgcaggcaggtttggtagcggtgaacaccaatccgctctataccccgcgcgagctggagcatcagttgaaagacagcggcgcgaccgccatcatcgttttggaaaatttcgccaacacgctggagctggtgctgccgcgcacgcagatcaaacacgtcatcgtagcctccgtcggcgaaatgttcgggctgcttaaaggttcgctgatcaatttcgtcatccggaaaatcaagaaaatggtgcccgaataccgtattcgggaaaccgtttcctttcagacggcattgaaagaaggggcgaagcacgttttccaacctgtcgcattaaaccgcgaagataccgcgctgttgcaatacacgggcggcacgacaggtgttgccaaaggggcggtgctgagtcacggcaacatctgcgccaatatgcttcaggcaaaagaatggattaaaaaccagttgcgcgagggcaaagaaaccgttatcgccgccttgccgctgtaccatatttttgccttaaccgtgaatctgatgatttttgccaatgccggctcgaaaatcatcctgattaccaacccgcgcgatatgaaaggctttatcggagaactgaaaaaacagcgggttaatgtatttatcggcgtgaacacgctgtttaacgcgatggttaaccgtcctgattttgccgaagtcgatttttcagaattgcggctgactttgggcggcggtatggcgacccaaaaagccgttgccgaaaaatggaaaaaaatcaccggcacgcccatcgtcgaagcctacggtctgaccgaagccagccccggcgtgtgctgcaaccccttaaacatcgaatcatacagcggcagcatcggtttgcccgtctcgtccaccgaagtcgaactgcgcgacgcaaacggcaaagaagtccccgtcgggcagccgggcgaattgtgggtaaaaggccctcaagtgatgcaaggctactggaaccgccccgaagaaaccgccaaagccatagacgcgcgcggcttcttggaaaccggcgatattgccgtcatggacgaaaaaggctggttgaagctggtcgatcgtaagaaagacctcgtcgttgtttccggattcaatgtttatccgaacgaaatcgaggaagtcatcgcgcatcacggcaaagtcatggaagtcgcctgtatcggcgttcccgacgaaaaaaccggcgaggcactcaaagtattcgtcgtcaaaaaagacccgtctttgaccaaagaagaacttatcgctttttgccgcaccgaattaaccgcatataaagtaccgaaaaatatcgaattccgcgacgagttgcccaagtccaacgtcggcaaaatcctgcgccgcgagttgcggcaaagtaccgggaaataa

SEQ ID NO: 5612 - DNA, 1104 bp, Neisseria meningitidis
atgaatacgacagcaaacccttccaatatcatcgtcgggctctccggcggtgtcgattcttccgtaaccgccgccctgctcaagcagcagggttatcaagtgcgcggtgtgttcatgcagaactgggaagacgacgacaacgacgaatattgcagcatcaaacaggattcgttcgatgccatcgccgttgccgatattatcggcatcgatatcgacatcgttaatttcgccgcgcaatataaagacaaagtctttgcttattttcttcaggaatacagtgcggggcgcacgccgaatccggatgtgttgtgcaacgccgaaatcaaattcaaatgctttttggactacgccgtagggcagggcgcggataccatcgccaccggccactatgcgcgcaaagaagttcgcaacggcgtgcattacctgctcaaaggtttggatcgaaacaaagaccaaagctatttcctctaccgcctcaagcctttccaactcgagcgcgcgatttttccgttgggcggtttggaaaaacccgaagtgcgccgccttgccgccgagttcaaactgccgaccgccgctaaaaaagacagcacgggcatctgtttcatcggcgaacgcccgtttcgcgagtttctgcagaaatacctgccgaccgacaatggtaaaatggttacgcccgaagggaaaaccgtcggcgaacacgtcgggctgatgttctacacgctcggacagcgcaaaggtttgggcattggcggcgcgggcgaaccgtggtttgttgcggctaaagatttgacgaaaaacgaactgattgtcgtgcaaggacacgaccatccgctgctttatacccgcagccttgtgatgaacgatttgagtttcacgctgcccgaacgcccgaaggcaggacgctatacctgcaaaacgcgttaccgtatggcggacgcgccttgtgagttgcgctatttggatgatgaaaccgccgagctggtgtttgacgaaccgcaatgggcggttacgccgggtcagtccgccgtgctgtacgacggcgatatctgtttgggcggcggtatcatccaaacgaccgacaaacccgtcatcatcacacgataa

SEQ ID NO: 5613 - DNA, 474 bp, Neisseria meningitidis; identical to SEQ ID NO: 731

SEQ ID NO: 5614 - DNA, 384 bp, Neisseria meningitidis
atggaaccttcctcctacgcggcagaaaaaaaaggcaaaggcggcatcaggcgcgtcattaacgcattcggctattcgatagacggcatcgccgccgcctaccgttacgaagcggcattccgtcaggttttgtggctgaacgtactgctggtgtgcgcggcatttttttgggtttccgaaaccgccgtccgcctgccgttgattatcgcgtcttttgtgtcggtcattgtcgaactgttcaacaccgccgtcgaagctgccgtcgatcatacttcgaccgaaaaacacgagctggccaaactcgccaaagacgcaggttctgccgcacaattgttcgcgatgctgatgttggcggcggtttggctgtctgccctgttcgggtaa

SEQ ID NO: 5615 - DNA, 960 bp, Neisseria meningitidis
atgatgaaagtcctctttatcgccgacccgatggcaagtttcaaaacctataaagacaccacctacgcgatgatgcgcgaaatggcaaaacgcggctggcggctgtttcacacattgagcggggaattgtctgtaaacggcggtttggtaacggcgcaggcatcggcatttgaatttttgggtgcaaaaaacgatgatgatcatgcgtggttcaaatctgccgacaaagttcagacggcattggaagcatttgatgccgtgattatgcgtaccgatccgccgttcgatatgcaatacctctacgccacccaattactgacgctggcggaacagcagggcgcgaaggtctttaacagcggacaggcgatgcgcgactttaatgaaaaactggcgattttgaacttcagccgctttatcgcgcccacgctggtaacgacccgttccgccgatgtccgcacatttttgaaagaacacggcgacatcatcatcaaaccgctcgacggcatgggcggtatgggaattttccgcctgaccgaaaaagaccccaacatcggcagcatcctcgaaaccctgatgcagcttgattcccgcaccattatggcgcaacgctacattcccgaaatcgtacacggtgacaaacgcatcctgattatcggcggcgaagtcgtcccctatgctttggcgcgtatcccgcaaaacggcgaaacacgcggcaaccttgcggcaggcgggcgcggcgtggcgcaggaattgggcggacgcgaccgcgaaattgccgaaacgctcgcccccgaactcaaacggcgcggcatcctgctggccggtttggacgttatcggcagcaacctgaccgaagtcaacgtaaccagcccgaccggattccaagaaattatgaaacaaaaaggtttcgatgtggcggcaatgtttgccgatgccgttgccgcgtggtcggtacgttaa

SEQ ID NO: 5616 - DNA, 1689 bp, Neisseria meningitidis
atgctcaataaagaccaatttgcggacaaccattttatccgcaccatcatcgaagaagacctcgaaagcggcaaacatacagctgtccaaacccgtttcccgcccgaacccaacggctacctgcacatcggacacgccaaatccatctgcctgaacttcggtttggcgtatatttacgacggcttgtgcaacctgcgttttgacgataccaaccccgaaaaagaaaacgacgaatacgtcaacgccatcaaagaagatgtcgagtggctcggtttccattgggcgggcgagccgcgtttcgcttccaactatttcgaccagctttatgactacgccgtcggtttgattaaagacggcaaagcgtatgtcgatgatttgacgcccgaagaaatgcgcgaataccgcggtacgctgaccgaagcgggtaaaaacagcccttaccgcgaccgcagcgtcgaagaaaacctcgacctgttcacacgcatgaaaaacggcgagttccccgacggcagcaaaaccctgcgcctgaaaatcgacatggcatcgggcaacatcaatatgcgcgaccccgtcatctaccgcatccgccgcgcccatcaccacaacaccggcgacaaatggtgtatctacccgatgtacgactacacgcattgcatctccgatgccatcgaaggcatcacgcattccttgtgtacgctcgaattcgaagcacaccgtccgctgtacgactgtgtgttggacaacattcctgcgccgcatgccacccgtccgcgccaatacgagttttcccgtttggagcttttgtacaccattacctccaaacggaaattgaatcagttggttgtggaaaaacacgtttccggctgggacgatccgcgtatgccgaccatttccggtatgcgccgacgcggctacacgcccgaagggctgcgcctgtttgccaaacgcgccggtatttccaaatctgaaaacatcgtcgatatgagcgtgttggaaggcgcgattcgcgaagagttggaaaattccgccccacgcctgatggcggtgttgaacccgctcaaagtgaccctgaccaactttgaaaccggcagaacccaaagccgccgtgccgcgttccatccgaaccacgaggaaatgggcgagcgcgaagtacctatttcccaaaccatctatattgaagccgacgactttgccgaaaatccgcccaaaggcttcaaacgcctgattcccggcggcgaagtacgcttgcgccacggctatgtcatcaagtgcgatgaagtcgtcaaagacgaagcaggcaatgtggttgaactcaaatgcagcatcgaccacgacaccttgggcaaaaatccagaaggccgtaaagttaaaggcgtgattcattgggtttccgccgaacacgccgccgaaatcaaagtccgtctgtacgaccgcctctttaccgtcgagcgtcccgatgccgtgcgcggcgaagacggcgaatacctgccgttcaccgatttcctcaatccggaatccgtcaaggaaatcaccgcctacgccgaacctgccgccaaagatttgccggcagaaagccgttggcagttcgagcgtatcggctacttcgtaaccgaccgtaaagaccacggcaaagacacgccggtgtttaaccgcacggtaacgctgaaagactcttggcagcctaagtaa

SEQ ID NO: 5617 - DNA, 774 bp, Neisseria meningitidis
atgaagccgaaaatccaaaggcacggagagattttaagccttgtccgccggcatcagtttatgtcggtggacgagcttgccgccgcattggacgttaccccgcagacgatacgccgcgacatccgcgagttggaggaggtcggcagcctgaaacgccatcacggcggcgcatcttcgggcggaaacttgccggagggcctgcccgccgaccgccaaacccggtgtcaaaacgaaaaaaacgccattgcccggctgattgcggaacacatccccgacggttcgtcgctgtttgtcagtatcggcacgacgatggaggccgtggtgtcggagctggtcaggcggcgcggcagcctgagggtgattaccaacaatatccacgccgcctcgattgcttcggcgcggacggattatacggtcatcatcacttccggagtcgtccgccctttggacggcggtattaccggcgtggcaaccgtcgattttatcaaccagttcaaagtcgattatgccgtgatgagtacgcacggcgtggaaagcgacggttcgcttttggacgacgactacaaagaagtcagcgtgatgcaggcgatgattgccaatgcgcgcgtccgcttcctcggcgtggaccacagtaaattccgcagcaacgcgctggtcaggctcggcgacattacggcgtttgacaaagtatttaccgaccggctgcccgataccgcgatgcagaagatgctgaaagaggcgggggtggaatgcttgattgccgatgccgtctga

SEQ ID NO: 5618 - DNA, 903 bp, Neisseria meningitidis; identical to SEQ ID NO: 3315

SEQ ID NO: 5619 - DNA, 717 bp, Neisseria meningitidis
atgaactttgaaaacgacgacattatccatgcgccgaccacgtcttccctgattctcgaagagcggcacgattcggagctgttccgtgtttacgccctgattttggacggcattaccgatcaggtgctgctgcccggcaaaaagctgaccgaatccgaactttgccgtcagatggtgtgttcgcgcaacaccgtccgcggcgcgctgtcgcttttggcgcacgacaagattgtcgatttgcaacccaacaggggcgcgttcgtccacgttcccgatttgaaagaaatgcaggatgtgttcaatgcgcgcatcgaaatggagacgatgattttgaatatcctcgcagatttgccggatttggaaacgcgcctcaagccgctttatgcgatgatacggcgcgaagaagaggcctccggcaggggcgaccgcgtcggctggaaccgcctgtccaatgccttccacgtcgaactggcgcgcctggtgggcaacgatgtgctgttcgacattatgaatacgctgtgcgcgcggtcttccctgattgtcgccgtggcgggcgtgcatcgcgaggaaaaacacgccatcaatacgcatacgcattccgaacaccgcgaaatcctcgacctgctgctggcgggcaggcgcaaccgcgtggtcaaaatcctgcgccgccatttgggcaactgtatggagcgtttggaaaagactttggaagattga

SEQ ID NO: 5620 - DNA, 423 bp, Neisseria meningitidis
atgcaggttacatcaaaatggatagacgggatgtgttttgtcggcacgacggaaggcgggcacagcgtcgttatggaggggtcggcggcagaaggtaaggctaagcgcgggcccagccctttggaaatgctgctgttgggcgtggcgggctgttcgagcatcgatgtggtgatgattgccgaaaaacagcgtcagaaagtgactgactgccgtgcgacggttacggcgaaacgggcggacgatgcgccgcgcgtgtttaccgaaatccacatccatttcaaagtattcgggcatgatttgaaagaatcggccattgagcgcgccgttcagatgtctgccgaaaaatactgttcggcttcgattatgttgggcaaagcggcaaagattacccacagttttgaaattgccggggcagataaatag

SEQ ID NO: 5621 - DNA, 672 bp, Neisseria meningitidis; identical to SEQ ID NO: 775

SEQ ID NO: 5622 - DNA, 627 bp, Neisseria meningitidis
atgaaaaacatcgtcatcctgatttctggacgcggcagcaatatgcaggcaatcgtcaatgccgccattcacaacgtccgcattgccgccgtgttgagcaacagcgaaacggctgccggtttgcaatgggcggccgaacgcggcatcccgaccgatagcctgaatcataaaaactttacatcccggcttgccttcgataccgccatgatggagaaaatcgacgcatatcaacccgacttggtggttttggcaggttttatgcggattctgacccccgagttttgcgcccgttacgaaggcaggctgatgaacattcacccgtccatccttccctcgtttaccggacttcatacgcacgaacgcgctttggaggcgggctgccgcgttgccggctgcaccatccatttcgttactgccgaactggattgcggcccgattgtatcgcaaggggttgtgccgatactcgacggcgatacggcagacgatattgccgcacgggttttggctgtcgagcataaactttatccgaaagccgttgccgattttgccgccggccgcctgattattgagggaaaccgcgtcagaaattcggaaaacgccgatgccgcccgttttctgacggcgtaa

SEQ ID NO: 5623 - DNA, 819 bp, Neisseria meningitidis; identical to SEQ ID NO: 2727

SEQ ID NO: 5624 - DNA, 441 bp, Neisseria meningitidis
atgccgaaagccaccttttacacgcacgttgcccaagttccgattttcacctgccgcctgattgcccgtgcgattcgggacggcggcaggatactggtgtggtccgattcgttcgggcagcttcaggaattggacaaaatgctttggcaatacgaggccgagagtttcattccgcacgaaatttgggaaacggaagaagccatgccgtctgaaccatccgtcctgcttgcctgcggcggcaatctgccccgaattcccgaaggcatgaccgttttgaacctgtccgacggtttttggaacaccgctccggtcttgcccgcgcgcgttttggaaatcgtcggcaacagcttggaagagctcgccgacgcgcgcgaacgctttaccgcctaccgccgaagcggttttgccatcgaacatcacggcatggagggcaaggcataa

SEQ ID NO: 5625 - DNA, 1532 bp, Neisseria meningitidis
ttgtccgcgcaaggtttcagacggtgcttcaaatggggtacaatcgtgccagccgtcttcagacggtcttttgagcgaaaggccgtccgaaaactaccgacaaccgtctcaatcaggagaataaacgtggaatttagcacaaaaaccgaaatcttgcaggaacagcaggcaggcgcacagttatttgtctgcaccgaagcatcgcaactgagcaacccgaccgtccttgcccttttgtcttcgcttgaagaaggtcaaaattttgccgacacaaaaatcccgacaggcaacggtttgcaggctgttgccgtatgctgtctgaaaagcaccggccgcgccgcattgaacaaggccgccgccgaagccgccaaatgggcgcaaaatcaggaaacggtcaatgtggacgttcacgtctttgaagaagcgcaggctgcagccgttgccgaagcgtttgcgattgcgttcggcaatgccgcctaccgtttcgaccgctacaaaaaagaagccaagcccgccaaatttgaaactgccgtgttccataccgcgcacgaagccgccgtcaaagaagccttgcgcgtcgccgaagcgcaagtttacggacaaagcctctgccgcgacttgggcaacgccgcgcccaacgaatgcacgcccgaatttttagcgcgcaccgccaaagccgaagccgaaaaactgggcgcgcacgccaaaatcatcgaaaaagactacatcaaagaaaacatgggttcgttttggtcggtcgccaaaggcagcgcggaagccccctatttggtcgaactgagctatttcggtgcagccgacaaagaagccgcgcctgtggtattggtcggcaaaggcattaccttcgacaccggcggcatctccctcaagcccggcctgaacatggacgaaatgaagtttgatatgtgcggagcggcaaccgtcatcagcaccttctgcgccgccgtcaaactgcaactgccgattaacctgattgccgtcgtcgccacttgtgaaaatatgccttccggcgcggcaaacaaaccgggcgatgtcgtgaaaagtatgaaagggctgaccatcgaagtgttgaacaccgatgccgaaggccgtctgattttgtgcgacgcgctcacttacgccgagcagttcaaacccaaagccgtcatcgacgtcgccaccctgaccggcgcgtgtattgttgccttggggcacgatgtcagcggcgtgatgggcaacaatcaggatttgatcgacagcctgcttgccgcttctacaacgtggacgacaaagcatggcaactgccgctctttgagacctacaaagaccaactcaaatccaactttgccgacattccaaacatcggcacgcccggcgcgggcacgattaccgccgcaacattcctatcctactttaccgaagactatccatgggcacaccttgacatcgcgggtacggcgtggaaatccggtgcggaaaaaggtgcgaccggccgtcccgttcccttgctgctgaactatctgcggaatctttaa

SEQ ID NO: 5626 - DNA, 1116 bp, Neisseria meningitidis; identical to SEQ ID NO: 499

SEQ ID NO: 5627 - DNA, 1071 bp, Neisseria meningitidis
atgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactgattcccctcgccgtccttatcggcggactggtctccctcagccagcttgccgccggcagcgaactgaccgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgccgccatcaacggcaaaatcagcaccggcaataccggcctttggctgaaagaaaaaaacagcattatcaatgtgcgcgaaatgttgcccgaccatacgcttttgggcatcaaaatttgggcgcgcaacgataaaaacgaattggcagaggcagtggaagccgattccgccgttttgaacagcgacggcagttggcagttgaaaaacatccgccgcagcacgcttggcgaagacaaagtcgaggtctctattgcggctgaagaaaactggccgatttccgtcaaacgcaacctgatggacgtattgctcgtcaaacccgaccaaatgtccgtcggcgaactgaccacctacatccgccacctccaaaacaacagccaaaacacccgaatctacgccatcgcatggtggcgcaaattggtttaccccgccgcagcctgggtgatggcgctcgtcgcctttgcctttaccccgcaaaccacccgccacggcaatatgggcttaaaactcttcggcggcatctgtctcggattgctgttccaccttgccggacggctcttcgggtttaccagccaactctacggcatcccgcccttcctcgccggcgcactacctaccatagccttcgccttgctcgccgtttggctgatacgcaaacaggaaaaacgttga

SEQ ID NO: 5628 - DNA, 2586 bp, Neisseria meningitidis
atgttagaagcctatcgtaaagccgccgccgagcgcgccgccctcggcattcccgccctccctttgaacgcgcagcaaaccgccgatttggttgagctgctgaaaagcccgcccgcaggcgaaggcgagttcttggtcgaactgcttgcccaccgtgttccgcccggtgtggacgatgccgccaaagtcaaagcctcattcctggctgccgttgccgaaggcagcgcgtccagcccgctgatctcccccgaatatgcgaccgaactcttaggtacaatgctcggcggttacaatattcacgccttaatcgaactcttggacgacgacaaactcgcgtccattgctgccaaaggcttgaaacatacgcttctgatgttcgattccttccacgacgttcaagaaaaagccgaaaaaggcaacaaatacgcgcaagaagttttgcaatcttgggcagatgccgaatggttcgcctcacgcgccaaagttcccgaaaaaatcaccgttaccgttttcaaagttgacggcgaaaccaatacagacgacctctcccccgcgcccgacgcgtggagtcgtcccgatattccgctgcacgcgctggccatgctgaaaaacccgcgcgacggcatcacgcccgacaaaccgggcgaagtcggtccgattaaattgttggaagaactcaaagccaaaggccatccggttgcttacgtcggcgacgtggtcggtactggttcttcacgcaaatccgcgaccaactccgtcatttggcataccggcgaagacattccgttcgtgccgaacaaacgcttcggcggcgtatgtttgggcggcaaaatcgcgccgattttcttcaatacccaagaagattccggcgcgctgccgattgaagtcgatgtatctgctctaaaaatgggcgatgtcgtcgatatcctgccttatgaaggcaaaatcgtgaaaaacggcgagactgttgccgagtttgaattgaaatcacaagtattgctggacgaagtgcaagccggcggccgtatcaacctgattatcggccgaggtctgaccgccaaagcgcgcgaagccctgaaactgcctgcctctactgcattccgcctgccgcaagcgcctgccgaaagcaaagccggtttcaccttggcgcaaaaaatggtcggccgcgcctgcggtctgcccgaaggacaaggcgtgcgcccgggtacttactgcgaaccgcgtatgacgacggtcggctcgcaagacacgaccggcccgatgacccgcgacgagttgaaagacttggcttgtttgggcttctccgccgatatggtgatgcagtctttctgccacaccgccgcctatccgaaacctgtcgatgtaaaaacccataaagaactgcccgcctttatttccacccgtggcggcgtgtcactgcgtccgggcgacggcgtcatccactcgtggctcaaccgcctgctgctgcccgataccgtcggcaccggcggcgacagccatacccgtttccccatcggtatttccttccccgccggctccggcttggttgcctttgccgccgcaacgggcgtaatgccgctcgatatgcccgagtctgtattggtacgcttcagcggcaagctgcaaccgggcgtaaccctgcgcgatttggtgaacgccatcccgctgtacgcaatcaaacaaggtttgctgaccgttgccaaagccggtaagaaaaacatcttctccggccgcatcctcgaaatcgaaggcctgcctgatttgaaagtggaacaagcctttgaattgaccgacgcatccgccgaacgctccgccgccggctgtaccgtgaagctcaacaaagagccgattatcgagtacatgaaatccaacgtcgtgttgatgaaaaacatgattgccaacggctatcaagacccgcgcactttggaacgccgcatcaaagctatggaaaaatggctggcaaatcccgagttgctcgaagcggataaagatgccgaatacgccgccgtgattgaaatcaacatggacgacatcaaagagccgattatcgcctgcccgaacgacccggacgacgtgtgcttcatgtccgaacgctccggcaccaaaatcgacgaagtattcatcggttcgtgtatgaccaacatcggccacttccgcgccgcctccaaacttttggaaggcaaggcagacacccccgtccgcctgtggattgcgccgccgaccaaaatggacgcgaaacaattgtccgacgaaggacactacggcgtactcggacgtgccggcgcgcgtatggaaatgccgggttgctccttatgtatgggtaatcaggcgcaagtacgcgaaggtgcgaccgttatgtccacctccacccgcaacttcccgaaccgtttgggtaaaaacacctttgtttacctcggttcggcggaattggcagcgatttgctccaaactgggtaaaatcccgaccgttgaagaatatcaagccaatatcggcatcatcaacgaacagggcgataaaatctaccgctatatgaacttcaacgaaatcgacagctacaacgaagtagccgagaccgtgaacgtttaa

SEQ ID NO: 5629 - DNA, 996 bp, Neisseria meningitidis
gtgaacctgaaaaaccgccattttctgaaacttttagacttcacgccggaagaaatcaccgcctacctcgaccttgccgccgaattgaaagccgccaaaaaagcagggcgcgagattcagcggatgaaagggaaaaacatcgccctgatttttgaaaaaacctctactcggacgcgctgcgcgtttgaagtcgccgcgcgcgatcaaggcgcgggagtgacttatttagagccgtccgccagccaaatcgggcataaggaaagcatcaaagacaccgcccgcgtgttgggcaggatgtacgatgccatcgaatatcgcggtttcggtcaggaagttgttgaagaattggcgaaatacgcgggcgtacccgtgttcaacgggctgaccaacgagttccatcccacacaaatgcttgccgacgcactgactatgcgcgaacacagcggcaaacctttgaaccaaaccgcgtttgcctacgtcggcgacgcgcgttacaacatgggcaattccctgctgattttaggggcaaaattggggatggacgtgcgtatcggcgcaccgcaaagcctgtggccgtctgaaggcattattgccgccgcacacgccgccgccaaagaaaccggcgcaaaaattaccctgaccgaaaacgcgcatgaagccgtgaagaatgttgattttattcataccgatgtgtgggtcagcatgggcgagccgaaagaagtctggcaggaacgcatcgatttgctgaaagattaccgcgttacgcccgaactgatggcggcatcgggcaatccgcaagtcaaattcatgcactgcctgcccgccttccacaaccgcgaaaccaaagtcggcgaatggatttacgaaaccttcgggctgaacggtgtggaagttacagaagaaatattcgaaagccccgccagcatcgtgttcgatcaggcggaaaaccgtatgcacacgattaaagcggtaatggtcgcggctctgggcgactga

SEQ ID NO: 5630 - DNA, 1014 bp, Neisseria meningitidis
atgcaagtctattacgataaagatgccgatctgtccctaatcaaaggcaaaaccgttgccatcatcggttacggttcgcaaggtcatgcccatgccgccaacctgaaagattcgggtgtaaacgtggtgattggtctgcgccaaggttcttcttggaaaaaagccgaagcagccggtcatgtcgtcaaaaccgttgctgaagcgaccaaagaagccgatgtcgttatgctgctgctgcctgacgaaaccatgcctgccgtctatcacgccgaagttacagccaatttgaaagaaggcgcaacgctggcatttgcacacggcttcaacgtgcactacaaccaaatcgttccgcgtgccgacttggacgtgattatggttgcccccaaaggtccgggccataccgtacgcagtgaatacaaacgcggcggcggcgtgccttctctgattgccgtttaccaagacaattccggcaaagccaaagacatcgccctgtcttatgcggctgccaacggcggcaccaaaggcggtgtgattgaaaccactttccgcgaagaaaccgaaaccgatctgttcggcgaacaagccgtattgtgcggcggcgtggtcgagttgatcaaggcgggttttgaaaccctgaccgaagccggttacgcgcctgaaatggcttacttcgaatgtctgcacgaaatgaaactgatcgttgacctgattttcgaaggcggtattgccaatatgaactactccatttccaacaatgcggagtacggcgaatacgttaccggccctgaagtggtcaatgcttccagcaaagaagccatgcgcaatgccctgaaacgcattcaaaccggcgaatacgcaaaaatgtttatccaagagggtaatgtcaactatgcgtctatgactgcccgccgccgtctgaatgccgaccaccaagttgaaaaagtcggcgcacaactgcgtgccatgatgccttggattactgccaacaaattggttgaccaagacaaaaactga

SEQ ID NO: 5631 - DNA, 294 bp, Neisseria meningitidis
atgtcgaacattaaaattgtcgcactggttaccgtcaaaccggaatacacagaaacactggcagcacagtttaaagaactggtcaaagccagccgtgcagaagagggcaacatcagctacgatctccatcaggaaatcggcaaaccgaaccgttttgttttcgtggaaaattggaaatctcaagcagctattgacgaacataacgccagcgcgcatttccaagccttcgtccagtccgtcgacggcaaaaccgaagcgttggaaatcgtattgatgaatgaagttgccgattaa

SEQ ID NO: 5632 - DNA, 492 bp, Neisseria meningitidis
atgcgacatatcttatctgttctgattgaaaacgaatcaggtgcgatgagccgcgtggtcggtttgttctctgcacgcgattacaatatcgattctttggcggttgcgccgaccgaagacaaaaccctgtcacggatgaccatcgttacccacggcgacgagcaggtcatcgaacaaattaccaagcaactcaataaattgattgaagtgattaaagtggtcgatttgaatgaaagccgttttgtcgaacgcgaactgatgttggtaaaagtccgtgccgccggcaaagaccgcgacgaatttttacgcttgaccgaaatctaccggggcagcatcatcgacgtaaccgaccgcagctatacgattgaaattaccggctcgacagacaagctggattcctttttggaaacggtcggacgcgcccaaattttggaaaccgtacgcacaggcgcggccggcatcggtcgcggtgagcgtattttgaaaatttaa

SEQ ID NO: 5633 - DNA, 1728 bp, Neisseria meningitidis
atgcagttatcaggcgcgcaaatcatagtgcagagtctcaaagccgaaggtgtcgagtacgttttcggttatcccggcggtgcggttatcgaaatctacgatgcccttttccaactcaataaattcaaacacattcttacccgccatgagcaggcggcagtacacgcggcagatgcgtatgcgcgcgtcagcggtaaggtgggcgtggcattggttacatccggcccgggcgttaccaatgcactgaccggtattgctactgcctatacggattcgattccgatggtggtcatcagcgggcaggtaggcaattccctgattggtacggatgcgttccaagaagttgatacggtgggtattacccgtccgtgcgtcaaacacaatttcctggttacggacatcaatgagttggcggaaaccattaaaaaggcgttccaaattgccgcaagcggccgaccggggcccgtggtggttgatgtcccgaaagatgttacgcaggcgatggcgaaattcagctatcctcaggaagacatttttatccgttcgtatcaaccggttgttcaaggacatatcggtcagattaaaaaggccgtgcagatgttggcatctgccaaacgtccggtcgtctattttggcggcggcgtggtgttgggtaatgcttctgaagagctgacccgatttgtccgaatgacgggtgctccgtgcacgggtacgctgatgggcttgggcgcttatccttccggcgaccgccaattcctcggtatgctcggtatgcacggtacttacgaggcaaaccttgccatgcagaatgcggatgtcgttcttgccgtaggtgcgcgttttgacgaccgtgtggtttccgtaccgtccaaatttttcgagaaggcgaagaaggttatccatatcgatgtcgatccttccagcatcgccaaacgcgtgaaggtggacattccgattgtcggcgacgtgaaaaacgttttgtccgagatggttgcgctgtggcaaaaacaagagtccgtgccgtctgaagatgctttgggcaaatggtggaaaaccatagaggaatggcgttcccgagattgcttgtggtttgacaacggcagcgaaattatcaagccacaatatgtgattcagaagcttgccgagattaccggcaattcggcaatcatcacatcggatgtagggcagcatcaaatgtttgcggctcaatattatcccttcgaacgtccgcgccaatggctcaattccggcggtttgggtacgatgggcgtgggtctgccttatgcgattggtgcaaaacttgccgccccggatcaagacgtattctgtatcaccggcgacggctcgatccagatgaacatccaagagctgtccacctgtttccaatatcggattccggttaacgtcattacgctgaacaacggttatctcggtatggtacgccagtggcaggaaatatattacggcggacgagagtcggaaacctatttcgattctttgcccgatttcgtcaaacttgccgaggcatacggccatatcggtatccgcgtggacaagaagtctgatgtggaaggtgcgttgttggaagcattgaaccaaaaagacaggctggtgtttatcgacttcctgaccgaccagaaacagaatgtgatgcccatggtcggcaacggcaaaggtttggacgaaatggtacttccgccgcatatgcgtgcggacggaaaggcgtaa

SEQ ID NO: 5634 - DNA, 654 bp, Neisseria meningitidis
atgttttccgtaccgcgttcctttttgccgggcgttttcgtacttgccgcgcttgccgcctgcaaacctcaagacaacagtgcggcgcaagtcgcttcttcaagtgcatccgcgtcggctgcggaaaatgcggcaaagccgcaaacgcgcggtacggatatgcgtaaggaagacatcggcggcgatttcacgctgaccgacggcgaaggcaagcctttcaacctgagcgatttgaaaggcaaggtcgtgattctgtctttcggctttacgcactgtcccgatgtctgcccgacagagcttttgacgtacagcgacacgttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcggccaaaacctgccggtcatcaagcagcaataccgcgtggtttctgccaaagtcaatcaaaaagacgacagcgaaaactatttggtcgaccactcttccggtgcgtatctcatcgacaaaaacggtgaggttgccattttctcgccttacggaagcgagccggaaacgattgctgccgatgtaaggaccctgctctga

SEQ ID NO: 5635 - DNA, 654 bp, Neisseria meningitidis
atgcaggataatgctttgaccatcgccttatccaaggggcgcatttttgaggagacgctgccgctgcttgccgctgccggcattgttccgactgaagagcctgaaaaatcgcgcaagctgattatcgggacgaaccatgaaaacatccgccttgtcattgtccgcgcaaccgatgtgccgacttatgtccgctacggcgcggcggacttcggcattgcgggcaaagacgtgctgatcgaacacggcggcacggggctttaccggcctttggatttggagattgccaagtgccgcatgatggttgctgtgcgtaaagggtttgattacgaagcagcttcgcaacccggatgccgtctgaagattgccacaaagtatcctgaaatcgcggcatctcattttgccggcaagggtgtccatgtggacattatcaaactgtacggctcgatggaacttgcgccgctggtcggcttgagcgatgcgattgtggacttggtttcgacgggcaacaccttgaaggcaaacggcttggaagcagtcgaacacatcgtcgacatttccagccgcctggtggtcaacaaggctgctttgaaaacgaaatacgcgctgctggagccgattattcaggcgttcggcggcgcagtgaaggcgaagtaa

SEQ ID NO: 5636 - DNA, 900 bp, Neisseria meningitidis
atggttgcaaaaataaaaaaattctcagattcaaccctttccgttttgaataacggcgagcgtcggttttatgtctattgtctgaccgacctgaaaaaagacaaaatcctctacatcggcaaaggctgcggtaatcgtatcttcgagcatgaatgggttgctagtcgttcacaagatccagtctccggcgagattatcgatcggaaactcaaagccatctccaaatgcaagaaactcggtcgctatatcatcagctatcatctgactgaagtcgaagcactcgccgccgaatctgccttaattcattttgttaaatctgtcttgggtaaaaaactcaaaaataaaattgccgggcatggtccgggtggtattagcgtagaagaactagatcgccgctttggattctcttctctcccacttaacgagattaaccccgacgggctgattctcgccatcaaaatccacaatgctttcgatttagatactgacgaagaattagactaccttttcgacaaccaagacgatgccaacctcaaatcgcgtacgttgggcaactgggttatcggtaaagatgttgcttcaaaagtgaaatacgttatcggcgttcacaccggtctgcaaaacgctgttgtcagtgcatacgaagtggacggttttgaaacaatggttgaggaaaccaaaaacggtagaaaacaatcccgttaccgtttccgcactacctctcgtagcgaagaggtattagccaaactcggtctgcaacaaaaatgcctgcccgaattgaagtttggtagcgggggagaaaaagcgtatatcagacccaaaacagagacagaaactgaacaagagaatattcagacgacccccaatccaaaaataaaaaaggaaaaaaccaaatcatga

SEQ ID NO: 5637 - DNA, 1290 bp, Neisseria meningitidis
atgaaaaaactcaacacccaatcgcccgatttccaagccggactcaaagccctgctggcttttgaaaccgcgcaaaaccccgaaaccgaacgcatcgtcgccgacatttgcgccgacgtgcaaaagcgcggcgatgcggctttgattgaatacaccaacaaattcgatcagacaaacgctaaaagcatcgatgatttaatactcacgcaagccgatttgaacgcggcgttcgagcgcattccgaacgacgttcagacggcattgcagaccgccgcccgccgtgtcgaaagctaccaccaacgccaaaaaatggaatcgtggagctacaccgatgaagacggcacgctgttgggacaacaaatcacaccgcttgaccgcgtcggcatttacgtccccggcggcaaggcggcgtatccgagttccgtcatcatgaacgccatgcccgcccacgtcgcaggtgtgaaagaaatcatcatggtcgtgccgacaccaaaaggcgaacgcaacgacatcgtacttgccgccgcatacgtcgccggcgtaaccaaagtcttcaccgtcggcggcgcgcaggcggttgccgccctcgcctacggcacggaaaccatcccccaagtcgataaaatcaccggtccgggcaacgccttcgtcgccgccgccaaacgccgcgtgttcggcgtggtcggcatcgacatggtggcggggccgtctgaaatcctggtcatcgccgacggcacgacacctgccgattgggtggcgatggatttgttcagccaggccgaacacgacgaaattgcccaagccatcctcatcggcacgtcgcaagcgtatctcgacgaagtagaagccgctatggaccgcctgatcgaaactatgccgcgccgcgacatcatcgaagcctcgctcggcaacaggggcgcgatgatactcgccaaagacttggacgaagcctgcgaaatcgccaactacatttcccccgaacacttggaactgtcagtcgaaaacccgcaggaatgggcgaaaaaaatccgccacgccggtgcgattttcatgggacgctacaccggcgaaagcctcggcgactactgcgccggtccaaaccatgtgttgcccaccagccgaaccgcccgcttttcctcgcctttggggacatatgatttccaaaaacgctccagcctgattcaggtttcggaacagggcgcgcaaaaattaggcgaaaccgccagcgtgctggcacacggcgaaagcctgaccgcccacgcccgcgcggcagagttccgtatgaaataa

SEQ ID NO: 5638 - DNA, 1098 bp, Neisseria meningitidis
atgaaatccgtccgctccttcatccgcgacgacatacaagctatgtcggcatatcagattgccgacgttccgcccggctttgccaaactcgattcgatggaaagtcccgtccacccttttgccggacatgaaacgctgttgcaggaatggcaggcacggcttgccgccgcgcccatccatctttaccccaatccctccggcagcggtttacaggaagcattacgttcggcgttcgacattcccgactgcgccgacatcgcgctgggcaacggttcggacgaactgatacagttcatcacgatgctgaccgccaaaccgggcgcggcaatgttggcagccgaacccagtttcgtcatgtaccgccacaacgccgcgctgtacggcatggattatgtcggcgttccactgaacggagatttcaccctcaacctgcccgccgtcctcgaagccgtcaggaaacaccgccctgccctgacctttatcgcctaccccaacaaccccaccggcgtatgcttcacgcgtgccgaaatcgaagccgtcatcgaagcttcagacggcatcgtcgtcgtcgatgaagcctacggcgcattcaacggcgacagcttcctgccgcaggcaggcaggattcccaacctgatagtcttacgcaccctcagcaaaatcggttttgccggactgcgtatcggttatgcggcaggctgccccgaagtcatcggcgaactgcaaaaaatcctgccgccctacaatatgaaccaattgagcctgaccactgccaaactcgccctgcggcactacggcattatctctgccaacatcgacagcctgaaaaacgaacgcgaacggatgttcgccgaattgggcaaaatatgccgtctgaacaccttttcaagtcaggcaaacttcattaccatacgcgtacccgatgccgatttgttgtttgacacgctcaaacaaaaccgcatcttggttaaaaaactgcatggcgcgcacccgcttttggaacactgcctgcgcattaccgtaggcagccccgcacaaaacgatgccgttctcaacatcattcgccaactttactgccaaccaacggatttcctatga

SEQ ID NO: 5639 - DNA, 918 bp, Neisseria meningitidis
atgaatttgactaaaacacaacgccaactgcacaactttctgaccctcgcccaagaagcaggttcgctgtccaagctcgccaaactctgcggctaccgtacccccgtcgcactctacaaactcaaacaacgccttgaaaagcaggcagaagacccagatgcacgcggcatccgtcccagcctgatggcaaaactcgaaaaacacaccggcaaacccaaaggctggctcgacagaaaacaccgcgaacgcactgtccccgaaaccgccgcagaaagcaccggaactgccgaaacccaaattgccgaaaccgcatctgctgccggctgccgcagcgttaccgtcaaccgcaatacctgcgaaacccaaatcaccgtctccatcaacctcgacggcagcggcaaaagcaggctggataccggcgtacccttcctcgaacacatgatcgatcaaatcgcccgccacggcatgattgacatcgacatcagctgcaaaggcgacctgcacatcgacgaccaccacaccgccgaagacatcggcatcacactcggacaagcaatccggcaggcactcggcgacaaaaaaggcatccgccgttacggacattcctacgtcccgctcgacgaagccctcagccgcgtcgtcatcgacctttccggccgccccggactcgtgtacaacatcgaatttacccgcgcactaatcggacgtttcgatgtcgatttgtttgaagaatttttccacggcatcgtcaaccacagtatgatgaccctgcacatcgacaacctcagcggcaaaaacgcccaccatcaggcggaaaccgtattcaaagccttcgggcgcgccctgcgtatggcagtcgaacacgacccgcgcatggcaggacagaccccctcgaccaaaggcacgctgaccgcataa

SEQ ID NO: 5640 - DNA, 870 bp, Neisseria meningitidis
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaagcgatgctgatggcgcggcagttcggcatcgataccgacaccatcgtcgaagccatcggcggctcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactga

SEQ ID NO: 5641 - DNA, 432 bp, Neisseria meningitidis
atgaaccaactcgaccaacttggcacccgtatcaacctgatttgcaatgtcttcgacaaatggatcgggcagcaggatctgaattacaacctctttgccgtactttataccctggcaaccgaaggcagccgcacgcaaaagcatatcggcgaaaagtggagcctgcccaaacagaccgtttcaggcgtatgcaaaacccttgccggacaagggttgattgaatggcaggaaggcgaacaggaccggcgcaaacggttgctgtcgttgaccgaaacaggcaaagcctatgccgcacctttaacagaaagcgcgcaggaattcagcgacaaagtatttgccacattcggcgacaagcgcacaactcggctgtttgccgatttggatgcactggctgaagtgatggaaaaaacaatctcggaaaataaaaaatag

SEQ ID NO: 5642 - DNA, 867 bp, Neisseria meningitidis; identical to SEQ ID NO: 1015

SEQ ID NO: 5643 - DNA, 1104 bp, Neisseria meningitidis
gtgatggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacggatttttcggaaaattataaaaaacagcggcaatcgtttgaagcattctttttaagcggggaagaggcaaaacatcaggaaaaagaggaaaagaaaaaggaaaaggcggaagccaaagcagagaaaaagcgtttgaaggagggtggggagaaatctgccgaaacgcaaaaatcccgcctttttgtgttggattttgacggcgatttgtatgcacacgccgtagaatccttgcgtcatgagattacggcggtgcttttgattgccaagcctgaagatgaggttctgctcagattggaaagtccgggcggcgtggttcacggttacggtttggcggcttcgcagcttaggcgtttgcgcgaacgcaatattccgctgaccgtcgccgtcgataaggtggcggcgagcggcggttatatgatggcgtgtgtggcggataaaattgcttccgctccgtttgcgattgtcggttcggtgggtgtggtggcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 5644 - DNA, 564 bp, Neisseria meningitidis
atgccttggaatctccccatcttcctcacatggttgagggtcttgctcattcctgtcctgacagcccttttttacctgccttttccgtggttcgcggaggaaacgattaatctcaccgccgccgtcatttttgccgttgccgccttgaccgactggtttgacggatttttggcaaggttgtggaaacagacctcggatttcggcgccttcctcgatcccgttgccgacaagctgatggtcgccgtctctttgcttttactggtcaaactcgaccggacctatgttttgtttgccatgatcatcatcggcagggaaattaccatttccgcattgcgcgaatggatggcgcaaatgggcaaaaggaacagcgttgccgtcgccaccgtcggtaagtttaaaaccgccgcgcaaatgctggcaatcttcctgctgctgctgaattttcccgatttttatggatttaacctcgcattcatcggcaatgtattgatgtttatcgcatctttgctgacagtctggtcgatgctgtattatctgaaaatggcgtggaaagaaatcgcctga

SEQ ID NO: 5645 - DNA, 243 bp, Neisseria meningitidis
atggtttgccgccataagctgtctgctgttgtccgccgtttttattgcaccttacctgacggcatttcacgaacaagaaaaaacattcgaatatgcggaattgaccgttaccgccctcaaccgcagcggacgggcaatcaaactggatgcagacgggcagcattaccggctttcctgctatgggttcgacagtttgtgcacaggcggcaatatcggcagaaccatcagggcggagcaggttag

SEQ ID NO: 5646 - DNA, 336 bp, Neisseria meningitidis
atgtttaaagattggaaagaacataccgcattggttaaaaaatcgttcggcgagctgggtaaggcgcatcctaaaatgctgcaggcctacggcgcattggaacaagcggcagctgcagaggcacttgatgctaaaacacgcgaactgattgccatcgccgttgccattactacacgttgtgagagctgcatcagtgttcacgccgccgccgccaccaaagccggtgcgaccgacagcgaaatcgcaggtgcattggcaaccgccattgccctgaatgcgggtgccgcttacacttatgccctgcgtgcattggaagcggttgaaacgcaaaaataa

SEQ ID NO: 5647 - DNA, 906 bp, Neisseria meningitidis; identical to SEQ ID NO: 1645

SEQ ID NO: 5648 - DNA, 489 bp, Neisseria meningitidis; identical to SEQ ID NO: 3791

SEQ ID NO: 5649 - DNA, 864 bp, Neisseria meningitidis
atgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacaccttccgcacgccccattggaaaaaccacttaaaccgcagtatggtcgggacgggggcgatgctgctgctgttttacgcggtaacgcatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttgagcagcatccgccccactgccttcaaacagcggctgcaatccctgttccgccaaagataa

SEQ ID NO: 5650 - DNA, 1131 bp, Neisseria meningitidis; identical to SEQ ID NO: 3767

SEQ ID NO: 5651 - DNA, 2625 bp, Neisseria meningitidis
atgaaaacctccgaactgcgccaaaaattcctaaaattttttgaaaccaaaggccacaccgtcgtccgctcttccagcctcgtgccgcacgacgacccgaccctgctgtttaccaacgcgggcatgaaccagtttaaagacgtattcttaggtttcgacaaacgcccgtacagccgcgccaccaccgcgcaaaaatgcgtacgcgcaggcggcaaacacaacgacttggaaaacgtcggctacaccgcccgccaccacaccttctttgaaatgatgggcaacttctccttcggcgactacttcaaacgcgacgccatccacttcgcttgggaatttctgacttcccccgaatggctcaacatccctaaagacaaactgttggcgaccgtttacgcggaagacgacgaagcctacaacatctggttgaacgaaatcggtatgccgtccgagcgcatcgtccgcatcggcgacaacaaaggcgcgaaatacgcatccgacaacttctggcaaatgggcgacaccggcccttgcggcccctgctccgaaattttctacgaccacggcgaagaaatctggggcggcattcccggcagtcccgaagaagacggcgaccgctggatcgaaatttggaactgcgtatttatgcagttcaaccgcgacgaacaaggcaatatgaacccgcttcccaaaccttccgtcgataccggtatgggcttggaacgcatagccgccgtcatgcagcatgttcacagcaactacgaaatcgacttgttccaagacctgctcaaagccgttgcccgcgaaaccggcgcgccgttcagaatggaagaacccagcctgaaagtcatcgccgaccacatccgctcctgctcgttcctgattgcagacggcgtcttgccttccaacgaaggccgcggctacgtattgcgccgcattatccgccgcgccgtgcgccacggttacaaactgggtcaaagcaaaccgttcttccacaaactcgttgccgatttggtcaaagagatgggcggtgcctaccctgaattgaaagaaaaacaagcccaaatcgaagaagcattgaaaaacgaagaaagccgttttgcccaaacgctggaaaccggtatggctttgttggaaaacgcgctggtcaaaggcggcaaaacactcggcggcgaaatcatcttcaaactctacgatacctacggtttcccatacgacttgactgccgacatctgccgcgaacgcaatatcgaaccggacgaagcaggcttcgagcgcgaaatggaagcccaacgcgcacgcgcacgcgccgcccaaagcttcaaagccaacgcccaactgccttatgacggtcaagacaccgagtttaaaggttatagcgaacgccaaaccgaatccaaagtcctcgccctctacaaagacggcgagcaagtcaacgaattgaacgaaggcgacagcggcgcagtcgtcatcgactttaccccgttctatgcagaatccggcggccaagtcggcgatgtcggctatatcttctcaggcgaaaaccgctttgaagtacgcgatacccaaaaaatcaaagcggccgtattcggtcaattcggcgtacaaacttcaggccgtctgaaagtcggcgacagcgttaccgccaaagtggacgacgaaatccgcaatgccaatatgcgcaaccacagcgcaacccacttgatgcacaaagccctgcgcgatgtattgggcagacacgtcgaacaaaaaggctctttggttaccgccgaatccacccgtttcgacatttcccatccccaagcggtaactgccgaagaaattgccgaagtagaacgccgcgtcaacgaagccattttggcgaacgttgccgtcaatgcagccattatgagcatggaagacgcgcaaaaaaccggcgcgatgatgctcttcggcgaaaaatacggcgaagaagtgcgcgtactgcaaatgggcggtttctctaccgaattgtgcggcggcacacacgtttcacgcaccggcgacatcggcctcttcaaaatcatcagcgaaggcggtattgccgcaggcgtgcgccgtatcgaagccatcaccggcctgaacgcactcaaatgggcgcaagagcaagagcgtttggtgaaagacattattgccgaaaccaaagcccaaaccgaaaaagacgtactggcaaaaatccaagcaggcgcggcacacgccaaagcattggaaaaagaattggcacgcgccaaagccgaactcgccgtccacgcaggcgccaaactcttggacgatgcaaaagacttgggcgcagccaaactcgttgccgcccaaatcgaagccgacgcagccgccctgcgcgaaatcgttaccgatttaaccggtaaatccgacaacgccgtgattcttttagcggcagtaaacgacggcaaagtctccctgtgcgccggcgtatccaaaccgttgaccggcaaagtgaaagcaggcgatctggttaaatttgcagccgaacaagtcggcggcaaaggcggcggcagaccagatttggcgcaagccggcggcacggatgccgacaaattgcccgccgtgttggatagcgtgaaagactgggtcggcgcgaagctggtttga

SEQ ID NO: 5652 - DNA, 207 bp, Neisseria meningitidis
gtgcaaagaggccgtctgaaaggtctcgtttgccgtaggttgggtcgcgacccaacaaattttgtgaagtataaaaatgttggtcatgacccaacctacctgcctttttgtacaaagaggctatctgaaaggccttgtttgccgtatggtgggtcgcgacccagcagatttttattagggtatgacccaagctacttgctacgataa

SEQ ID NO: 5653 - DNA, 432 bp, Neisseria meningitidis
atgagcattagccttattggactacacattaccatagcaatcattttgttttttactacaaattttatgggaaaaaaatcatctatatttggctattaccaactgtcttttagcgaagaaaatcactctccggcatttaatattttttacagagcatttacccctatattatttatcgttattttttcttgggttgttactagtcttgaaattcccatttctcttgaaaagataaactatgtagtaatttattattttataattagattgttatctgtatttgtttttgagaaaacacacatagttaactggtttaatcaactaacaatacccatactatccataacattatcatttatagtatataacaaaatgattttgcccaaaagttttctacttccatcctcacaagaagtagctactactttttga

SEQ ID NO: 5654 - DNA, 192 bp, Neisseria meningitidis
atgcacaaaaaatttgaaagttattttggtaaaattatagataaaataatcaaagaggatagttataataatgatgattttttaaccgataagaaaaaagcactaatatattcagttttaatttatgagaattttaataggggactagtttatagatattttgaaaaaaattattttgtactggtagaataa

SEQ ID NO: 5655 - DNA, 288 bp, Neisseria meningitidis
atgcaagtaacctcagcagagtacctttccaatgaggaaagtataaaaaaaggcggaaatattcttatggaaaaatacaatgaaaaatataatgaatctattgatggcaataaaactctctataaatcatattatgaatcaagaagagagagtattaaaaactacaacccagatgcaaaatacattaatgaaattgaatcaatttacatgatgcttggagaaatctatccaaatgcaccagacttcatgtcaccacattttgagggggactgctctgagggggaataa

SEQ ID NO: 5656 - DNA, 258 bp, Neisseria meningitidis
ttgtcgggcataaatgcccgacctacaaattcaattttttcaaacctctgccaaatattttcatctttgcaaggctgtctgaaaacccaaaccccattttcagacggccttttttcgctaaaatccccataccgttcaatccgaaaacacaggagaatcatcatggaagttaccatctccgccatcatcaatggcgaatttgccgaccaatacggcaagcgcggtagtcagtttaatgaaaacgggatgctgatttaa

SEQ ID NO: 5657 - DNA, 1008 bp, Neisseria meningitidis
atgagcaccttctttcaacaaaccgcccaagccatgattgccaaacacatcgaccgcttcccgctattgaagttggaccgggtgattgattggcagctgatcgaacaatacctgaaccgtcaaaaaacccgttaccttagagaccaccgcggccgtcctgcctatcccctgctgtccatgttcaaagccgtcctgctcggacaatggcacagcctctccgatcccgaactcgaacacagcctcattacccgcatcgatttcaacctgttttgccgttttgacgaactgagcatccccgattacagcaccttatgccgctaccgcaaccggctggcgcaagacaataccctgtctgaactgttggaactgattaaccgccaactgaccgaaaaaggtttaaaaatagagaaagcatccgctgccgtcgttgacgccaccattattcagaccgccggcagcaaacagcgtcaggccatagaagttgacgaagaaggacaaatcagcggtcaaaccacaccgagtaaggacagcgatgcccgttggataaagaaaaacggcctctacaaactcggttacaaacaacatacccgtaccgatgcagaaggctatatcgagaaactgcacattacccccgccaatgcccatgagtgcaaacacctgtcgccgttgttggaaggtctgcccaaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttgtcgaagacccgttatgtggtcgaacaaagcttcggtacgctgcaccgtaaattccgctatgcccgggcagcctatttcggactgattaaagtgagtgcgcaaagccatctgaaggcgatgtgtttgaacctgttgaaagccgccaacaggctaagtgcgcccgctgccgcctaa

SEQ ID NO: 5658 - DNA, 1119 bp, Neisseria meningitidis
ttgttaattcactatatcgacatcgccaaacgaaacttcgtcatcgccgtttcgtctttgtctaaaaccaaaaccgaaaccaacaaccccaaaggtatcgcccatactatcgaataccttaaaaaacacaaggtcgccctcgtcgtgacggaaagtaccggaggtctcgaaatccccgccgccaaagccatccaccgagcaggcatagccgtgattatcgccaacccgcgtcagacgcatcagtttgcccaatcgcagtcgctgaccaaaaccgacgccaaagatgccaaaatgcctgccttcttcgcacagatgaaggcacagaaagaagattggcaaaccatgccctaccacccgcccacagaagcggaagaagtgttggaagccttggttaaccgccgcaaccaatcggcggatatgcggactgccgagaaaaaccgtctgcatcaggttcacgaaacgcaagtcggaagcgtcaaacaactgattgcccattttgaccggctgattgacgaatcggacaaacaaatcgacgaccacacccacacgcattttgacggcaaagcccaagtggcggagcaaatcaaaggcatcggttcgataacgacggctacgctgatggcgatgctacctgaattggggcggctgtcgcacaaacggatagcgagtttggtcggcattgccccgcacccgaggaagagcggggaagccaaattcaaaagccgctgctttggcggaaggtctgcggtgcttaaggcactgtatatggctaccgtggcagcgacacgttttgaaccgcttattcgggatttccaccaacgcccgctgtccgagggtaagccgtataaggttgccgttacggcatgtatgcgcaaactgctggagacctttgcaaaattcctttccctcacgacaaccgaaatcccaacacaggttttcggctgttttcgccccaaataccgcctaattttacccaaacacccccttaatcctccccggacacccgataatcaggcatccgggctgccttttaggcggcagcgggcgcacttagcctgttggcggctttcaacaggttcaaacacatcgccttcagatggctttgcgcactcactttaa

SEQ ID NO: 5659 - DNA, 945 bp, Neisseria meningitidis
atgtctgcatctaagaaatttccgattcctttgagctatttcagcatcgcgctgggcttgtttgccttggggctgtcgtggcgttacggcgcgtctgtcgggctgctgcccgccttggccgccgaatcgctgcttgcggcggcttcggtcgtctggctcttgctggtggcggcatacctgatcaaaatgtttgcgtaccgaaacgattttttgtctgatttacgcgacttggtgcaatgctgcttcatcagcgcgattccgattaccgctatgctggagggactcgcgctgaagccctatcaggcaggcgcggcggcagtcctgatttatgtcggcgttgccggacagttggctttttcgatgtatcgggcggccggtctgtggcgcggcctgcattccttggaggcgacgacgccgattatttatctgcctacggttgcgacaaactttgtcagcgcgtcatctctggcggcgttggggcatcatgattatgcagctttgtttttcggcgcgggtatgttttcctggctgagcttggaagcctccatcttgggcaggctgcgcacggcggcaccggtcggcacggcggcgcgcggcgtggtcggcatccagcttgcgcccgcctttgtcggctgcggcgcgtattttgccgtcggcggtaaagtcgacggttttgcgttggcattaatcggctacggctgcctgcagcttttgttcttgctgcgcctgacccgctggttttgggaaggtggttttacgatgagcttttggggattttcattcggtttcgcggcaatggcaggatgcggtctgcatctggcggcttccggcgtattgtcgggcttggggctgacgcttgccaccgccggatcggcaggcgtggcgctgctgcttgtcggtacgctgcaccggatagcgacggggcgtttcttggtacgcagctga

SEQ ID NO: 5660 - DNA, 684 bp, Neisseria meningitidis
atggaactggtatttatccgccacggacaaagcgaatggaacgcgaaaaacctgtttacaggctggcgcgacgtgaagctgagcgagcaggggcttgccgaggctgccgccgccggcaagaaactgaaagaaaacggctatgagttcgacatcgccttcacatccgtcctgacccgcgcgattaagacctgcaacatcgttttggaagaatccgaccaactgttcgtaccgcaaatcaaaacgtggcggctgaacgaacgccactacggccaactgcaaggcctggacaaaaaacaaaccgccgaacaatacggcgacgagcaagtccgcatctggcggcgcagctacgacaccctgccgccgcttttggacaaagacgatgagttttccgcacacaaagaccgccgctatgcccatctgcctgccgatgtcgtacccgacggcgaaaacctgaaagtaacgctggagcgcgtattgccgttttgggaagaccaaatcgcccccgcgattttgagcggcaaacgcgtcttggtggcggcgcacggcaactccctgcgcgcgctggcaaaacacatcgagggcatttccgacgaagacattatgggcttggaaatcccgaccggtcagccgttggtgtacaaattggacgacaatttgaaagtcatcgaaaaattctacctgtaa

SEQ ID NO: 5661 - DNA, 2304 bp, Neisseria meningitidis
atgaatacgcaagcgcacgccccacataccgattccaatacgctgatgctcggccgatacgccgaacgcgcctatctcgaatacgccatgagcgtggtcaaaggccgcgcgctgcctgaagtttcagacggccagaagcccgtgcagcggcgcattttgtttgccatgcgcgatatgggtttgacggcgggggcgaagccggtgaaatcggcgcgcgtggtcggcgagattttgggtaaataccacccgcacggcgacagttccgcctatgaggcgatggtgcggatggcgcaggattttaccttgcgctatcccttaatcgacggcatcggcaacttcggctcgcgcgacggcgacggggcggcggcgatgcgttacaccgaagcgcggctgacgccgattgcggaattgctgttgtccgaaatcaatcaggggacggtggattttgtgccgaactacgacggcgcgtttgacgaaccgctgcacctgcccgcccgcctgcctatggtgttgctcaacggcgcgtcaggcattgcggtgggcatggcgaccgagattccgccgcacaatttgaacgaagtgacgcaggcggcgattgcgttgttgaaaaagccgacgctggaaaccgccgacctgatgcaatatattcctgcccccgattttgccggcggcggtcaaatcatcacgccggcggacgaattgcgccggatttatgaaaccggcaagggcagcgtgcgcgtgcgtgcgcgttatgaaatcgaaaaattggcgcgcggacagtggcgcgtcatcgtaaccgagctgccgccgaacgccaattccgccaaaatccttgccgaaatcgaagagcaaaccaacccgaaaccgaaagcgggtaagaaacagctcaaccaagaccagctcaataccaaaaagctgatgctggatttaatcgaccgcgtgcgcgacgagtccgacggcgaacatcccgtgcgactggtattcgagccgaaatccagccgcatcgataccgataccttcatcaacacgctgatggcgcaaacttcgctggaaggcaatgtgtcgatgaacttggtgatgatgggtttggacaaccgccccgcgcagaaaaacctgaaaacgattttgcaggaatggctggatttccgcaccgtaaccgtaacacgccgtctgaaattccgtttgaaccaagtggaaaaacggctgcacatcctcgaaggccgtctgaaagtctttctgcacatcgacgaagtgattaaagtcatccgcgaatcagacgacccgaaagccgatttgatggcggcgttcgggctgaccgaaatccaagccgaagacattttggaaatccgcctgcgccagttggcgcgtttggagggtttcaaactcgaaaaagaattgaacgagttgcgcgaggaacaaggccgtctgaacatccttttgagcgacgaaaacgaaaaacgcaagctgattgtcaaagagatgcaggcggatatgaaacaatacggcgacgcgcgacgcacgctggtggaagaggccggacgcgccgtgctgacgcagaccaccgccgacgaacccatcacgctgatcctgtcggaaaaaggctggatacgcagccgcgccggacacaatctcgatttgagccaaaccgcgttcaaagaaggcgactgcctcaaacaaaccctcgaaggcagaacggttttacccgtcgtcatcctcgattcatcgggcagaacctacacgctcgatgccgccgaaatccccggagggcgcggcgacggcgtaccggtttcctccttaatcgagctgcaaaacggcgcgaaacccgttgcgatgttgacaggattgccggaacaacattatttattatcaagcagcagcggctatggcttcatcaccaagctgggcgatatggtcgggcgcgtgaaagcgggcaaagtggtgatgaccgcagacagcggcgaaaccgttttgccgccggttgccgtctatgcctcctcgttcatcaaccccgactgcaaaatcattgccgccaccagtcaaaaccgcgccctcgccttccccatcggcgaattgaaaattatggcgaaaggcaaagggctgcaaatcatcggattaaacgccggcgaatcgatgacgcataccgccgtttcttccgagctggaaatcctgattgaaagcgaaggcaggcgcggcgcggcgcacaaagaccgcatccccatctccctgcttgaggcaaaacgcggcaaaaaaggcagactattgcccatatcgggcagcctgaaacagctttcttcccctaaataa

SEQ ID NO: 5662 - DNA, 1518 bp, Neisseria meningitidis
atggtgatttccaacccccgcgaacttgaaaaactcaaagaccggattcccaatctgatcaacatcatccgcgtcgccatcgtttttccgctgatgattatgcacatcctcgggctggaaaccggcagccgtgcgaacctgcacgcttcgtggacggcgtgggcgttttatgtttggctcgccattgcctgctggctgattttcttttccattatccatccgcattggcaatggcagtcgctgaaaatgccgcgtttcagcgcggtagcggacatcacgatgatcggcgtgctgacctacctgttcggcggcatcgattccggcttcggcatcctgatcctgcccttcgtcgtctgctcctgcctgctcagctacgggcgctaccccctgctctattccagctacgccgccatcctgctgatattcaacgccattgccgacggcgatatcggcaaatacccgctcatatcggatgcccgaaccgcctcggcaaccttcatccttgtcgccgcctcctatctttccgccatcttcacctcactgtcggtcaaatacatcgaccgtgccggaaaactcgcctacgacagccatatcgcctaccaccgcatcaaaggcttgagccaaaccgtactcgaacgcgttcaggaagctgtcgtcgtcatcaatgccgaagggctggcggtgctgttcaaccggaaggcgaaagaccttttccccgcgctcgaaatcggacggcgcgccggtctgtccgattctgccgccgaactgtgggatcaagcctctccgcacactttcgaatacgtcctcggcacacccggcctgaacgccggcatccgcgccgttccggtcaacaaagggtcggacaagctgctcatcctctacatccgcccgcaaagcgaaattcaggcagaagccctgtccgtcaaacttgccgcgctcggacaactgaccgccaacctcgcccacgaaatccgcaacccgatgtccgccatccgccacgccaacgacctgctgcgcgaaaatatggaagcgggggcggcagatccgttcaacgccaaattgtgcaaaatcatcgacggcaacatctgccgcatcgacaaaatgctcgaagacatttcctcgctcaacaagcgcaacaaaaccgaacgcgaaaccatcggcctgataccgttttgggaagaattcaaacaagagttcctgctcggccatcccgatgccgccgactgcatccgtccggacattcaaggcggcagcccgaccgcctatttcgatcccgcccacctgcggcaaattatgtggaacctcgccaacaacgcgtggcggcacagccgcaaacagcccggctcgatttccgtcaccatccgccccgcgcaaaaaaacaccgtctgtatcctctttgccgaccgcccgaagtgcaggaacacctgttcgaacccttttacaccacggcggaaaacggcaccggcctcgggctgtatgtcgcccgcgaactggcgcacgccaatttcggcgatttga

SEQ ID NO: 5663 - DNA, 468 bp, Neisseria meningitidis
atgactgaactgcaacaccccgtcctcgtcgtcgatgacgaaaccgacattctcgacctgatggaaatgaccctgatgaaaatgggcttgcgcgtccataccgcgtcaggcgttgccgaagccaaaaacaagctcgacagccaacgctattcgctcgtcctgaccgatatgcgtatgccggacggctcggggctggaagtcgtccaacacatcaacagccgcctgctcgatacgccggttgccgtcatcaccgccttcggcaacgccgatcaggcacaggaagcgttgcgttgcggcgcgttcgaccccgataccatgcagatacaggactatctcgaccaaatcgaacgcgacatcatcgaacaaaccctcaaacaaaccgaaggcaaccgcacgcaggccgccaaacgcttgggcatcagcttccgttccatgcgctaccgtatggaacgcctcaacatcggctga

SEQ ID NO: 5664 - DNA, 753 bp, Neisseria meningitidis
atgaccgacatccttattgacaacaccgccaccgaaaccgtccgcaccctgatacgggcattcccccttgtgcccgtttcccaaccgcccgaacaaggcagttacctccttgccgaacacgataccgtcagcctcaggcttgtcggggaaaaaagcagcgtcatcgtcgattttgcctccggcgcggcacaataccggcgcacaaaaggcgggggcgaactcatcgccaaagccgtcaaccacaccgcgcaccccaccgtttgggacgcaaccgcaggattggggcgcgacagcttcgtcctcgcctcgctcgggctggccgttaccgccttcgagcaacatcccgccgtcgcctgcctgctttcagacggcatccgccgcgccctcctcaatcccgaaacgcaaaacaccgccgcgcacatcaacctccatttcggcaacgccgccgaacaaatgcccgcacttgtccaaacacaaggcaaacccgacatcgtctatctcgaccccatgtatcccgaacgccgcaaaagtgccgccgttaaaaaagaaatgacctacttccaccggctcgtcggcgaagcgcaagatgaagcggcactcctgcataccgcacgccaaacagcaaaaaaacgcgtcgtcgtcaaacgcccccgcctcggcgaacaccttgccggacaagaccctgcctaccaatacacaggcaaaagcacccgcttcgacgtttacctgccctacgggacggacaagggataa

SEQ ID NO: 5665 - DNA, 1170 bp, Neisseria meningitidis
atgagcaaaaaactccatccgcaaacgctcgccatacgcggcggcaaagaacaaaccgaataccgcgaacacaatcaggcattgtttctgaccagcagcttcatgtgggacaacgcccaacacgctgccgatttgttttcaaaaaaaatcaaagggttcacttatacccgtaccgccaacccgaccacagccgcctttgaaaaacgcatcgccgctttggaaggtgcggaacgcgcggtcgccacttcggcgggtatgtctgcgattcaggcggcgtttttcacctttttgcaggcgggcgaccatgtgatttccagccgcagcctgttcggcacgaccgtcggctttatcaataacatcgttgccaaattcggcatcgaagtgagccacgtgtcgccgactgatataaacgaatggaaagccgccgtcaaagccaataccaaactgctgtttttggaaacgccgtccaaccccttaggcgaagtggccgacttggaagccttggcggaattggcgcacggcatcggcgcgctcttggtggtggacaacagcctgctgtcgcccgtcggctcgcagcctttgaaacacggtgcggatatttccgtttcctccgcgaccaaagccatagacggacacgggcgtgtgatgggcggcgtgttggcgggttcggaagagttgttggcgcaggtcgccatgtattgcaactcttgcgggctggcgatgtcgccgtttaatgcgtggcagttgttgagcggcgtggaaaccctgtcgctgcgtatggaaaaacagttcgacaacgccctgaaaatcgcacaatggctgcaagcgcagccgcaggttcaagccgtgtactacaccggattgtccgaccatcctcaggcggcgcttatccgcaaacagcaaaacggcggcggcatcgtcatcggctttgaagttgccgatcaagaagcggcgtggaaagttgtggacggcgtggaactcttttcccgcaccgccaacctcggtgacgtgcgctcgaccattacccacccgtggacaaccacgcacggcaggatgcagcccgaagaaaaactcgccgccaacatccgccccggattggtgcgcctgtcggtcggtttggaatatgttggcgatttgattgacgatttgaaacaggcactcgcacgctga

SEQ ID NO: 5666 - DNA, 762 bp, Neisseria meningitidis
atggatgcgaataaagagccgaattgggaaaaacgtttggaaaacctgcgtcagacgcgccgtatgaaggcagtgccgacttacgcgccgctgtcccgcccctctgaaaccggaacggacgcgcctgtgccgaaactggacgatgagagccgagcccgtgtgttgaaggcgtatctgaaaaaatggcaggaggaacacaatgccgccgttgccgattgcggcgaggaagtcgaaaccgacccgatgatcgtccttcaggaaaactggctcaacgcgcaggcttccctgcaaatgtcggtttcggaaaaacacatcgaatcgcggcggagaatccggtttgataccaaaaaagacagtgtcgaatttgaaaccggacagattgaaagcggggaaaacgccgacgaggcagaatccggcacgaatgagccggcggtttcggaaaacggggaaaacgatgcggaagaaacgttgatgcccgtccaaatcaatatcctgaacccgaaagccgtcaaccggcgcgaagtgttctgcctgtccgaacaggagctgaccgaacggctgatcaaacgcctgcgcccgcatctgaccgataccgtcaacggcatcatccgaacggcggtgcaaaagcagatggcggttttcacctatcagctccagcagatgctgcacgagcaggcgggggcggtagtcgaagacgtgttggaacacgatgtccgcaaaatcctcaacgacatcaagtacgagttaaaatacaaacgctga

SEQ ID NO: 5667 - DNA, 252 bp, Neisseria meningitidis
atgggcagcatcgaacagcgtttggaatatctggaagaggcgaacgacgtgctgcgtatgcagaaccacgtcctgtccaccgcattcaaagccttaatccgcgcccttcccgccgaaaccgccgaaatcgcggtcgagtcgattcagcttgcttttgaggacgccttggcagaattgagctatgaggacagcccgcatacggatttgttccacgacgttacttatgcgtttttccgtgaaaaagaacgttaa

SEQ ID NO: 5668 - DNA, 807 bp, Neisseria meningitidis
atgaatatgaaaaaatggattgccgccgcccttgcctgttccgcgctcgcgctgtctgcctgcggcggtcagggcaaagataccgccgcgcctgccgccaaccccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttaaacaacggcgatgcggacgttgtgatgtcgggcgtaaccattaccgacgaccgcaaacagtctatggacttcagcgacccgtattttgaaatcacccaagtcgtcctcgttccgaaaggcaaaaaagtatcttcttccgaagatttgaaaaacatgaacaaagtcggcgtggtaaccggctacacgggcgatttctccgtatccaaactcttgggcaacgacaatccgaaaatcgcgcgctttgaaaacgttcccctgattatcaaagaactggaaaacggcggcttggattccgtggtcagcgacagcgcggtcatcgccaattatgtgaaaaacaatccggccaaagggatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatttacgccaaatattttgcaaaagaagacggacaggccgcaaaataa

SEQ ID NO: 5669 - DNA, 1524 bp, Neisseria meningitidis; identical to SEQ ID NO: 1201

SEQ ID NO: 5670 - DNA, 1413 bp, Neisseria meningitidis
gtgaaaatcctcattttaggcaacggacaggtaggttctaccgtcgcacaaaaccttgccgccatacccaacaacgacgtaaccgttatcgacatcgacgaaaaagcattgcaggaaacaggcagccgcctcgatgtccaaaccgttttcggcaacggcgcatcccccttcacattagaacgcgccggcgcggaagatgccgacttgctgctcgcgctctcccgcagcgacgaaaccaacatcgtcgcctgcaaagttgccgccgacctgttcaacatccccggccgcatcgcgcgcgtccgttccagcgaatacctcgaatacctcagccccaagctcgaaaacaacgaaaacggcagcctttccatattcggcataaccgaaaccatcagccccgaacagctcgttaccgaacagcttgccggcctgatagactgcccgggcgcattgcaggttttacgttttgcagacgaccgcgtgcggatggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataa

SEQ ID NO: 5671 - DNA, 264 bp, Neisseria meningitidis
ttgttttcaggcgaatccgccgcatcagaacatactgcgcacgcccatattgacctgccaagtctagcgcatcgtgtgcatcgaagacctttgcgcctcaaaataaagctgccttccgttgtcggcattaccacgcaaaaaaatgaattgcttgatattccaatgttttttatatgtttttatattgtgatgcgatcagacaaacgcccccctgacatttgtttagacggcatcgtattgctaaatttctataagtatgtataa

SEQ ID NO: 5672 - DNA, 807 bp, Neisseria meningitidis
atgaaaagctcttttgtgcaaacgcttaccatcgccggttcggattcgggcggcggtgcgggcattcaggcggatttgaaaacatttcagatgcgcggcgtgttcggaacgtgcgtcatcaccgccgttaccgcgcaaaataccttgggcgtgtcggcggttcatctcgtcccgaccgaaaccatcaccgcacaaatccaagcaatcagggaagacttcgacatccgcgcctacaaaatcggtatgctcggcacggcggaaatcatcgaatgcgttgccgacaagctgaaacactgcagctttggcaggcgcgtactcgaccctgtgatgattgccaaaggcggtgcgccgctgttgcaggattccgccgttgcggcactgacgcgcctgctgcttcccgatacggatgtattgacccccaacctgcccgaagcggaagctctgaccggcgtgcatattgaaaaccgtaaagatgcggaacgtgcggcaaaaatcctgcttgattacggtgtcaaaaatgtcgttatcaaaggcggacatttgaacggcagcacaagcggacgctgcacggattggctgtttacacaaaatgaaacgctggaattcgacagcccgcgctttccgaccgcccacacgcacggcacgggctgcacgttttccgcctgcatcaccgccgagttggcaaaaggctcggacgtttgcgaagccgtacagactgccaaggcctacatcacggcggcaatctcaaaccctttggaaatcggcgcaggacacggcccggtcaatcattgggcgtatcgggactaa

SEQ ID NO: 5673 - DNA, 870 bp, Neisseria meningitidis
atgaaggagcggatagtgggtcaaagtggcgagttgttttgtttcggacagatgcctgtatggaaagtggaaaacctgccggaagttttgttgtcgggctattcgtctgaggaaggggagtgggtctgcctgaatgtgttgcagggcgatgtcgaagttcgtgcaccggacgggtcggcagaagtttggtcggcagacggcggcgattgtgtgtttgcgccgcagcaggtgttttctgtcaaaccgaaaacggacgatgccgaaatccgtttgtcgctgtattgcgcggcggcagactattttcacaaaaaatacgggatgagtgccacgcattctgcggtcgcggcggcacgggataccgtaccggcgggcagggcgttggatatgggctgcggacaggggcgcaacgcgctgtttctcggtttgaaggggtttgaagttactgcagtcgatcacaatcccgccgccttggcaaacgtggcggagctggcagaggcggagggtttgaacgtccgcacgctggaatatgatttgaacgccgccgccttgcagggcgagtttgattatattgtggcaacagtggtgctgatgttcctgatgccgcagcgcgtacccgacgtgattgccgatatgcaggcgcatacggcggcgggcgggtacaacttgattgtatcggcaatggatacggcggatttcccctgtccgatgccgttcccttttaaatttaaagagggcgagctgaaggattattatcgggattgggaactggtcgaatataaagaagaattgggttctatgcatgccaaagacgaaaacggcaatccgatacggtttaaatttgtaacgatgctggcgaaaaagcctgaataa

SEQ ID NO: 5674 - DNA, 438 bp, Neisseria meningitidis
atgaaccaaaccgtttacctttacaccgacggcgcgtgcaaaggcaatcccggcgcgggcggctggggcgtgttaatgcgctacggtagccacgaaaaagaacttttcggcggcgaagcgcaaaccaccaacaaccgcatggaactgactgccgtcatcgaaggactgaaatcgctcaaacgccgctgcaccgtcatcatctgcaccgactcgcaatacgtcaaaaatggcatggaaaactggatacacggttggaagcgcaacggctggaaaaccgcctccaaacagcccgtcaaaaacgacgacttgtggaaagaactcgacgctctagtcggacggcatcaagtcagttggacttgggtgaaaggacacgcgggacacgccgaaaacgaacgcgccgacgatttggcaaaccgtggcgcagcgcagttttcctga

SEQ ID NO: 5675 - DNA, 405 bp, Neisseria meningitidis
atgaccgcccaaccctgccccatctgcacggcgcaaaatgaagacgttttgctgcaaacccccaacctccgcgtcatcgccgtccataacgacagcggttcgcctgcattctgccgcgtcatttggcgtaagcatattgccgaaatgaccgacctttcggcagcggaacgcggcgaattgatggaaatggtgtacaaagtcgaagccgctatgcgccaagtgttccggccggcaaaaatcaacctcgccagcttgggcaatgtcgtgccgcacctgcattggcatattatcgcccgctttgaaaacgatgcgtctttccccgcgccgatttgggcaaaccccgtccggaaacacggtatgaccctgccgcaagattggacggaacagcttaaaaagctgctttaa

SEQ ID NO: 5676 - DNA, 1185 bp, Neisseria meningitidis
atgaccgaaccgacctcccgccgccgttttctgaaaacctgcaccgccgctgccggcgcggggctgcttcaggcttgcggcacatccgccacatccgttccgccccttccctcttcccattccgttgtgaaagcccgaaccgtgcctctccaaacgccacgccgtcaaagttcggacggcaaccttctgcgcgttgtcgcttcgtcaggatttgccgaagacaccaaccgcgtcaacacagccttaacccgcctttacaatgtcggttttaccgtaaccaaccaacaggcgggcagccgccgtttccaacggtttgccggcacggacacgcaacgtgccgccgatttccaagaggtcgcttccggccgcgtcgccacgcctaaagtgctgatgggtttgcgcggcggttacggtgcggcgcggattctgccgcatatcgattttgcttcgctcggcgcaaggatgcgcgaacacggcacgctctttttcggattcagcgacgtatgcgccgtccagctggcattgttggcaaaaggcaatatgatgagttttgccggcccgatggcttatagcgattttggcaaacccgcccccggtgcgtttacgatggatgcctttatcaagggtgcaacccaaaaccgcctgaccgttgatgttccttatatccaacgcgccgatgtcgaaaccgaaggcatattgtggggcggcaacttaagcgtcctcgcctcgctcgccggcacgccttatatgcccgacatcgacggcggcattttgttcctcgaagatgtcggcgaacagccctaccgcatcgaacgtatgctcaatacgctgtatctttcgggtattttgaagaaacagcgcgccatcgtgttcggcaatttccgtatggaaaaaattcgagatgtctatgatccgtcttatgatttttctgccgttgccaaccatgtttcgcgcacggcgaaaatccccgtgctgacgggcttcccgttcggacacattgccgacaaaatcactttccctctaggcgcgcacgcccgaatccgtatgaacggaaacagcggttattcggtcgcgtttgaaggctaccccacactcgatgcgtccgccctgactttggataccctgctcccaccgccggatttgcccatcttccccgaaagcggtgttgccgatatttcggaataa

SEQ ID NO: 5677 - DNA, 534 bp, Neisseria meningitidis
atgggtatttacgattttcaaatgaaagatgcagaaggcaatgcggttgatttgtcaggctatcgcggcaaggttctgctgattgtcaacacggcaacgcgttgcggtctgaccccgcaatacgaggctttgcagaagctgtatgcacaatataccgcagaaggcttggagattttggattttccgtgcaaccagttccgcgaacaggctcccgaaagcagcggagaaattgcccaagtgtgtatgatgaagtttggcacgaagtttaagattttcgacaaaatcgaagtcaatggagcaaataccgcgcccttgtatgcctacctgaaatccgtcaaaccgcaagataaaggcaatcatctgtttaaagatttcgtgttgaagctcgcagctttgggagagaagcgcgacgaaggcgacatcaaatggaactttaccaaattcctcgtcaaccgcgacggcgaagtggtcgagcgttttgcgcctagtgttacgcccgaagaaatcgaagccgatattcgggcattgctgtaa

SEQ ID NO: 5678 - DNA, 2256 bp, Neisseria meningitidis
atgggacagtacaagaagctttggtacttgctgtttgccgttctggcggtatgctttaccattcttggctatatgggcagcgaggtttacaaaaaagccccgccttaccccgaacaggtcgtttccgcatccggcaaggtcttgatgacgaaagacgatattttggcaggtcagtctgcatggcagactaccggcggtatggaagtcggttcgattttgggtcacggtgcatatcaggctccggactggacggcggactggctgcatcgtgagttggttgcctggttggatttgaccgcgcaacagacttacggcaaaaaattcgacgaggtttcccccgaggaacaagccgtcttgaaaacacgcctggccgacgaataccgcaatcaaagccgcgtgaaggaagacggcagcgtcgtcatcagcgatacgcgcgtgaaagccatcgaaagcatcctgccttactaccacggtgtgtacagcgacgatcctaagttccaaaccactcgcgaacactttgcaatgaaaaacaatacattgccaagccaagaagcgcgtgaaaaactgttcaacttcttcttctggacttcttggtctgcttcgaccaaccgtcctgacgagaattttacttacaccaacaactggccgcacgaacctttgatcaacaacgtaccgaccactgaaaactatatgtggtcattcaccagcgttgttcttctgctgatgggcatcggtttgctgatgtggggttattccttcctgaccaaacacgaggaagtggaagtgccgtctgaagacccgatttccaaaatccaactgaccccttcgcaaaaagcattgggcaaatacgtcttcctgacggtcgccctgtttgtggtacaagtattgctgggcggactgaccgcgcactacaccgtcgaaggccagggtttctacggcattgacgaggcgttgggctttgaaatgtccgactggttcccctacgccctgacccgtacttggcacatccaatccgccatcttctggattgcaaccggctttttgacggcaggtttgttcctcgcgccgattgtcaacggcggtaaagatcccaagttccaacgtgccggcgtaaacttcctctatatcgccctcttcatcgtggtcggcggttcttacgcgggcaacttcttcgcgttgacgcacatccttcccccggaatttaacttctggttcggacaccaaggttacgaatacctcgatttgggacgtttctggcaactccttttgatggtcggtctgctgttatggctgttcctgatgttgcgttgcacggtttccgcctttaaagaaaaaggcgtggacaaaaacctgttggctatcttcgtagcttctatggtcggtgtgggcgtattctacgcaccaggcctgttctatggcgaaaaatccccgattgccgttatggaatactggcgttggtgggtggttcacctgtgggtagaaggcttcttcgaagtatttgccactgccgcctttgcctttgtcttctacaatatgggctttgtccgccgcagtaccgccactgcctccactttggccgctgccgccatctttatgttgggcggcgttccgggcacgctgcaccacctgtacttctccggctctacctccgcctctatggcaatcggtgcctgcttctccgctttggaagtcgtgccgctggtgttgctgggccgtgaagcatacgaacactggtcttaccaacacctgtccgactgggcgaaacgcctgcgttggccgctgatgtgcttcgtggcagtcgccttttggaatatgatcggtgccggcgtattcggcttcctgatcaatccgccgatttccctgttctatatccaaggtttgaacacttctgccgttcacgcgcacgccgccttgtttggtgtgtacggtttcttggcattgggcttcgtattgctggttgcccgttatttgaaaccgaacgcgcagtttgacgacaaactgatgacttggggcttctggctgctcaacggcggcttggccggtatgattgccatcagcctgctgcctgtcggcgcgattcaggcatacgcctccatcacgcacggtctgtggtatgcccgcagcgaagagttcctgcaaatggaaatcctcgataccttgcgttgggtacgtacggcagctgacttggtctttatcggcggtgcaatctgtgtcgccatccaagccactaaaatcgtattcggccgcgacaaataa

SEQ ID NO: 5679 - DNA, 1173 bp, Neisseria meningitidis
atgaaacgccaagccttagctgcaatgattgcttccttattcgcattagccgcctgcggcggcgaacctgccgcgcaagcccctgccgaaacccctgccgctgccgccgaagccgcaagctccgccgcacaaaccgccgccgaaacaccgtccggcgaactgcccgttatcgatgcggttaccacccacgctcccgaagtgcctcctgcaatcgaccgcgactaccccgccaaagtccgcgtaaaaatggaaaccgtcgaaaaaaccatgaccatggaagacggtgtggaataccgctactggacatttgacggcgacgttccgggccgtatgatccgcgtacgcgaaggcgatacggttgaagtggaattttccaacaatccttcttctaccgttccgcacaacgtcgacttccacgcggctaccggccagggcggcggcgcggccgcaacctttaccgctccgggccgtacttccacattcagcttcaaagccctgcaaccgggtctgtacatctaccactgcgccgtcgcaccggtcggtatgcacatcgccaacggtatgtacggtctgattttggtcgagcctaaagaaggcctgccgaaagtggataaagagttctacatcgtccaaggcgacttctacaccaaaggcaaaaaaggcgcgcaaggtctgcaaccgttcgatatggacaaagccgttgccgaacagcctgaatacgtcgtattcaacggtcacgtaggtgctatcgccggcgataacgcgctgaaagccaaagcaggcgaaactgtacgtatgtacgttggtaacggcggtccgaacttggtatcttccttccacgtcatcggcgaaatcttcgacaaagtttatgttgaaggcggcaaactgattaacgaaaacgtacaaagcaccatcgttcctgccggcggctctgccatcgtcgaattcaaagtcgacatcccgggcagctacactttggttgaccactctatcttccgcgcattcaacaaaggcgcactgggtcaattgaaagtagaaggtgcagaaaaccctgaaatcatgactcaaaaattgagtgataccgcttacgccggtaacggtgcagctcctgctgcttccgctcccgcagcttctgccccggcagcctctgcatccgaaaaaagcgtttattaa

SEQ ID NO: 5680 - DNA, 756 bp, Neisseria meningitidis; identical to SEQ ID NO: 2479

SEQ ID NO: 5681 - DNA, 957 bp, Neisseria meningitidis; identical to SEQ ID NO: 5608

SEQ ID NO: 5682 - DNA, 1104 bp, Neisseria meningitidis; identical to SEQ ID NO: 5607

SEQ ID NO: 5683 - DNA, 285 bp, Neisseria meningitidis; identical to SEQ ID NO: 5606

SEQ ID NO: 5684 - DNA, 1554 bp, Neisseria meningitidis
atgttggggatgttttcggttaattcttatgctgaacgttttaagtatcctattggaaattcagatgttagattggatattgatcataaaaaatctgtagttaccgattttcgtgttgatggtcagcgtttttcaggtcgaattatcgaaccttcaataatagaacacgtgccaacaggtgcacgctctcttgaaaaagtccccgttaaatttaccgcatcagtttcccgcgccgccgtcttgtcaggagtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatcgttgcacatttaattggaatggcggagattgtttggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccgggacgcacaaacggcagggacggcaaagacggaaaggacggcaaagatggcggccttttgtgcaaattcttccccgacattctcgcttgcgacaggctgcccgagtccaatccggcagaagatttaaatctgccgtctgaaaccgtcaatgtagagtttcagaaatcaggaatctttcaagattccgcacagtgtcccgcacctgtcactttcacagtgactgtgcttgattcaagcaggcagttcgcgttcagctttgagaacgcatgtaccatagccgaacggctaaggtacatgcttctcgcccttgcttgggcggttgccgcctttttttgtatccgcacagtatctcgtgaagtctag

SEQ ID NO: 5685 - DNA, 366 bp, Neisseria meningitidis
atgacgtgttttaaaatcaggctttcaaaacaacctttgaaaggcagaacaatgaacaaaccgtttatcacgcaggcgcagttggcactttataaatatcagccgtcaagcaagtattatggtaaaacaatggcatatactttcgctagtgagcttttggattattcaaaagttaataaatttataattcatgaagaaatccaatgttttttaaatagaaggatttctaataatatttggaaaatttatttttctgatgagtctgttgcgtatataaaaattttagaattacaggatgattatagtcgtggaattgaaattaaaacgtttgattttaatcctaatgttggggatgttttcggttaa

SEQ ID NO: 5686 - DNA, 303 bp, Neisseria meningitidis
atgggctatcgtgtcggcataaattgttttgatacaagattgcatgcagacgactatttattgtcgtcccttcctcctactgttacccaggacggaaaaatcatcaggccggaaagggtgggcgaaaaatgggtcttgaacggaaagccggtaatgttgtcctatccgaaatgttccaattttgagcagatcaaacagggttcttatgtcggttcgacggttttaattctgttcgtagtcatttacggcttcaggcttttgattaattttttaaaagacatgggcaaggttgggattgattga

SEQ ID NO: 5687 - DNA, 285 bp, Neisseria meningitidis; identical to SEQ ID NO: 5602

SEQ ID NO: 5688 - DNA, 201 bp, Neisseria meningitidis; identical to SEQ ID NO: 5601

SEQ ID NO: 5689 - DNA, 312 bp, Neisseria meningitidis
atgtttaatcaaactcaaactgtaacttatcccgcaacttttttaggagctaaaaaattcaaaggcgaaattgatggctctaatatcgacacttgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttga

SEQ ID NO: 5690 - DNA, 1209 bp, Neisseria meningitidis
atgagtgaagcagaatatttttcccatttcatatctaacggcaatgggaagttattagaaattccgcaacgtaggggcaggcaggacggcgtttttatagattggttgtcattcacactgcacgaagattccttgctgaaagtttccggatgccccttagtttccgatgccgaatatatgtttgttttaagcaaaaaattggaggaaatattagggtttggcatcacgagcagatgcaaatcgaagggcaataaattttacgattcgatgtttaggttgggatcggaagaagttgactacggcgaagtccattacggaggtcagcgaaatacggttttaatcgaattgaaaggtgtaggttgcaacattgcaaatccaggttgggaattgaggcttaagcagtttttggaagattcattgaggccgaggataacgcgggtagatttggcacttgatttttttgatggggagtacacgccggaacaggcacttttggatcacgataacggttttttcgataacagtaacatgaggccgaaatctgaaatggttggaacggcttggcggagagaggacgggagcggcaagacattttatgtaggtcgcaagaaaaattctcgttttgtgcgtgtttatgagaaaggcaggcagctaggcgataaagaaagcaagtgggtaaggttcgaaattcagtttaatcatggagatatggaaatacctttggatattctgataaatcaaggttcttacttttcaggcgctttcccgatttgtcagaaatttaaaaatatgccgaatccggaaaggttcgattaccgtaaaaaagtggctaatttaacttttcagcataaattgagatacgcaaaaaacgcggtcggcaaactgattaatttcatgtttgatatgggttttgatagtgatgaaattgtcagatatctgaaggcagatttggggtatcccaaagggctagaacctgaaaaatattcgttggccggattgaaggaatctttgaaattcggctttatccacgaacaaccggatgtagatttagaggttgaattggaagaactcggaattatcaaatttaagcaatcagataaattcgatccggataaaaggcttttcgatccacatcacgatgtggaaagtgagaggcaatatcagctttatctcgacagaatgtatgatcttcatgcaaatcaaaattaa

SEQ ID NO: 5691 - DNA, 222 bp, Neisseria meningitidis
atgtcagtagcaaatgtaatattttcttgttcctattggagaatatttaaaaaatcagattattgcgttttatgtttctatcagttcaggcatggtgaaccgcataaactcgctgaacaagaaaatttttcaaagctttatcaggcgttcgattatatagattcggttggctcgaattttccggtaattatcacaacagacggttgtggtctttcttcttga

SEQ ID NO: 5692 - DNA, 820 bp, Neisseria meningitidis
atgaatccagcccccaaaaaaccttctcttctcttctcttctcttctcttctcttctcttctcttctcttctcttctcttccgcagcgcaggcggcaagtgaagacggcagccgcagcccgtattatgtgcaggcggatttagcttatgccgccgaacgtattacccacgattatccgaaagcaaccggtacagacaaagacaaaataagcacagtaagcgattatttcagaaacatccgtgcgcattccatccacccccgagtgtcagtcggctacgatttcggcggctggaggatagcggcagattatgccagttacagaaaatggagcaacaataaatattccgtcaacacaaaagtgttgaaagaaaaccagggcaacaggataaaactgaagacggaaaatcagggaaacggtacgttccacgcctcttcttctctcggcttatccgccatttacgatttcaaactcaacgataaattcgataaattcaaaccctatatcggtgcgcgcgtcgcctacggacacgttaaacatcaggttcattcggtggaaaccaaaaccacgatttataccactgcaccaacgggagacgctacagtgggaggcactatcccagagagaccgagtagcaaacctgcctatcacgaaagcaacagcatcagcagcttggggcttggtgtcatcgctggtgtcggtttcgacatcacgcccaagctgaccttggacaccggataccgctaccacaactggggacgcttggaaaacacccgcttcaaaacccacgaagtctcattgggcatgcgctaccacttctga

SEQ ID NO: 5693 - DNA, 558 bp, Neisseria meningitidis
atggatgctttaaaattattgacgaaccgccgatcttccaaaaagctgaagcaccccgcccccgatgcggcggagttggaacaaatatttcaggcggcaacccaagttcccgatcacggcaatatgcgccccttccgttttaccgtgattcaaggcgaggtaggattgcaacgttttcgcgatgtgttgaagcaaacggttgccgaattgaatttcggcgacgatgcgatgaaaaaggcggaaaaagtgggcaatatggcgccgatggttatcggggtaacgtttgcgccgaaccgcgatgtgcctaagccgaaaccggaatgggagcagatgctgacggcgggttgtgcggcgtatgcgctgcaactggcggcaacggctcagggattcgacaatgtctggattacggggatgtgggtcaatagccccctgttgcgggaggctttcggttgtgcggataaggataaaatcatcgggctgatgatggtcggcacgccgacagaggaagtgcataagcccaagaataccgatttggaagcgtttgtcagccattggtaa

SEQ ID NO: 5694 - DNA, 1635 bp, Neisseria meningitidis
atgataaaaccgaacctgaggccgaagctcggctcttccgcgctgattgccttcctttccctgtattcctcgctggtattgaattacgccttttttgccaaagttgtcgagcttcatccttttaacggcaccggggcggatatcttcctctatacgatgccggtggtgctgttttttttaagtaatttcgtttttcacgtcattgccctgcctttcgtgcataaggtattgattccgttgatattggttatcagtgcggcggtgtcttaccaagaaatatttttcaatatctatttcaacaagtcgatgttgaataatgtcttgcaaactacggctgccgaaagcgcgcgcctgattacgccgggctatgtgctgtggattgtatgtttgggcgtattgcccgcgctggcgtatatcgccgtcaaggttaaataccgcgtttggtataaggagcttttgacgcgccttgtgcttgccgccgtttcctttttgtgcgcgttgggcatcgcaatgttgcaatatcaggattacgcctcgtttttccgcaacaataaatcagtaacccatctgattgtgccgtctaatttcatcggcgcgggcgtgtcgaaatacaaagattggaagcgttccaatattccttatacgcaattggatatggcggtcgtgcaaaaccgcccggccggcagcctgcgccgtttcgtggtgctggtcgtgggcgagaccacgcgtgccgccaactggggtttgaacggttacagccgccaaactacgccgctgcttgccgcgcgcggcgatgaaattgtcaatttcccgcaggtcagaagctgcggcacatcgaccgcgcactccctgccgtgtatgttctcaaccttcgaccgcacggattatgacgaaatcaaagccgaacaccaagacaacctgctggacatcgtgcagcgcgccggcgtggaagttacttggttggaaaacgattccggctgcaagggcgtgtgcggcaaagtgccgaataccgacgttacctcgctcaacctgcccgaatactgccgcaacggcgagtgcctcgacaatatcctgctgactaagttcgacgaagtcctcaacaaaaacgataaagacgcggttttaatcctgcataccatcggcagccacgggccgacgtattacgaacgctataccgaagccgaacgcaaattcacgccgacctgcgacaccaacgaaatcaacaaatgcacccgcgccacgctggtcaacacttacgacaatacggttttgtatgtggaccagtttatcgacaaggttatccgcaaacttgaaaaccgcgacgatttggaaagcgtggtgcattatgtttccgaccacggcgaaagtttgggcgaaaacgggatgtacctgcacgccgcgccttacgccatcgcgccttccgggcagacgcatatcccgatggttatgtggttttccaaagccttccgccaacacgggggcatagatttccaatgcctcaaacaaaaagcggcggaaaacgaatattcgcacgaccactatttcagcacggtattggggctgatggacatttccaatagccaaacctatcggaaggaaatggatatattggcagcctgccgccgtccgcgctga

SEQ ID NO: 5695 - DNA, 330 bp, Neisseria meningitidis
atgtcccgatgttgtctgaagcggcttcagacggcatcggctgtttcggcgttctccggcggcgttttggaggtggtaagattgtgctgccggcggctatccgtccttttcaatccgagcgtgatgctgtttgtgccggactgtcccgtcggcggcgcggctgggtttttccaatatgaaatgctttgcccgtttttctggcaggggcggttgcagaccggttcgaatcttgcttacgatgtttttatgtctgccggacgtttgaatggcgggcggaaccccccgcacagccgccgttttcttgccctgctttgctccgttgccttataa

SEQ ID NO: 5696 - DNA, 1107 bp, Neisseria meningitidis
atgtctctttatccgatttacaatttttccgccggccctgccgtattgcccgaagccgtgttggaaacggcgcggcaggaaatgttggactacaacggtacgggttttcctgtgatggcaatgagccaccgttcggaaatgtttttgagcatcctgcatcatgcggaacaggatttgaggcagcttttgaaagtgcctgacaactataagatattgtttctgcagggcggagcaacaacccaatttaatatggcagccatgaatctggcacacggtttccgcactgccgacgcggtggtaacgggcaactggagccgtatcgcttatgaacagatgagccgtttgaccgatacggaaatccgtttggcggcgcatggcggcgagcagttcgactatctcgacctgccgcctgtggaaacgtgggatgttgcacccgattcggcgtttgtccattttgccgtcaatgaaacggtcaacgggctgcaataccgtgaagtgccgtgcctttcagaaggcatgccgccgctggtgtgcgatatgtccagcgagattttgtcgcgcgagtttgatgttgccgactacggactgatttacgcaggcgcacagaaaaacatcgggccggcaggagttacggtggtgattgtgcgtgaggatttgctcgagcgttgtccgaacgatattcccgatgtgttcaactaccgttcgcacatcaaccgcgacggtatgtacaacacgccgtcaacttacgcgatttatatgtcggggctggtgttccgctggctacaggcgcagggcggtgtgaaaaaaattgaagcggtcaatcggctgaaggcgcaaaccttgtatgagacgatagacggcagcgatggtttttatatcaaccgtatccgtccgaatgcgcgttctaaaatgaatgtcgtgttccaaacgggggatgaggagcttgaccgccgttttgtgctggaagccgaattgcagggcttgtgcctgcttaagggctataaaaccgtcggcggtatgcgtgccagcatttataatgcgatgccgcttgaaggcgtgcgggctttggcagattttatgcgcgatttccaacggcgttacggttga

SEQ ID NO: 5697 - DNA, 450 bp, Neisseria meningitidis
atgtacatagggagcagcatggatatccaaaccatcctcgaaaaaaccctgcccggcctgggctacgaactggtcgatttcgaactgaccgcgcaaggaacattgcgcgtgttcatcgacaaagaaagcggcattaccgtcgaagactgcgcaaccgtcagcaaccacttgagccgcgtcttcatggttgaagacatcgactacaaaaacctggaaatttccagccccggactcgaccgccccttgaaaaaagccgccgacttcgtgcgctttgccggtcagaatgccaaaatcaaaacccgcctgccgatagacggtcagaaaaactttatcggtaaaatcgaaggctgcgaaaacgataccgttaccgtatccttcgacggcaaaaccgtacaaatcgaattgggcaacatcgacaaagcccgtctgcgccccgaattcaaattctaa

SEQ ID NO: 5698 - DNA, 1503 bp, Neisseria meningitidis
atgagtcgtgaaatgttacagctggcagaagcactggcaagcgaaaaaaacgttgatgcggaagtcgtcttccaagcactggaattcgccctgtctaccgccgccaagaaaaaggcagaccgcgaacacatggacgtgcgcgtccaaatcaaccgcgacaccggcgaataccaaaccttccgccgctggctgattgtcgccgatgaagactatacctatcccgatgtcgaaaaaaccatcgaggaaatccaagaggaaattcccggcactaccatccaaatcggcgaatactacgaagagcagctgcccaacgaaggcttcggccgccaagccgcgcaaaccgccaaacaaatcatcctgcaacgcatccgcgatgccgagcgcgagcagaatctgaacgagtttctcgccgtcaaagaagacatcgtgtccggcacggtcaaacgcgtcgaacgccacggcatcatcgtcgaagtcgttgccggcaaactggacgcgctgattccgcgcgaccaaatgattccgcgcgaaaacttccgcagcggcgaccgcatccgcgccctcttcctgcgcgtcgaagaaatcggcaacaccggccgcaaacaagtcattctgagccgtacttccggcgatttcctcgtcaaactgtacgccaatgaagtacctgaaattgcagacggcatgcttgaaatccgcgctgtcgcccgcgacccgggacaacgtgccaaagtcgccgtcaaagccaacgaccagcgcatcgatccgcaaggcacctgtatcggcgttcgcggttcgcgtgtcaatgccgtcagcaacgaattgtccggcgagcgcatcgatgtcgtcctctggtcgcccgaacccgcgcaattcgtgatgagcgcgctctcacccgccgaagtcagccgcatcgtcatcgacgaagacaaacacgccgtcgatgtcatcgttgccgaagaccagctcgcgctcgccatcgggcgcggcggtcaaaacgtgcgccttgcttccgacctgaccggctggcagctcaacatcatgacttccgccgaggcagacgaacgcaatgcggcagaagatgccgccatccgccgcctgtttatggatcacttgaacgtggacgaagaaaccgccgacgtactggttcaggaaggttttgcaaccttggaagaagtcgcctatgttcctgccgccgaactgcttgccattgaaggatttgacgaagaaatcgtcgatatgctccgcaaccgcgcccgcgatgccatcctgaccatggcgattgccgccgaagaaaaactgggcgaagtgtccgacgatatgcgcaacctcgaaggcatagatgccgatatgctccgcagccttgccgaagcaggcattaccacccgcgacgacttggcagagcttgctgtggacgaactgattgaaatcaccggtgtaaacgaagaaaccgcaaaagccgtcatcctgaccgcacgcgaacactggtttaccgaagacaaataa

SEQ ID NO: 5699 - DNA, 2889 bp, Neisseria meningitidis
atgagtaacacaaccgtagaacaatttgccgccgagctgaaacgccccgtcgaagacctgttgaaacagttgaaagaagccggcgtcagcaaaaacagcggcagcgattccctgacgctggacgacaaacagcttctgaacgcctacctgaccaagaaaaacggcagcaacagcagcaccatcagcatccgccgcaccaaaaccgaagtcagcaccgttgacggcgtaaaagtcgaaacacgcaaacgcggacgcactgtcaagattccttctgccgaagaattggcagcacaggtaaaagccgcccaaacccaagccgcacctgtccggccggagcagacggcagaagacgcggcaaaagcccgagccgaagctgccgcacgcgcagaagcccgtgccaaggcagaagcggaagcggcaaaactgaaagcggcaaaagcaggcaacaaagccaaacctgccgcgcagaaacccaccgaagcaaaagccgaaaccgcacccgttgcggcggaaaccaaacccgccgaagaaagcaaagcggaaaaagcccaagccgacaaaatgccgtctgaaaaacccgccgagcccaaagaaaaagccgccaagccgaaacacgagcgaaacggcaaaggcaaagatgccaaaaaaccggcgaaacctgccgcacctgccgtgccgcaacccgtggtcagcgcggaagaacaggcgcaacgcgacgaagaagcacgccgtgccgccgcacttcgcgcccaccaggaagccctgttgaaagagaaacaggaacgccaggcacgccgcgaagccatgaaacaacaggcagaacaacaggcaaaagccgcacaggaagccaaaaccggcagacagcgtcccgccaaacctgccgaaaaaccgcaggcagccgcgccagccgtcgaaaataaacctgtcaatccggcaaaagcgaaaaaagaagaccgccgcaaccgcgatgacgaaggtcaaggccgaaacgccaaaggcaaaggcggaaaaggcggacgcgaccgcaacaatgcacgcaatggcgacgacgagcgcgtacgcggcggcaaaaaaggcaaaaaactcaaactcgagccgaaccaacacgccttccaagcaccgaccgaacccgtcgttcatgaagttttggttcccgaaaccattaccgttgccgatttggcgcacaaaatggcggtcaaaggcgtggaagtggtcaaagccctgatgaagatgggcatgatggttaccatcaaccaatccatcgaccaagacaccgccctgattgtggtggaagaactcggccacatcggcaaacctgccgcagccgacgaccctgaagcattcttggacgagggcgcggaagcagtggaagccgaagcattgccgcgtccgcccgtcgttaccgtgatgggccacgtcgaccacggcaaaacctcgctgctggactacatccgccgtaccaaagtggtacagggcgaagcgggcggcattacgcagcacatcggcgcgtaccacgttgaaacccctcgcggcgtgattaccttcttggacaccccgggccacgaagcctttaccgctatgcgcgcacgcggtgcgaaagcaaccgacatcgtgattctcgtggtcgccgccgacgacggcgtgatgccgcaaaccatcgaagcgattgcccacgccaaagctgcgggtgtaccgatggtggttgccgtcaacaaaatcgataaagaagccgccaacccagagcgtatccgccaagagctgaccgcacacgaagttgtgcctgacgaatggggcggcgatgtacagtttatcgacgtttccgctaaaaaaggcctgaacatcgatgcattgctcgaagccgtcttgctcgaagctgaagttttggaactgaccgcacctgtcgatgcgcccgccaaaggcatcatcgtcgaggcgcgcttggacaaaggccgcggcgcggttgccacattgctggttcaaagcggcacgctgaaaaaaggcgatatgctgctggccggtacggcattcggcaaaatccgcgcgatggtcgatgaaaacggcaaatccattaccgaagccggtccgtccatccccgtcgaaatcctcggcttgtccgacgtaccgaatgcgggtgaagacgcgatggtattggcggacgagaaaaaagcgcgcgaaatcgccctcttccgccaaggcaaataccgcgacgtgcgccttgccaaacagcaggcggcgaagctggaaaatatgttcaacaatatgggcgaaacccaggcccaatctttgtcggtcatcatcaaggcagacgtgcagggctcttacgaggctttggcgggcagcctgaaaaaactgtccacagacgaagtgaaagtgaacgtgttgcacagcggcgtgggcggcattaccgaatcggatgtcaaccttgccatcgcttcgggcgcattcattatcggctttaacgtgcgtgcagatgcctcttcgcgcaaacttgccgaaaatgaaaacgtggaaatccgctactacaacatcatctacgatgccatcaacgacgtgaaggcggcgatgagcggtatgctttccccggaagagaaagaacaggttaccggtacggtcgaaatccgtcaggtcatctccgtttccaaagtcggcaacattgcaggctgtatggttaccgacggcgtggtcaaacgcgattcccatgtccgcctcatccgcaacaacgtggttatccacacgggcgaactggcttcgttgaaacgctataaagacgatgtaaaagaagtccgcatgggcttcgagtgcggtctgatgctcaaaggctacaacgaaatcatggaaggcgaccaactggaatgcttcgacatcgtcgaagttgcccgcagcctgtaa

SEQ ID NO: 5700 - DNA, 1341 bp, Neisseria meningitidis
atgaacaaacaacccctttccctcgccgtcgtcggacacaccaacaccggcaaaacctcgctcctgcgtacccttttgcgcgacagcggtttcggcgaagtcaaaaacgccccatcgaccacgcgtcatgtcgaagaagccgccatcagcgacggcgcagacacgctggttttcctgtacgacacgcccggactcgaagacgcgggcggcgtgctggaatggctggaaaaccatacggacaatcgttcagacggcatcgaacggctgcaacagtttctcggcagccacggtgcgcaccatgatttcaatcaggaagccaaagtcttacggcaagtcttgcaaagcgatatggcaatgtacgtcatcgacgcgcgcgaacccgtcctcgacaaatacagggacgagttgaccatcctttcatggtgtgccaaaccggttatgcccgtgttcaactttaccggcggacagcttcccgaatcgtggacaaccatgctggcgaggagaaacctgcacgttttcgcagggttcgacaccgtcgcctttgattttgaaggcgaactgcgcctgtgggaaaacctcgccaccatgttgcccgaacgcagcacacttgaccgcctgacagccatgcgccggcgcgaatggcagcggctggacggcgaagcgcgccgcgaaatcgccgactttttaattgatgccgccgccttcaggcaggaagtggacgaaaacgaggataccgccaccgtgctgcaaaccatgcaggcggaaatacgccaactcgaacggcagatgcagcagcggctgtttgccctctaccgtttctaccacagcgaaatcgacggcggcgactggatgccgcaagccttccgccaagacccgttcgacagcgaattgctcaaacaatacggcatccgcaccggcacgggcgcggcaaccggcgcgctcatcggcttggggctggacatcgccacactcggcggctcgctcggattgggtacggcaatcggcggctttttgggcggcatcctgcccaatacccgcaccatttccgacaaactcgctggccgccaaaccctgcacaccgaccctgaaaccctgaccctgctcgccgcccgcgccctcgatttgctccacgtcctgcaaacgcgcggacacgcggcacagtcggatatcgagctgcacagccgcaaagtcccgtgggatgccgccagactcccgcccgaactcaacaaagcccgcagtcattggaaatggtcgtcgctcaatacgcaccgcccggaaaccagccgcgccgaacgcagggaatatgcggagaagcttgggatacgtttagcgggcaaataa

SEQ ID NO: 5701 - DNA, 1341 bp, Neisseria meningitidis; identical to SEQ ID NO: 199

SEQ ID NO: 5702 - DNA, 627 bp, Neisseria meningitidis
atgtatacaggcgaacgcttcaatacttacagccatttgagcggtttgattctggcggcggcaggtttggcgctgatgctgctgaaaaccataggacacggggacggctaccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgtgatttatgtcgtcatgggttggatggtcttggcggtaatgaaatccctgacagcctcactcccgtcggcaggactggcttggctggcggcaggcggtatgctgtacagtgtcggcatttactggtttgtaaacgatgaaaaaatccgacacgggcacggaatctggcatctgttcgtattgggcggcagcatcacccaatttgtcagcgtgtacggttacgtaatctga

SEQ ID NO: 5703 - DNA, 1419 bp, Neisseria meningitidis
atggaaaatatattgtctgttctggtgggtacagtcaatcggttcctttgggactacctgctgatttacgcgcttttgggtatcggcctgttttttacgctgtatcttggtgcgccgcagattaccaagctgggcgcgggattcaaatccgtattcggcggcttgtttgccaaaggcgataaagacgacaagtctttatcgcagtttcaggcgttggcggttgccatatctgcgcaaatcggtacgggcaacgttgccggcgtggcgaccgccatcaccgcaggcgggccgggcgcgattttttggatgtgggtttctgccgttttggggatgtccacgatttttgcggaggcactgctggcgcagaaataccgcgtcgtcagccacggcaaatacatcggcgggccggcgttctacatcacccacggtctgactccgaaaatcggcaggggcgcggcgcgttttttgtccggtttcttttccattgcgttgattatcgcattgggctttatcggtaatgcgacacaggcaaactccattgcttctgccgttaccattgcatttgatgtgccttctttggcagtcggtattgtgcttgccgtccttgcgggcatggttgtgattggcggcgtgaaccgtattgccaatatcgcccaatttgtcgtgccgtttatggcggttgtttatattttgtgcgccgtcgttatcctgtttgaattttccgaccatattgtgccgatgttcaaccacatctttaccgccgccttcaatcccgaagccgttttgggcggtgctgcgggtatcggtatgcgcgaagcgatacgtttcggcgtggcgcgcggtctgttttccaacgaagcaggtatgggttcgactccgcacgcccacgcgactgcggatgtgaagcaccctgtgcagcaaggtatggcggcatttgtcggtgtgtttatcgatacgattttggtatgtacggctacggcattgattatcctgctgaccgatgccaacctttcgggcgaacagggcgcggcggttactcaatttgcctttaacaaggcatttccgggcttcggttcgcaattgcttgccgtgtgtctgaccttctttgccttcaccaccatcatcggttggtattatttcggcgagtccaatatccgttttcttttcaggggaagacacttgggcatctatcgcgcattggttctgcttgccattgttttgggtacgctcggcaaagtcgatttggtttggagtctgtcggatatgttcaacggttttatggttatccccaacctgatagccctgtttttgttgcgtaaggaaatccgcgccatttatgatgattatttggcacagaaaaaagcgggtcgggatttgtcctatcagtatgaattccacgagttccacgacaagggctga

SEQ ID NO: 5704 - DNA, 729 bp, Neisseria meningitidis
atggcaggccatagcaagtgggcaaatatccagcataaaaaagcccgtcaggatgccaaacgcggcaaaatctttacccgtttaatcaaagaaatcaccgttgcggcgcgtatgggcggcggcgaccccggttcaaatccgcgcctgcgcctggctttggaaaaagcagccgaaaacaatatgcccaaagacaatgtgcaacgcgccatcgacaaaggcacgggcaacttggaaggcgtggaatacatcgagttgcgctacgaaggctacggcatcggcggcgcggctttgatggtggactgcctgaccgacaacaaaacccgcaccgttgcggacgtacgccacgcgtttaccaaaaacggcggcaacttgggtaccgacggctgcgtggcgttcaacttcgtgcatcagggctatttggtattcgaacccggcgttgacgaagacgcgctgatggaagcggctttggaagccggtgcggaagacgtggttaccaacgacgacggttccatcgaagtcattaccgcgccaaacgattgggcgggcgtaaaatccgctttggaggcggcaggttacaaatccgttgacggcgacgttacgatgcgcgcccaaaacgaaaccgaactctccggcgacgatgccgtcaaaatgcaaaaactgattgacgcgctggaagacttggacgacgtgcaagacgtttacacttccgccgtattgaatctggactga

SEQ ID NO: 5705 - DNA, 489 bp, Neisseria meningitidis
atgaccccgttatttagaaaagccgtttggctgctgtttgccgtttcggtctgtgcatttgccggttctttggcggcacagtatgttttgggtatggagccttgcgttttgtgtatcagtcagcggttatgcgttttggcaaccgcattgtgtacggcaattgtcctgatgtgcagaccaagaagaagggcaggcggtttgttcggtgctgtctttatcagcattccggccgttacgggtatttctgttgcggcatatcagttgtggttgcagtcgctgccgccgggaaccgctccttcgtgcggcgcgccgtggacgttccgcttgaaaggctggcctttgtttgattggttcgagcctgtcgtgcgcgggttcggaaattgtgctgaaccggattatctgctgggaattgctttgcctgtttggagcgtggcgtattttctggcggttgtcctgacggtttggtgggcgtgggcaagggctaaataa

SEQ ID NO: 5706 - DNA, 465 bp, Neisseria meningitidis
atgaaagaactagataaaatcgatttccgcatccttaagatccttcaacagaatgcccgcatcccgatgacggagcttgccgagaaggtaggcttgtccaccacgcccgttacagagagggtgcgccgtttggagcgggaacattatatttccggttatcacgcccatctcaatccccatctgttgggcaaacctttattggtttttgtcgagctgaagctgcaatccaaatcgggcaatattttcgaagatttcaaaaaagaagtgctgaaaattccgcaaattatggaatgccacttggtgtcgggcgaatacgactatctgattaaagtacgtttgcccgatatgtctgcctatcgggatatgctaggcaatatcctattgcaactgcctgccgcttcggagagtaggagttatgttgtgatggaggaggtcaaagaaaatccggttttggatttggattga

SEQ ID NO: 5707 - DNA, 1059 bp, Neisseria meningitidis
atgcgccctttgaacgtgcagatcaggttgggcaaccttaggcacaattatcggattttgaaggaaatgcacggaggcaaactgttggcggtagtgaaggccgacgcatacggacacggtgcggtcagatgtgctttcgcgctggcagacttggcagacggctttgccgtggcgacaatcgatgaaggaatcaggctgcgggagagcggcattacccatccgattgtccttttggaaggcgtatttgaagcatcggaatacgaagcggtcgaacaatactcgctttggccggcagtcggaaaccaatggcagcttgaggctttgctgatccgccattggaaaaaaaccgtcaaagtctggttgaaaatggattcggggatgcaccgtaccggttttttccctcatgattacgcttcggcatatgcggcattgaagcagtcggaatatgtggacagtattgtcaaattctcgcatttctcctgtgcggacgaacccgaaagcggtatgacggaaatacagatggaagcattcgatttgggtacggaagggctggaaggcgaagaaagccttgccaactccgccgctattttgaatgttcccgaagcacgcagggactgggggcgcgccggtctggcgttatacggcatttccccgttcggaggaggcgatgacaggctgaagcccgtgatgaggctttcaacccgtattttcggcgaacgcgttttacagccgcactcccctatcggttatggcgcaacattttataccagcaaatctacgcgcgtcggcctgattgcctgcggttatgcggacggttatccgcgccgcgccccaagcaattcccccgtcgctgtcgacggcaaattgacccgggtcatcggcagggtctctatggatatgatgaccatcgagctggatgcttcgcaagaaggtttgggacacgaggtcgaactgtggggcgatacggtcaacatcaataccgttgccgaagcggccggaaccatcccttacgaattgatgtgcaatatcaaacgtgcaaaattcacttatatcgagtaa

SEQ ID NO: 5708 - DNA, 1356 bp, Neisseria meningitidis
atgagtatccaatccggcgaaattttagaaaccgtcaaaatggttgccgaccagaattttgatgtccgcaccattaccatcggcattgatttgcacgactgcatcagcagcgatatcaatgtgttgaaccaaaatatttacaataaaattaccacagtcggcaaagacttggtcactacggcaaaatatctgtctgccaaatacggcgtaccgattgtgaatcagcgcatttccgttacgccgattgcccaaatcgcggcggccacccatgctgattcttacgtcagcgtggcgcaaactttggataaagctgccaaagccatcggtgtgtcttttatcggcggtttttccgcgttggtgcaaaaagggatgtcgccttcggatgaggtgttaatccgctccattcccgaagcgatgaagactaccgatattgtgtgcagctccatcaatatcggcagtacgcgtgccggtatcaatatggatgcggtcaagctggcgggcgaaaccgtcaaacgcacggcggaaatcacgcccgaaggtttcggctgcgctaaaattgtcgtgttctgcaacgcggtggaagacaacccgtttatggcgggcgcgtttcatggttcgggcgaagcggatgccgttatcaatgtcggcgtatccggcccaggtgtcgtaaaagccgcgttggaaaattcagatgcaacgacattgaccgaagttgcggaagtagtgaagaaaactgctttcaaaattacccgcgtgggcgaactcatcggccgcgaagcctcaaaaatgctgaatatcccgtttggtattctcgacttgtcgctggcgccgacccccgccgtcggcgactcagtggcacgcattcttgaagaaatgggcttgagcgtctgcggtacgcacggcacaacagcagctttggcattgctgaacgatgccgtgaaaaaaggcggcatgatggcttccagcgcggtcgggggtttgagtggcgcgtttatccccgtttccgaagacgaaggtatgattgccgccgccgaagcaggcgtgctgacgctggacaaactcgaagccatgaccgccgtttgttcggtcggcttggatatgattgccgttcccggcgacacgcccgcgcacaccatttccggcatcattgccgacgaagccgccatcggcatgatcaacagcaaaaccactgccgtgcgcattattccggtaaccggtaaaaccgtcggcgacagcgtcgagttcggcggcttgttgggctacgcgcctgtgatgccggtcaaagaaggttcgtgcgaagtattcgtcaaccgaggcggcagaattccggctccggttcaatcgatgaaaaactga

SEQ ID NO: 5709 - DNA, 273 bp, Neisseria meningitidis
gtgaacaattcagtcatcaccgtcatcggtaaagaccgcgtcggcatcgtgtacgatgtttccaaaattttggcggaaaaccaaatcaatattctcaacatcagccaacagctgatggacgatttttttactatgattatcttggtggacacttcaaaatgcagcaaatcgcgtcaagaggttttggatttgtttgcggaagagagcaaaaaactcgcgcttgatatccgtatgcaaaacgaagaaatcttccaagcgatgcaccgcatttga

SEQ ID NO: 5710 - DNA, 738 bp, Neisseria meningitidis; identical to SEQ ID NO: 699

SEQ ID NO: 5711 - DNA, 912 bp, Neisseria meningitidis
atggttcatattatgtttaatcaggcagcacaagaattgacgactatccgcgatattttacgttttgcagtcagccgttttaatgaggcagggctcttttttggtcatggaacagataatgcgcatgatgaagcagcttatttgattctgcatactttgaatttgcctttggatatgcttgccccatatcttgatgcaaaactcttggaagctgaaaaagaggaagtgctggcggttattgagcgtcgtgctgtcgaacacattccagccgcttatttgacacaccaggcatggcagggagagtttgatttctatgtggatgagcgcgtaatcatacctcgttcttttatttatgaattgttgggtgacggacttcgtccttggatagaatacgatgagttggtgcataatgctttggatctttgcaccggaagcggttgccttgccattcagatggcgcatcattatcctgatgcccaaattgatgcggttgatgtgagcttggatgctttggaagtggcagggattaatgtcgaagattatggtttggaagaacgcatccggcttattcatacggatttgtttgaaggattggaaggcacttatgatttgattgtttccaatcctccttatgtggatgcggaatcggttgagttattgcctgaagagtatttgcacgaaccggaattggcattgggcagcggggcggacgggttggatgccaccaggcagattcttctgaatgcggcaaagtttctgaatcccaaaggtgtattgctggtggaaatcgggcataacagggatgtattggaagcagcgtatccggagttgccttttacttggttggaaaccagcgggggcgacggttttgttttcctcttgacgcgcgagcagttattgggtgaagagtga

SEQ ID NO: 5712 - DNA, 594 bp, Neisseria meningitidis
atggccgacggtatgggcaatctgattggctgggaaaaaacggggcttgttgtcggtaagcagtggataaccgcaaaagacgacaaggtgtccgatgtctgcaatgccaacggcgagatgggcgtaatcgggctttacgagcctttctcacacggcgcattgacgatacccggtcatccgaactgccgatgcgaggttgtttccgtatcgggtggcgaattgggggaatttgccgaaaaaaaggagcttcgtaaagcggctatgcagtatgcgcgggataactttatcggcaaaagctatgtcaataaaaacagcgggcatgaactgaaggtaacttggcaaggtgtgaaacacgctgcgtcaaaggcaaatcaggcggaattatccatcatgacaaaacttgatgacttattgcgctacgcaaaatatgagggttcttattcggataggaaaggtcatcctaatattattgcagcacataagtatcgtgccgttgccaaggttgggaatgagtctttaaatatcggtgtgattgtaagggaatttccagacgaccataaacattacgaccatttcatcttgaaggatgaataa

SEQ ID NO: 5713 - DNA, 618 bp, Neisseria meningitidis
ttggtcccacgccttcccatcccgaacaggaccgtgaaacgactcagcgccgatgatagtgtggttcttccatgcgaaagtaggtcactgccaaacacccattcagaaaacccccgattattcgggggtttttgctttgcccggaaaaaatgtttgctttgcccggaaaaaatgtcggtgatggcgggacggcatccgtacggtgtccggtcgggtttgcggaggaacggcttgaaactttgggatattcattttagaatgactcgttttatcgtcgcaagatgcggtttattgtttgcaacccttaaaggaaaaaccatgaagaaaatgttcgtgctgttctgtatgctgttctcctgcgccttctcccttgcggcggtaaacatcaatgcggcttcgcagcaggagttggaggcgctgccgggcataggcccggcgaaggcgaaggccattgcggaataccgtgcgcaaaacggtgcgttcaagtctgtagacgatttgaccaaggtaaagggcatcggccctgcggtgctggcgaagctgaaggaccaggcttcggtcggcgcgcccgcaccaaaagccccagccaaaccggtgctgcccgcggataaaaaatag

SEQ ID NO: 5714 - DNA, 1185 bp, Neisseria meningitidis
atgggcaaacatattcttttaggtgtaacgggcagtattgcggcgtataagtcttgcgagttggtgcgactgctgaaaaaacaggggcattcggttacggtggttatgagccgctcggcaactgaatttgtttctccgctgacttttcaggctttaagcggcaatcctgtcctgaccgacacgcacggcggcaacggttcaaacggtatggaacatatcaacctgacccggaatgcggatgtttttctgattgcgccggcaagtatgaataccgtggcaaaaatctgtaacggcgtggcagataacctactgaccagtctggcagccgcacggaaatgtccgcttgccatcgcgcccgcgatgaatgtggaaatgtggctcaaccctgccaaccaacggaatatcgcacaactggtttcagacggcattactgtctatatgccgggcttgggcgaacaggcttgcggagaaaatggtatgggaaggatgccggaacctgccgaattgctggatctgcttccggatttatggacaccgaaaattttaaagggcaaaaaagtcttgattaccgcaggtgcgacatttgaagccattgaccctgtccgaggcatcacaaatatctccagcgggaaaatgggcgtggctttggcgcgggcgtgccgtgccgccggtgcagaagtcagcctgattcacggacagcttcaaaccgcgctgcctttcggcatatccgatacggttcaagccgtcagtgccgaaaatatgcatcgcgcagtgcatcgtttaatcgacaaacaagatgcttttatttctgttgccgccgtctcagactatagggttaagaataggagtactcaaaaattcaaaaaagataaaaatgccaaaccgttatccatcgaattggatgagaaccccgatattttggcttctattgcctcattaccgaacccgccgttctgcatcggttttgccgctgaaacggagaatgtaatgacatatgcgcgggaaaaacgtattaagaaaaagctaccgatgatcgttgccaatgatgtttcaatcgcaatgggcaaaccgaccaaccggattaccattatcggggacgacggggaactgtcttttcccgaaacaagtaaagatgaagcggcaatgcggattgttgaaaggcttgccgtatatttgagcaaataa

SEQ ID NO: 5715 - DNA, 2157 bp, Neisseria meningitidis
atgcccgccccccaaccttccgccccttacgaccccctgaccgccgaagcgcgtgccctgcttttccataccgcctcctacctcaagcccgaggaacaggcggagcttgaaaaagctgtcgcctatgcgtttcgcgcccacgacgggcaaacccgcaaaagcggggagccctacatcacgcatccgattgccgttgcgacgcagctcgccctttggcatatggacatacagggtctttgtgcaggcgtgatgcacgacgtattggaagatacgggcgtgacaaaaggggaaatggcggcggtgttcggcaatacgattgccgagatggtggacggtctgtccaagcttgaaaaactcaaatttgaagatcatgcggagcatcaggcggagagtttccgcaaactgattttggcaatgaccaaagatgtgcgcgtgattgtcgtcaaacttgccgaccgcctgcacaatatgcggacgctcggttcgatgcgcccggacaaacgccgccggattgcaagggaaacccttgaaatctatgcacagattgccaaccgtataggtttgaataacgcatatcaagagcttcaggatttatcgttccaaaacctgcatcccaaccgctacgagactttaaaaaaagcgatggacaagagccggaagaaccggcaggacgttgtcggcaaagtcttgcgcgcattcggccagcggctggtaggcgcgaatatagaggccaaaatcaaaggcagggaaaaaaacctgtacggcatccatcagaaaatgatggcgaaaaagctgcgctttgccgaggttatggatatttacggtttccgcgtcattgtcaacagcattccagcctgttatgccgcactcggcgcattgcacaccctctatcagcccaagcccgggcggttcaaagactatatcgccattccgaaaagcaacgggtatcaaagtctgcatacgactttggtcggcccttacggcttgccgattgaagttcagatacgtaccaaggaaatggatgctgttgccgaaggtggaatcgccggacattggagctataaatcatattctaagacggtcgatcaggcggtgcttcacacaaaccggtggctgaaaaatatcttagatttgcaggcaagcagtgccaatgccattgagtttctcgaacacgtcaaagtcgatttgtttccgaacgaaatctacatccttacgccaaaaggaaaaatcctaactttgcccaaaggggcaacgcctgtcgattttgcttatgcggtgcataccgatatcgggcacaaaaccgttgccgcacgtatcaacaatatcatgatgccgttgcgtacgaagctcaaaaccggtgattctgttgaaattatcacatccgaacacgccaaacccaatcccgcgtggttgaatttcgccgtgtcaggcagggcgcgcagcgccatacgccaatatattaaaaaccttaaccggcacgatgcggtcgttttgggagagagcctcttacaaaaagccctgtccagtttgctgcccaaagatgtcctgctttcagacggcatcaaggaaaaatatcttgccgatctcaacgacaagcagacatcgtttgaagaagtgctgtacaacgtagggatggggcataccctgcctgtttatgtcgccatgcacattgccgagttggcaggggagcatttcggcagcgaggtcaggctcagttccattaaagtcgatgggcaggaaagcgggcatattcattttgcagagtgctgccaccctgttcccggcgattccatccgtttgctgttggttaagggaaaaggcatgattatccatagggatacctgcccgacgttgttgaagtccgatcccgaacagcagctggatgcagactgggaaaatatgaacgggcagaactaccgtgtcgggcttcaagtccaatcggaagacagccacggcctgttggcattaatggcgcaagcgatttccgattccggtgcagacattgagtcggtcgaaacaccgtctaaatcccagtcgggaacggaaggttttgtcgaattcaaattcttattgaaagtcaagaatctgaatcaattgaatcagattattcaaaatctgcatagtattccatatatccgcaaagtcatcagaagttga

SEQ ID NO: 5716 - DNA, 207 bp, Neisseria meningitidis
atggcacgtattaccaccgaagactgtaccggaaaaatttccaaccattttgacctgacattggtagcggctcgccgcgcccgccagcttgagaacggcaacacgccgcttgtggacgatgtccgcaataacaaaccgaccgttaccgccttaagggaaatcgccgccggacatatcggtacagaactgttgacgcgcaataaataa

SEQ ID NO: 5717 - DNA, 618 bp, Neisseria meningitidis
atgtccgcttatcgaaaaggcaacatctttatcatttcggccgcttccggcacgggcaaaaccacgctggtgtcgcggctgttggcaaaccataacggtttgcgcgtttccgtgtcgcacacgacgcgcccgccgcgtgaaggcgaagcaaacggcgtacattatcactttgtttccaaagaagagtttgagtcgcttatcgcgcaggaagcttttttggaatacgccgacgtatttggcaactattacggcacaggcgcggagggtgtgaatgcgttggcggcggcaggctatgacgtgattttggaaatcgacgttcagggcgcggcgcaggttcgcgacgcgctgcccgaagccgtcggcatctttatcctgccgccttctttcgacgtacttgccgcgcgcctcaacggacgcgggacggacagtcgggaagttatccaaaggaggctgtcgaaggcaaggcatgaaatcgagcagtccgtattgtttgactttgtcgtggtcaatgacgacttggcgcgagcggaggaggatttgcgccatattgtgaatgcctgccgtctgaaaaggtcgcggcaactggggtttattgcagatttgttggaaaattcctag

SEQ ID NO: 5718 - DNA, 567 bp, Neisseria meningitidis
atgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 5719 - DNA, 789 bp, Neisseria meningitidis
atgaatcctaaaatcgtgtttttcgacattgacgatacgctgtaccgaaaatatacggatactttgcgcccttccgtgaaaacggcggtggcggctttgcgcggcaaaggtatattgacggcgttggcaacggggcggtctttggcgacgattcccgaaaaggtcagggatatgatggcggaagcgggaatggatgccgtggtaacgataaacggacagtttgcgctgctgcacggaaaaaccgtgcgcgaagtaccgatggatgccggtttgatgggcagggtttgcgcgcatttggatggcttgggcatggattatgcgtttgtcggcggagaggggatcgctgtgtccgcgctgtcggaatgcgtgtgccgcgccttgaagcatatcgccagcgatttttttgccgataaggattatttttcaagcaaaccggtgtatcagatgctggtgtttgcggaggaaaacgaaatgccgctttggtcggatattgtggaacgggaaggcttgaaaacggtgcgctggcacgaggaagcggtcgatctgctgcctgcgggtgcgtcgaaaacggacggcatcagaagcgtggttgaagcattgggatgggaaatggcagacgtgatggcgttcggcgacggtttgaacgatgtggaaatgctgtcagaagtcgggttcggcgtggcaatgggcaacggggaacaggcggcgaaagaagcggcgaaatatgtttgccccagcgttgatgaagacggcgtgttgaggggcttgcaagatttgggcgtgatttga

SEQ ID NO: 5720 - DNA, 1356 bp, Neisseria meningitidis
atgaaagcacccgaactcttattgcccgccggcggattggaaagaatgcgcgccgcctacgactacggcgcagacgccgtttacgccggcagcccgcgttactcactgcgcgcccgcaacaacgaatttgccaaacttgatgttttagaacaaggcattaaagaagcgcacgagcgcaacaaaaaattctttttaaccgtcaacaccctgccgcacaattccaaactcaaaaccttcgttgccgacatggagccgctgattgccatgaaacccgacgcgctgattatggcggatccgggtttgattatgaccgtgcgcgaaaaatggccggaaatgccgatccatctgtccgtacaggcgaacaccaccaactattggggcgtgaaattctggcaaaacatcggcgtcgaacgcattattctgtcgcgcgaattgagtatggaagaaatcgccgaaatccgccaagaatgccccgacatcgaactcgaagtcttcatccacggcgcattgtgcatcgcttattcaggccgttgcctattgtcgggctatttcaaccaccgcgaccccaaccaaggcacctgcaccaactcctgccgttgggattacaaggttcacaatgccacggaaagcgatgcaggcgatgcccagcttctgcaaggtttcaactttgaaaaagcccaagaagaagccaaccaaaactttgaaggcatcaacggtcaaaaacgccatccctacgccgacaaagttttcctgattgaagaatccaaccgcccgggcgaaatgatgccgattatggaagacgaacacggcacctacatcatgaattccaaagaccttcgcggtatcgaagtcgtcgaaaaactcgccaaaatcggcgtggacagcctcaaagtcgaaggccgtaccaaatcgctctattatgttgcacgcgtcgcccagtcctaccgcaaagcgattgatgatgccgtcgcaggccgtccgtttgattacagcctgttgagcgaactcgaaggcctcgccaaccgcggctacaccagcggcttcctcgaacgccaccaaactcaggattatcaaaactacctgaccggccattccaccgccaaacaaagccaatacgtcggacacgttaccgaaatcgatgaaaacggctgggcaacagtggaagtcaaaaaccgctttgccgtcagcgattcactcgaaatcatccacccgagcggcaaccaaaccatcaaattggaacaaatgacccgcaaaggccagcctgtcgatgttgccccgggcaacggcattcaggtcaaaatccccaatatgcagggtaaagaaaaagccctcatcgcacgcgtgttgaacccctaa

SEQ ID NO: 5721 - DNA, 387 bp, Neisseria meningitidis
gtgagaaagattctgcttgatacccatgcgttgctgtggtggttgttggatgacaagaaactggggatatctgcacgcaaactgatagaaaatccgagaaatgcgatctttgtcagtgcagcaagtatttgggaaatttccatcaagcagaacaaggggttgttgaaattaccggaagagttttttgatgtgcttcaagaagaggattttgaaatgttgcctataggtctgtttcatgcaaaacaggctggaagccttccggagatacacaaagaccctttcgataggatgttgattgcacaaacccaagcggaaggctttgaactgatgactgtcgatgaatatattccgcaatatggaattagagttgtcaacgcatcaagctga

SEQ ID NO: 5722 - DNA, 249 bp, Neisseria meningitidis
atgtttcaagcaaatattcatcaggcaaaaaccaatttgagtcaattgattcaaagagcagaagcaggggaaatcgttattattgcgaaggcaggtaagccttgcgtccaactaatcggtattgaaaaaccggcacgaaatgcaggaaggttgaaaaaattcagtcatatggaaaatacggatatttcacgtattcttgaggatgacaatgaaacggcagctttattttttgaggagtcggctctgtga

SEQ ID NO: 5723 - DNA, 207 bp, Neisseria meningitidis
atgccgtctgaaaaatgtttcagacggcattttttggttgccgatatgttaacggacgacgttggcgcgcatgaccacgcggacgtggaacgagcctgcctgacagtcgtattgtccgccttgcagcggctgcttgtcgaagtagctgtggaagccggtaacgccgcgtccgcaagggtggcggcagatgccgcattgtgtttataa

SEQ ID NO: 5724 - DNA, 2376 bp, Neisseria meningitidis
atgaaaccattacaaatgctccctatcgccgcgctggtcggcagtattttcggcaatccggtcttggcagcagatgaagctgcaactgaaaccacacccgttaaggcagagataaaagcagtgcgcgttaaaggtcagcgcaatgcgcctgcggctgtggaacgcgtcaaccttaaccgtatcaaacaagaaatgatacgcgacaataaagacttggtgcgctattccaccgatgtcggcttgagcgacagcggccgccatcaaaaaggctttgctgttcgcggcgtggaaggcaaccgtgtcggcgtgagcatagacggtgtaaacctgcctgattctgaagaaaactcgctgtacgcccgttatggcaacttcaacagctcgcgtttgtctatcgaccccgaactcgtgcgcaacatcgaaatcgtgaagggcgcagactctttcaataccggcagtggtgcattgggcggcggtgtgaattaccaaacgctgcaaggccgtgatttgctgttggacgacaggcaattcggcgtgatgatgaaaaacggttacagcacgcgtaaccgtgaatggacaaatactctcggtttcggtgtgagtaacgaccgcgtggatgctgctttgctgtattcgcaacgtcgcggtcatgaaaccgaaagtgcgggaaaccgaggctatgctgtggaaggggaaggcagtggcgcgaatatccgtggttcggcacgcggtatccctgattcgtccaaacacaaataccacagctttttgggtaagattgcttaccaaattaacgataaccaccgcatcggcgcatcgcttaacggccagcagggacataattacacggttgaagagtcttataacctgaccgcttcttcctggcgcgaagccgatgacgtaaacagacggcgcaatgccaacctcttttacgaatggatgcctgattcaaattggttgtcgtctttgaaggcggacttcgattatcagaaaaccaaagtggcggcggttaacaacaaaggctcgttcccgatggattattccacctggacgcgcaactataatcagaaggatttggacgaaatatacaaccgcagcatggacacccgattcaaacgttttactttgcgtttggacagccatccgttgcaactcgggggggggcgacaccgcctgtcgtttaaaactttcgtcagccgccgtgattttgaaaacctaaaccgcgacgattattacttcagcggccgtgttgttcgaaccaccagcagtatccagcatccggtgaaaaccaccaactacggtttctcactgtctgaccaaattcaatggaacgacgtgttcagtagccgcgcaggtatccgttacgaccacaccaaaatgacgcctcaggaattgaatgccgagtgtcatgcttgtgacaaaacaccacctgcagccaacacttataaaggctggagcggttttgtcggcttggcggcgcaactgaatcaggcttggcgtgtcggttacgacattacttccggctaccgtgtccccaatgcgtccgaagtgtatttcacttacaaccacggttcgggtaattggctgcccaatcccaacctgaaagccgagcgcagcaccacccacaccctgtctctgcaaggccgcagcgaaaaaggcatgctggatgccaacctgtatcaaagcaattaccgcaatttcctgtctgaagagcagaagctgaccaccagcggcactcccggctgtactgaggaaaatgcttactacggtatatgcagcgacccctacaaagaaaaactggattggcagatgaaaaatatcgacaaggccagaatccgcggtatcgagctgacaggccgtctgaatgtggacaaagtagcgtcttttgttcctgagggttggaaactgttcggctcgctgggttatgcgaaaagcaaactgtcgggcgacaacagcctgctgtccacacagccgctgaaagtgattgccggtatcgactatgaaagtccgagcgaaaaatggggcgtattctcccgcctgacctatctaggcgcgaaaaaggtcaaagacgcgcaatacaccgtttatgaaaacaagggctggggtacgcctttgcagaaaaaggtaaaagattacccgtggctgaacaagtcggcttatgtgtttgatatgtacggcttctacaaaccggctaaaaacctgactttgcgtgcaggcgtgtacaacctgttcaaccgcaaatacaccacttgggattccctgcgcggtttatatagctacagcaccaccaatgcggtcgaccgcgatggcaaaggcttagaccgctaccgcgccccaggccgcaattacgccgtatcgctggaatggaagttttaa

SEQ ID NO: 5725 - DNA, 630 bp, Neisseria meningitidis
atgagtgaaaccgaaaatcaagcattgacatttgccaaacgcttgaaggcggataccacggcggttcacgacagcgtggataacctcgttatgtctgtccaaccgtttgtcagcaaagaaaactacatcaaatttttgaaactccaatccgttttccacaaggctgtcgaccacatctataaagatgccgaattaaacaaagccattcccgagctggaatacatggcgcgatacgatgccgtaacgcaagaccttgcagatttgggtgacaaaccttacgaatacggcaaaccgctgccgcatgaaaccggcaacaaagcaatcggctggctttattgcgccgaaggatccaatttgggcgcggcatttttgttcaaacacgcccaaaaactcgattacaacggcgaacacggcgcgcgccacctcgcaccccatcccgacgggcgcggcaaacactggcgcgctttcgtcgagcatctgaacgctttgaacctgactcccgaagccgaagcggaagccatccaaggcgcgcgcgaagcctttgcattctacaaagtcgtgttgcgcgaaaccttcggcttggcagccgatgccgaagcaccggaaggaatgatgccgcacaggcactaa

SEQ ID NO: 5726 - DNA, 1512 bp, Neisseria meningitidis
atgtttttaagcaggtattttactattctttacagaatcgggattttatcaaatgggttcggcagtcggcggacaaccgctcaaaaaatatttttgccggacaccaagggtttgttcatactgccgaacctgccggttttgcatcctgattgggtgtatcgccttttttcctttataatgccgccacttatatttgccactttcccgatgaagccgtttgccgaaaatatcccccacagccttcgcggcaactgctgcgacgaagccctgccgccgcatacggtagattgtccggaatgcggctgccgcgcggatgtaccccggttggacagtggagaagcggcgttctgtccccgttgcggacacaaactcttcagggtgggcaggcatcctttttccgccccgcccgcctatgcggcggcttcgctgattttaatggcgtttgcttacggtatgacgtatatcgaggtcgggataccgggtgcggcatccgtcctttcgctgcccgagatgatgcgcctgatggtgtttcaggattatggttttttggccgaagtgatgtttgtgctgactttcggcgcgccggttctgtttctgctgctgtgcctgtatgtctatgccgcgctgatacggaaacaggcgtatcctgcgctgcgtttggcaacgcgtgtgatggtgcgcttgagacaggcgatgatggtggatgtgttttttgtttccactttggtggcgtatatcaagctctcgtctgtggcagaggttcgcttcgggccggcgttttatctgatgttcgcgctgtcagttatgctgattcggacttcggtatcggttccccagcattgggtgtattttcaaatcgggcggctgacgggggataatgcggttcagacggcatcggaaggtaaaacctgttgcagccgctgcctgtatttccgcgacagtgccgaatccccctgcggcgtgtgcggtgcggaactgtaccgccgacggccgaaaagtctgagtatttcgtcggcgtttctgacggcggcggttattttgtatttccctgccaatatcctgccgattatgatttcgtccaatcctgccgccacggaggtcaataccatccttaacggcatcgcttatatgtgggacgagggcgacaggctgattgcggcggttattttcagcgcgagtattttggtgccggtactgaagattgcggcaatgtcggttttgattgcgtccgcccgcttcgctttgccaacgggtgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattctgacgatgctgtccgcctattatttcgacccgcgcctgctttgggacaaacgcgcttcagacggcattgctttcaatgaaacggaaaaacatgactga

SEQ ID NO: 5727 - DNA, 1662 bp, Neisseria meningitidis; identical to SEQ ID NO: 1615

SEQ ID NO: 5728 - DNA, 519 bp, Neisseria meningitidis; identical to SEQ ID NO: 3245

SEQ ID NO: 5729 - DNA, 552 bp, Neisseria meningitidis
gtgaactattgcgaatttgccgcctcacttcccgaaaacaccgataacccgaacaaacattaccacgacacgcaatacggttttccgattgaggacgacaatgaattgtttgagcggctggtgttggaaatcaatcaggcaggattaaactggacgctgatgctgaagaagcggcaggcgtttcagacggcatttgaaggtttcgacatcgatacggttgccgccttcgacgacaccgaccgcgaacgcctgcttgccgacgcgggcattgtccgcaaccgcctgaaaatcgatgccgccattttcaatgcacggcaaatccaagcgttgcaacaagaatacggctcgttcaagaactggctcgacacgcaccatccgcgaagcaaagacgaatgggttaaactctttaaaaaacatttcaaattcgtcggcggcgaaatcgtcggcgaatttctgatgagtaccggctacctcaaaggcgcgcacgccgaaagctgtccggtttaccgtgaaaccctgaaataccacccgaaatggctcgatgccatctga

SEQ ID NO: 5730 - DNA, 642 bp, Neisseria meningitidis
atgccatctgaaaaaccaatgaacagaagaaccttcctcctcggcgcaggcgcgttgctgcttaccgcctgcggcagaaaatccgcccgaacccacgccaaaattcccgaaggaagcaccgtacttgccttgggcgattcgcttaccttcggctacggcgcaaaccctggcgaatcctaccccgcgcaactgcaaaaactgacgggttggaatattgtcaacggcggcgtatcgggcgatacatctgcccaagccctgtcgcgcctgcccgcgctgttggcacgcaaacccaagcttgtgattgtcggcataggcggcaacgactttctgcgcaaagttcccaaggagcagacccgcgccaatatcgcgaaaatcatcgaaaccgtgcagaaggaaaacatccccgccgtcctcgtcggcgtgccgcacatcacactgggtgcgttgttcgggcatttgagcgatcatccgctgtatgaggatttgtccgaggaatacggcattccgctgttcggcggcgcgtgggcggaaattttgggcgataataatctgaaatccgaccaaatccacgccaacggcaaaggctatcggaaatttgccgaagatttgaatcaatttttgagaaaacaggggtttagataa

SEQ ID NO: 5731 - DNA, 309 bp, Neisseria meningitidis
atggaatattgcgaacctgaagaagcatccgacccgtacgcaacatacaggcgtgccaacctgatggcgggtctgccgctgtttgtcgtgattttggttctgctcaatattgtttttccgcttccggcgcatcccttagcttggctggtgcctgcaggtttcatggttttgggcggcggctttcccttatcgctgccgcttgtggcgctgcttgtcctgacctgctgcattctggcgcattgtccgccattatcccgtcttttgtgctacccttgcccgaatcatccgatgtctaaaaattctgcctga

SEQ ID NO: 5732 - DNA, 2852 bp, Neisseria meningitidis
atgaaactgtccgaactgttcaaccccgacgaatttgccgcgcggcatttgagttttggcgacgaagcggcgttgcttgccgctgtcggcgagaaaagtatggacgattttgtcggcaacaccgtgccgcaaagcatccgtatgccgtctgaactcgatttgcccgatgccctgaccgaagcggacgcgttggcaaaattgaaaggcattgcgtcgaaaaacatgatcaacaaatcctatatcggtttaggctattacccgacccgcgtgccgaacgtgattttgcgtaacgtattggaaaatccgggttggtacaccgcctacacgccgtatcaggcggaaatcgcgcaggtcgtttggaagctttgttgaacttccaacaagtgtgtatcgatttgaccggtttccctgtggcgggcgcgtctttgctggacgaagcgaccgccgccgccgaagcgatggcgatggcgcaccgcgtgggcaaggtaaaatccgagcgtttctttgtggacgagcgcgtgtatccgcaaactttggacgtgatgaaaacccgtgccaagtatttcggcttcgagctggtggtcggcgattttgcccaagccgacgaaggcgaatacttcggcgcgctgttccaatacgtcggcaaagacggcgacgtgcaagacttgcaggacgttatcggccgtctgaaagccaaaggcacgattgtcgccgtttccgccgacatcatgagcttggttttgctgaaaccgcctgccgaattgggtgcggatattgcgttgggcaacacacaacgcttcggcgtgccgatgggcttcggcgggccgcacgccgcttatttcgcgtttaaagacgagttcaaacgttccgccccgggccgcatcatcggcgtatccaaagacgcatcgggcaaacctgccttgcgcatggctttgtccacccgtgagcaacacatccgccgcgaaaaagctacatccaatatttgtaccgcgcaggcattgctggcgaatttggcgggtatgtatgccgtttaccacggccctgaaggcgtgaaacgcattgccaaccgcattcacgcgctggcttctgcctttgccgatgcgctggtttcagacggcctgaatgtggttcacaaagtctttttcgatactgttaccatcgattttggcagtaaagagaaagcagaccaagtgtttgccgctgctttggcgtcgggttacaacctgcgccgcgtcaacgatactcaagttgcggctgcattccatgaaacatcggcatacgaagatttggtcgatttgtaccgcgcgtttaccggcaaggatacgtttacatttgccgatgatgtcaaaggccgtctgaacgccgaattgctgcgtcaggacgacattctgcaacatcctgtgttcaacagttaccacaccgaacacgaaatgttgcgttatctgaaaaaactcgaagaccgcgacttggcgatgaaccgcagtatgatttcattgggcagctgtactatgaaactcaacgcgactgcggaaatgttgccgattacttgggccgagttcaccgacatccatccttacgctcccgaagcgcaaaccgccggctaccgcgaattgctcgccgatatggaaaacagcctgaaagccatcaccggctttgacgcgatttccctgcaaccaaattccggcgcacaaggcgaatacaccggtatgctcgccatccgccgctatcaggaatcccaaggcgaagcgcaccgcaacatctgtctgattccaaaatcagcccacggtaccaaccccgccaccgccgccatgctcggtttgaaagtcgtcgtcgtcgacaccgacgaacacggcaacgtcaacattgacgatttgaaagccaaagccgagcaacaccgcgacgctttgtctgccatcatgattacctatccgtccacccacggcgtgtacgaagaaggcatccgcgacatctgccgcattattcacgaaaacggcggacaggtttacatggacggtgcgaacctcaacgcccaaatcggcatcatgcagcctgccgaagtcggtgcggatgtgttgcacatgaacctgcacaaaaccttctgtatccctcacggcggcggcggcccgggcatgggtccgattggcttgaaagcccatttggctccgtttgccccgggccataccttgaccgacacccacaacgcggctgccgatcaaaccgccgtggctgccgcagcatatggttctgcatccatcctgccgattacttggatgtacctgaccatgatgggcaaacaaggcatggaacaggcaacgcgctgggcattgctcaacgccaactacgtcgccaaagccttgggcgaggattatccgattctctacaccggcaaaaacggccgcgtcgcgcacgaatgtatcgtcgacttgcgtccgctcaaagccgaaagcggcattaccgaaaccgacatcgccaaacgcctgatggactacggcttccacgccccgaccgtctccttccccgttgccggcacgctgatgatcgaaccgaccgaaagcgagagcaaagccgaactcgaccgcttcatcgccgccctgaaacaaatcaaacaggaagtgctgaaagtcgggcgcggcgaatggccgaaagacgacaacccactggtcaacgcgccgcacaccgccgcagatataaccggcaactgggcgcatccgtattcccgcgaagaagccgtcttcccgttgccgttcgtccgcgaacacaagttttggcccttcgtcaaccgcgtggacgacgtgtacggcgaccgcaatctcgtgtgcagctgcccaccgatggaaaattatgaagactga

SEQ ID NO: 5733 - DNA, 840 bp, Neisseria meningitidis
atgaaacaactccgcgacaacaaagcccaaggctctgcactgtttacccttgtgagcggtatcgttattgttattgcagtcctttatttcctgattaagctggcgggcagcggctcgttcggcgatgtcgatgccactacggaagcagcaacgcagacccgtatccagcctgtcggacaattgacgatgggcgacggcatccccgtcggcgaacgccaaggcgaacagattttcggcaaaatctgtatccaatgccacgcggcggacagcaatgtgccgaacgctccgaaactggaacacaacggcgattgggcaccgcgtatcgcgcaaggcttcgataccttgttccaacacgcgctgaacggctttaacgccatgcctgcaaaaggcggtgcggcagacctgaccgatcaggaacttaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaaggcggcaatgcaggtttgagcgatgacgaagtcaaagcggctgttgactatatggcaaaccaatccggtgcaaaattctaa

SEQ ID NO: 5734 - DNA, 1194 bp, Neisseria meningitidis
atgtaccgacacatcgaatactatcctggcgacccgattttgagtttggtcgaaaccttcaaaaacgacccgcgccccgaaaaagtcaatttgagcataggcatttatttcgacgacgaaggcaaaatgcccgtgttggaatccgtgagccgagccgaaaccgcccgtgccgccgcgcctgcgccgtcgccctacctgccgatggaaggcttggacacttaccgcagcgcggtgcagcatttattgttcggcaaagacaatcccgcgcttgcgcaagggcgcatcgttaccgtacaaaccttgggcggctcgggcgcgctcaaagtcggggcggacttcctgcaccgctggtttcccgaagcgcgcgcctacgtcagcgacccgacttgggacaaccatcgcggcatttttgaaggcgcaggtttcgaggtcggcacttacccatattacgaccctgccactgtcggcgtgaaattcgacgaaatgaccgcgtttttcaacaccctgcccgaaaacagcgtcctgatcctccatccctgctgccacaacccgaccggcgtggatatgtcggaacggcaatgggacgaagtgttgcacatcatcaaaacgcgcaaactgattccgtttatggacattgcctaccaaggattcggcggcgatttggacagcgatgcctacgccgtccgcaaagcggtggaaatggaattgcccttgttcgtcagcaattccttctcaaaaaacctgtcgctctacggcgagcgcgtcggcggcttaagcgtggtttgcccgaataaggaagaagcggatttggtgttcggacagctcaaattcaccgtccgccgcatctactccagcccgcccgcgcacggcgcgtatatcgccgccgacgtgatgaacagccccgaactttacgccttgtggcaaaacgaggtttatatgatgcgcgaccgcatccgtgcgatgcggcagaaactttatgatgtcttaactgcgcaaatccccaatcgcgatttcacttatttcatcaaacagcgcggcatgttcggctacacaggattgagcgtggaacaagtccgcaggctgcgcgacgaatttgccgtttacctgctggattccggcaggatgtgcgtcgccggactgaatacgtcgaataccgactatgttgcccgcgcatttgcggaagtcttgaaataa

SEQ ID NO: 5735 - DNA, 1089 bp, Neisseria meningitidis
atgaatgactacacgcagcagcttcaaggtaaaaaagactaccttaaaaccctttttgcaggtttggatgttcctgagtgggaagtgtacgaatctccggacaaacattaccgtatgcgtgccgagttccgtatttggcacgaaggcggggaaatgttttatgccatgtttgaaaaagggcagaaagccagcggcgcaagcatgatacgctgcgaccgttttgaagcagcttccgaggctgtcaaccgcctcatgcccgagctgatcgccgccgccgcgcaatcccccgaactcaaaaaacgctggtatgccgtcgaatttctgtccacgctcagcggggaaatgctggttaccatgatttaccacaaaaggcttgatgctgagtggatgcaggcggcgcaagcgttacagcaacagttggatatttccgttattgggcggagcaggggacagaaaatagtcttaaaacaggactatgtaacggaaactttgaaggtcggcaaccgggatttccgttatcggcaaattgaaggcagttttacccaaccgaatgccgccgtgtgtcagaaaatgcttgaatgggcgtgccgcacggcggaaggcttgggcagcgacctgctcgaactgtattgcggaaacggcaatttcaccctgccgctgtcccgatatttccgacaggttttggcaaccgaaatctccaaaacctccgtcagcgcggcgcaatggaatatcgaagccaaccgcatcggcaacatcaaaatcgcccgtctgtctgctgaagaatttaccgaagcctataccggaaaacgtgagtttaaacgccttaaggatggcggtattgctttgacggattacgcattttccactattttcgtcgatccgccgcgtgccggtatcgatgaggaaactttgaagctggtgtcgcagtttgacaacatcatctacatttcctgcaatcccgaaacgttgcgcgccaatttggacaccttggcggaaacccatgcggtcgaacgtgccgccctgttcgaccaattcccgtttacgcaccatatcgaaagtggtgtattgttgaaaaagaaaatcctttga

SEQ ID NO: 5736 - DNA, 1101 bp, Neisseria meningitidis
atggcaggcaacactttcggacaactcttcaccgttaccaccttcggcgaaagccacggcgcgggtttgggctgtatcatcgacggctgcccgcccggcttggaattaagcgaagcggatatccaatttgacctcgaccgacgcaaacccggcaccagccgccacgttacccaacgccgcgaagccgaccaagtcgaaatcctctccggcgtattcgaaggcaaaaccaccggcacgcccatcgccctcttaatccgcaataccgaccagcgcagcaaagactacggcaacatcgccaccagcttccgccccggccacgccgactatacctattggcacaaatacggcacgcgcgactaccgcggcggcggcaggagctccgcccgtgaaaccgccgcccgcgttgctgccggagccgttgccaaaaaatggttgaaagaaaaattcggcacggaaatcaccgcctacgttacccaagtcggcgaaaaagaaatccggtttgaaggctgcgaacacatttcccaaaatcctttttttgccgccaaccatagccaaattgccgagctggaaaactatatggacagcgtgcgcaaatccttggattccgtcggcgcgaagctgcatatcgaagcagccaatgtccctgtcggcttgggcgaacctgtttttgaccgcctcgatgccgaaatcgcctacgcgatgatgggcatcaacgccgtcaaaggcgtggaaatcggcgcaggttttgacagcgtaacgcaacgcggcagcgaacacggcgacgaactgaccccgcaaggcttcctgtccaaccactcaggcggcatcctcggcggcatcagcaccgggcaagacatccgcgtcaatatcgccatcaaacccaccagctccatcgccaccccgcgccgcagtatcgacatcaacggcaaccccatcgaactcgccacgcacggcaggcacgacccctgcgtcggactgcgctccgcgccgatcgccgaagccatgctcgcgttagtcctcatcgaccacgccctgcgccatcgcgcgcaaaatgccgacgttcaggttaatacgcccgacattaccctttcaaacaaataa

SEQ ID NO: 5737 - DNA, 426 bp, Neisseria meningitidis
atgacacaagaaaccgctttgggcgcggcactaaaatccgccgtccaaactatgagcaaaaagaaacagaccgaaatgatcgccgaccacatctacggcaaatacgatgtattcaaacgcttcaaaccgttggcgctcggcatcgatcaggatttgattgccgctttgccgcaatacgatgccgcactgattgcacgcgtcctcgccaaccactgccgccgtccgcgctatctgaaagccttggcgcgcggaggcaaacgtttcgatttgaacaaccgtttcaaaggcgaagttacccccgaagaacaggcgatcgcgcaaaaccatccttttgtgcagcaggctttgcaacagcagtccgcccaagctgccgccgaaacgctgtctgttgaagccgaagcagccgaatcttccgcagcagaataa

SEQ ID NO: 5738 - DNA, 1986 bp, Neisseria meningitidis
atggctaaaaacaaccaatacagcgaatccagcatcaccgtcctcaaaggcttggagccggtcaaagaacgtcccggtatgtacacccgcaccgacagcccgacccatatctgccaagaagtcatcgacaacgcgtcggatgaagcgttgggcggtttcgcgactgcaatcgacgtgcaaattcatgaagacggttcgctttccgtgcacgacaatgggcgcggcattcccgtcggcctgcatcccgaagaaggcgtatccgtagtcgaactcgtattcacccgtctgcacgcaggcggcaagttcaacaaaaaagacggaggcagcgcgtatgccttttcaggcggcctgcacggcgtgggcgtatccgtcaccaacgccctttccacccgccttgaagtaacggtcaaacgcgaaggcaaaatccaccgcatcgtgtttgccggcggcgacgtggtcgaaccgttggcacaagtgggcaaatgcgccgtcaaagacagcggtacagaagtgcgcgtctggccggacggcaaatattttgaaagcccgaattacagcattcccgaactcgaacgcctgctgcgtgccaaagccgtgctgctgccgggtgtgcgcgtttccctgacccgtccggtcaaaggcgaagacgaagcgcacacccaaacctggcattaccccgacggcctgaaaagctatctgaccgacctgattgccgacgcgcaggaagccgtaccgctgttctcttgcgaaaactacatttcagacgaacacaacggcgatttcagcatcggcgaaggagcggcgtttgccctgacttggctggaagaaggctcgtgcgccaacgaaagctacgtcaacctcatccccaccccgctgggcggcacgcacgaagcaggcttgaaacaagccgtgttcaacgcagtcaacaacttcatcaatctgcacaacctcttgccgcgcggcgttaaagtgcaaagcgacgacgtgttcggaaaaaccgccttcgttctctctgcccgcgtcctcgacccgcagttccaaggtcaaaccaaagacaagctgaccaaccgcgacgcgctgaaactcgtcgccaccgtatcgggcgaccctttggaattgtggctgaaccaaaacgtggacttcggcaaaaaaatcgccgaactcgccatccgccaagcacaggcgcggatgcgttcggttaaaaagattgaaaagaaaaaaggcagcggcgtcgccgtcctgcccggtaagctgaccgactgcgaaagcgaagacatccgcgaaaacgaactcttcctcgtcgaaggcgattccgccggcggctcagccaaactcgcccgcgacaaagccacccaagccatcctgcccctgcgcggcaaagtgctcaacagctttgaagtccaccccgaccaactcttcggcaacgccgaaatccacgacatttccgtcgccatcggcgtcgatccgcacggtattaacgaccatcccgatttaagcggcctgcgctacggcaaaatcgccatcctgtccgatgccgacgtggacggctcgcatattcaagttttgctgctgaccctgttctaccgccacttcccgaaactggttgccgacggacacatctacgtcgcccagccgccactgttccgcgtcgatgtcaacgcacaaggtaagagcaaacctgcccgcaaattctacgccctcgaccaaaacgaactcgacagcattttggagcggctgcaaaaagaaggcgttaaagaaaccgcctattccatcagccgtttcaaaggcttgggcgagatgaaccccgaccagctcaaagatactaccatgcaccccgacacccgccgcctgttgcaggtacaaatcccagaaggtgcagatgacgagacgcgcgacatcttcgtcaaactgatgggcaaaggcgaagccgccgcccgccgcgcttggatggaacgcgaaggcgatacggcggaattggatatttga

SEQ ID NO: 5739 - DNA, 525 bp, Neisseria meningitidis
gtgttggacagggaaggctatcgccccaatgtcggtatcatcttaatcaacaaccgcaacgaagtcttttggggtaagcgcgtgcgcgaacattcttggcagtttccgcaaggcggcatcaagccgggcgaaagccccgaaaccgccatgtaccgcgagttgtacgaagaagtcgggcttttgccgcaacacgtcaaaattatcggccgcacgcgcgactggctgcgttatgacgtgccgaacaactgggtacgccgcgaatggcgcggctcttatcgcggacagaagcagatttggtatctcctgcgcctgaccggccgagattgcgatgtcaacctgcgcgccacccgccaccccgaatttgacggctggcgttggcatcaatattgggcacccgttgacgaagtgattgatttcaaacgcgacgtttatttgggggcgttgaaagaactctcttcccgcttcctgcgcggtatggaaagttatgaagactttgccgcccgccaatcttccgacaaccgctaa

SEQ ID NO: 5740 - DNA, 1296 bp, Neisseria meningitidis
atgttagatatccaattgctccgcagcaacaccgccgccgttgccgaacggcttgcacggcgcggttatgactttgataccgcacgttttgacacactggaagaacgacgcaagtccgttcaggtgaaaaccgaagaattacaggcctcgcgcaacagcatttccaaacaaatcggcgcactgaaaggtcagggcaaacacgaagaagcgcaggcggccatgaatcaggttgcccaaatcaaaaccgatttggaacaggctgccgccgatttggatgccgttcaaaaagaattggacgcatggttgttgagcatacctaacctgccgcacgaaagcgtacctgccggtaaagacgaaaccgaaaacgtcgaagtccgcaaagtcggcaccccgcgcgaatttgactttgaaatcaaagaccatgtcgatttgggcgaacctttgggtttggattttgaaggcggtgcaaaactctccggcgcacgatttaccgtgatgcgcggacaaatcgcccgtctgcaccgcgccttggcacagttcatgctggatacgcacacgctgcaacacggctacaccgagcattacacgccttatatcgttgacgatacgacgctgcaaggtacgggccaactaccaaaatttgcggaagatctgttccacgttacccgtggcggcgacgaaaccaaaaccacccaatacctgattccgacagccgaagttaccctgaccaataccgttgccgacagcattatcccgtccgaacaactgccgctgaagctgaccgcgcattcgccctgtttccgcagcgaggcgggttcgtacggcaaagacacgcgcggtctgattcgccagcaccagttcgacaaagtggaaatggttcaaatcgttcatcccgaaaaatcatacgaaacgctggaagaaatggtcggccatgccgaaaacatcctgaaggctttggaactgccctaccgcgtgattaccctgtgtaccggcgacatgggcttcggcgcggcaaaaacgtatgacttggaagtttgggtgccggcgcaaaatacctaccgcgaaatctcaagctgctccaactgcgaagatttccaagcccgccgcctgaaggcgcgtttcaaagacgaaaacggcaaaaaccgcttggtacatactttgaacggctccggcttggctgtcggcagaacgctggtcgccgtattggaaaaccatcaaaacgccgacggcagcatcaacatccctgccgcactgcaaccgtatatgggcggtgttgccaagttggaagtcaaataa

SEQ ID NO: 5741 - DNA, 999 bp, Neisseria meningitidis
atgaagattgcgatttacggtacgaaaagctatgaccgcgaacattttacccgcgccaaccggcatttcggcttcgagctggagttttttgattttatgctggatgcgaaaacggcgaaaatggcggaaggcgcggaagcggtctgtatttttgtaaacgacgacggcagccggcccgtgttggaaaaattggcgcaaattggcgtgaaaactgtggcgttgcgttgtgccggcttcaataatgtggatttaaaggcggctgaagagttgggcttgaaagtcgtgcgcgtgcctgcctattcgcccgaatcggttgcggaacatacggtcggtctgatgctgacgttgaaccgccgtatccacaaagcctatcagcgtacccgcgatgcgaatttttcgctggaaggtctgaccggtttcaatatgtacggcaaaacggcgggcgttatcggcacggggaaaatcggtattgcaaccatgcggattttaaagggtttcggcatgaacctgctggcttacgatccgttttgcaaccccgaagcggaaaaaatcggcggcaaatatgtggatttagacgagctgtatgcccggtcggacatcatcacgctgcattgccccgccacgccggaaaaccactatatgctgaacgaagcggcgttcgacaaaatgaaagacggcgtgatgattatcaacaccagccggggcgggctgattgacagtgccgccgcgattgaggcgttgaaacgccggaaaatcggcgcattgggcatggatgtgtacgagaacgagcgcgagctgttttttgaagacaaatccaacgatgtgattaccgacgacgtgttccgccgcctgtcgtcttgtcataatgtgctgtttaccggccatcaggcatttttgacggaagaggcgttgggtaatatttcggaagttacgctgtccaatatccgcgaggtcggacagaccggcgattgcggcaatgcggttcgtgccgacggctga

SEQ ID NO: 5742 - DNA, 1077 bp, Neisseria meningitidis
atgaagccgtctatcttagaaaaactacaacaactcagcgaccgactggaagaagttacccaccttctcggacagcccgaagccacgtccgacatggacaactaccgcaagctcacgcgcgaacacgccgaactgacccccgtcgtcgaagtgttccaaaactatcggcttgcccaaagcgacttggcggatgccgaagaaatgttgtccgaccccgaaatgaaagactttgccgccgaagaaatcgaagcggccaaagccaaaatcggcgaactcgataccgaactgcaaaaactgctgctgcccaaagatgccgacgacgacaaaaacatcttcatcgaaatacgcgccggaacgggcggcgacgaagccgcgctgtttgccggcgatttgctgcgtatgtacagccgctacgccgagcgcaaccgttggcaggttgaaatcgtgtccgccaacgaaagcgaattgggcggctataaagaagtcatcgcccgtattgtcggactcggggcgtacagccgtttgaaatttgaatcgggcggacaccgcgtgcagcgcgtccccgccaccgaaagccaaggccgcatccacacctccgcctgcaccgttgccgtcatgcccgaagcggacgaactggaagacatcgaactgaacccagccgacctgcgcatcgacaccttccgcgcatccggcgcgggcggtcagcacatcaacaaaaccgactccgccgtccgcatcacccacctgcccaccggcatggtggtcgaatgccaagacggccgcagccaacatgccaacaaagcgcaggcaatgaaagtcctcgccgcccgcctgaacgacgcgcaaaaacgcgaagcccaagccaaagaagccgccgagcgcaaatccctcatcggcagcggcgaccgcagcgaacgcatccgcacctacaactatccccaaggccgcgtaaccgaccaccgcatcaaccttaccctgcacaagctggattttgtgatggacggcgacttggaagaaatcaccaatgccctgattgccgagcatcaggccgagcttctggcggcaatgggcgattga

SEQ ID NO: 5743 - DNA, 771 bp, Neisseria meningitidis
atgaacttcaccgacacccactgccatctcgctgatcccgccctgcgcgaaaacctgccgcacatcctgaccgcagcgcggaaagttggggtgaagcggtttatcgttcccgcgacgcgcccgcaggattggcaggacgtggcggatttggcggaaatgccgtccgaacacggtcaaatccgtattgcactgggcattcatccttggttttcagacggcattgccgagcgggatttcgtccgcctggaaacgatgttggcacattatccgcaggcatgggtcggcgaaatcggcttggatttttacgataaaacccaaacgtcgcagcagcgcgaacggcaaattcaagttttcgtccgccagcttgaaattgcgcaaaccctgcgccgccgcgtgattatccataatctcaaagccaccgccgacatcgccgccgccgtcaaacagacaggctttgcccaaggcggcatcgttcacgccttctccggcagcgcggaagaagcgcgtgtgttgacgaaactgggtttcaaaatcggcatcggttcgctgctgctcaatccgaacgcgcgtaaagtgcgcgatacgcttaaagccttgaacgacggggatttcgtattggaaacggatagcccgtttatgctgaaaaaagagattaatacgcctgccaatattccgggtattgcaaagattgctgcggaaatccgcggaacctgtgtagaagagattgcaaaggtaacggagcgcaatgccgatgccctgttgggacggtag

SEQ ID NO: 5744 - DNA, 1002 bp, Neisseria meningitidis
atgatgtccatgaaacaaaaaatcttcgtcctctacacaggcggcaccataggcatgacccaaagcagcgaaggcctgcgccccgataccgcactggttagccaagccctttcccccttttcagacggcctcgatttcgagtggcacgtctgcaatcccttgattgattcctcctccgttacgctgcaacactggcgcgattggctggacatcattgccgacaaactcccttcatgcgacggcatcctgatactgcacggcacggacagcatggcgtacaccgccaatctcctcgcgctcgctctgcaaggtttgggcaaaccgattgtcctgactggttcccaatggccttacgccgccgaaaacagcgatgccccgcgcaacctctccaccgccgttgccgccttcagcctcaagctcaaacaaaccgtcatcgcgtttgacggcaaactgtatcccgccgtcggcagcagcaaagtcagcaccgaaactgctgcaggcttcgacaatccgcatttcggcacgcttgccgaatgggacgaaacccggggttggcacaatcttcgcctcccgtcccaagacgcagcagccgtttcagacggcctcaaaatccgttatcccgacccgcaggcaaaaatcgctgtccgcacgcttatccccggctttgccgtccaagaacttgcggacggactcggacagcttcccgcccaagctcttatcctgcaaagctacggacacggcaacacgcccgcagacgaaggttttatccgcgccgtccgagacttcgcgcggcagggcaaactgctgctcaacatcagccaagtccgacaaggcaaaaccgccgccgtttacgcgcaaggcaacgcgttccgcaactcgggcatcatcaacggcggcaaatgcaacctcgaaaccgccaccgcgctgatgaccctcgccgtatcgcaaggctggggtaaggaagatgtttacaaagaattggtaagactaaagttagtgtga

SEQ ID NO: 5745 - DNA, 684 bp, Neisseria meningitidis; identical to SEQ ID NO: 721

SEQ ID NO: 5746 - DNA, 1335 bp, Neisseria meningitidis
atggcaaaaaaatatttcggcacggacggcgtgcgcggcgaagtggggcaatttccgattacgcccgatttcgtattgaaactcggctatgcggcggggcaggttttggtgcagcacgacaccgaccagaaaccgaccgtcctcatcggcaaagacacgcgcatttccggctatatgctggaagccgctttggtggccggttttacggcggcgggtgtgaatgtggtacagaccggaccgctgcccacgcccggcgtggcttatctgacccgcgcgttgcgcctgtccgccggcgtgatgatttccgcgtcgcacaacgcctattccgacaacggcatcaaattcttcgccgaaggcggcgtgaaactttccgatgaagtcgagttggaaatcgaagccaaaatcgacggcgaaatgaaaacccaaccgtccgcccgtctcggtcgcgcacgccgcatcagcggtgcggacgaccgctatatcgaattttgcaaatccacctttcccagccattccgaccttcggggtttgaagttggttgtcgataccgccaacggcgcggggtacggtgtcgcccccaaggtgtttcacgaactgggcgcacaggtcgtcagcatcggcaacgaacccaacggctacaacatcaacgaaaaatgcggtgcgacttataccaagacactccaggccgccgttttacagcatgaagccgactacggcatcgccttagacggcgacggcgaccgcctgatgatggtcgataaaaacgggcaggtttacgacggcgacagcctgatttacgtcattgccaaagcccgcgcccgagaaggtatcaacatcggcggcgtggtcggcacggtcatgaccaatatggcgatggaaatcgccctgaaagagcagggcgtggatttctgccgcgccaaagtcggcgaccgctatgtgttggaacagctgaaccaacgcggctggctcatcggcggcgaagccagcggccatattttgtgtatggacaaacacaacaccggcgacggcattatttccgcgctgcaagttttggcggcactgcaaacgctgaaccaagacctcgccaccgtttgcgccgattggcagccgtatccgcaaacgatgattaacgtgcgcatccaaaaaggtcagcaatggcaggaagcttcgaaagacgtgttggcggaagtggaaaaagaactcgaaggcaaagggcgtgtcgtgttgcgcgcttcgggaaccgaacccgtcgtgcgcgtgatggtggaggcgcggcaggcggattgggcgcgcgaaggggcggaacgcattgccgccgccatcggcggcatttag

SEQ ID NO: 5747 - DNA, 858 bp, Neisseria meningitidis
atggcacgacacgtttggcaggcaggacggtttgaaatcggtttggacaaaccgaaaatcatgggcatcgtgaatctcacacccgattctttttccgacggcggcgtgtattcgcaaaacgcccaaacagccttggcacatgccgaacagcttctaaaagaaggcgcagacattctcgacatcggcggcgaatcgacgcggtcgggtgcggattatgtttcgcctgaagaagaatgggcgcgggttgagcctgttttggcggaagtggcggggtggggcgttcccatcagtttggacacgcgccgcacggtgattatggaaaaagcgttggcactcggcggcatcgatattattaatgatgtggcggcgttgaatgacgagggcgcggtcgaattgctggcgcgtcaggcggacacgggcatttgcctgatgcacatgcagggtttgcccaaaaccatgcagattaatccgaaatatcaagatgttgtcggtgaagtagcgcggtatttgaaagcgcgctcagcggaatgtatcgcggcaggcatcgcaccgcaacgcatcatactcgaccccggcttcggctccggcttcggcaaacccttgcaacacaatatcgcgctgatgcggcatttgcccgaattgatggcggaaacaggttttccgctgctcatcggcgtatcgcgcaaaagcacgataggcgagctgaccggcgaggcaaatgcggcggaacgcgtacacggcagcgtggcggcagcgttggcttccgtagcgcgcggcgcgcaaatcgtgcgggtgcatgatgtgaaggcgacagcggatgcgttgaaggtgtgggaagcgttgggcatcaatctgtaa

SEQ ID NO: 5748 - DNA, 894 bp, Neisseria meningitidis
atgattattgtcatgagcaggcgtgccgccgaagcggacattgccggcgttgtcgcctttatccgcagcagaggtctgcgagaacacatttctcacggcgacgagcgtactgtcatcggcgcaatcggcgacgatagggttttgagcgtcagggaggtgcagacgctgccggaggtcgagaaagccgtccgcattttggatacatggaaaaccgtcagtcgggaaaatcgggcggaagacagccgcgttgccgccaaaggcgtggctttcggcggcggggaaaccgtccgtatcgccgcagaaccgtcagtatggcgcaatgcggatgcagtgtttctggatccgtttttcacttcggcaaacttatacgacacttcaagtgcggatgaagggcggggacggtgcagacggttggcggaacagaccgcatcggcgcatgatgcagggaaacccgtattggtgcgcgtccgcaacgtccgccatgtcgaagcggctttgaatgcgggggcggacatcctgtatttgggcggcgggctgatgtccgatcttgccgtattgaatgaagccggaaacctgaacattcccttggtgctgtgtaaagacaagcaccattctgccgaagattggttgaatgccgcagaatatgtcgtctcgcgcggcaaccgccacctgattctgggcgagtcgggcgtattgaaccataccaaaggccatccctaccgtttggatgtcgaatccatcgtgaaagtccgccaaatcagccatctgcccgtgattgcgaatattacgggattatggaaccgcgatatgccgcaggaaatcctgtacggcttggcaaaggcggcaggcgcgtgcggaatcgtcggaacctgttttgaaaagtcgggcggatag

SEQ ID NO: 5749 - DNA, 2115 bp, Neisseria meningitidis
atggatttattatcggttttccacaaataccgtctgaaatatgcggtggccgtgctgacgatactgcttttggcggcagtcgggctgcacgcttccgtatatcgcaccttcacgcctgaaaacatccgcagccgcctacaacaaagcattgcacacacacaccggaaaatctcgtttgatgcggacattcagcgcaggctcctgccccggccgaccgtcatcctgaaaaacctgaccattaccgaacccggcggcgaccagactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcaaacggcatcggcccgcccgaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccccgcgctggcactcaggaacaacagcattaaaattgaaaccgtcaacggcgcatttaccgccggcggcgaatatgcccgatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggcacggtggacaaaccgtccattaccgtcgattacggcaggctgaccggcggcatcaattcgcgcaaagagaaacagaaaatcctcgaagacaccctgctggaacaatggcagtggctcaaacctaaagaaccgtaa

SEQ ID NO: 5750 - DNA, 1485 bp, Neisseria meningitidis
atgaatatgaaatacaaagacctgcgcgacttcatcgccatgctcgagcagcagggcaaactcaagcgcgtcgcacaccccatttccccgtatttggaaatgaccgaaatcgccgaccgcgtgctgcgtgccgaagggccggcgttgctgtttgaaaacccgattaagcccgacggtacgcgctacggttatcccgtgttggcaaacctgttcggcacgcccgaacgtgtggcgatgggcatgggcgcggacagcgtgtccaagctgcgtgaaattgggcagacgctggcgtatttgaaagaacccgaaccgcccaaaggcatcaaagatgcgttttccaaactgccgctgctgaaagacatttggagcatggcgccgaacgtggtgaaaaacgcgccgtgtcaggaaatcgtgtgggaaggcgaagacgttgatttgtatcaacttccgattcagcattgctggccggaagacgttgcgccgctggtaacgtggggcttgaccgtcacgcgcgggccgcacaaaaaacgccaaaatctcggcatttaccgccaacaactcatcggcaaaaacaagctgattatgcgttggctgtcgcatcgcggcggcgcgttggattatcaggagttccgcaaactcaatcccgatacgccgtatcccgtcgccgtcgtactcggctgcgaccccgccaccattttgggcgcggtaacgcctgttcccgataccttgagcgaataccagtttgccggactgctgcgcggttcgcggacggagctggtgaaatgtatcggcaacgatttgcaagtgcctgcccgcgcagaaatcgtgttggaaggcgtcatccatccgaacgaaaccgcgttggaaggcccgtacggcgaccacaccggctattacaacgagcaggattatttccctgtgtttacggtcgaacgcatcaccatgcgcgaaaacccgatttaccattcgacctacacgggcaaaccgcccgatgaacccgccgttttgggcgtggcgttgaacgaagtgttcgtaccgcttttgcaaaagcagttccccgaaatcaccgatttctacctgccgcccgaaggctgctcctaccgcatggcggtggtgagcatgaaaaaacagtacgccggacacgccaagcgcgtgatgatgggctgctggtcgttcctgcgccagtttatgtataccaaattcatcatcgtggtggatgacgatgtgaacgtgcgcgactggaaagaagtcatctgggcggtcaccacgcgcatggaccccgtgcgcgacactgttttggtagaaaacacgcccatcgattatctcgacttcgccagccccgtcagcggactcggcggcaaaatgggtttggatgcgaccaacaaatggccgggagaaaccgaccgcgaatggggacgcgtcatcaaaaaagaccctgcggttacggctaagattgatgggatttgggaggaattggggttgtag

SEQ ID NO: 5751 - DNA, 981 bp, Neisseria meningitidis
atggagttgcaacaaaggacgttgaccatcgggttgggtaacgacattgcagtgcagaccgaaggtgtcggtttcataagggggcagctggttgcagatcatgccgaaataaacagcgttttcaaggttgtcgtaaaagcggctttgatagtcgttaaaactcttttcgctgacggatacccacacgccatattccagcgtttcctcatgcccgataatcggaatcggcagcaccgcgcggataaagcggtcggtttggtcgggatagcggatgatgcagaaatcagaatcgcattctgcttgataagcaatgcgttcttcttcactgagttgattatagggatcgggtgcggtaaagccgattgcgggcatttcttcgtggttttcgccgcaggaagtgcaagtgtacataaggtttcagactttcaaaacgagtttgcggtaaagccattcgccggcaaacagcatccccatcaatacataggcaatcacgccggtataaaccgcccaccaatcatatcgccccaaccgtgccaacaaagcggcaagcgtcccgttgattataaaaaatacgcaccaaacctgcgttacccggcgggtatagcgcacggctttttcaggcaggtcgggctgttgcagccgcgcaagtttttcaatcaccgtctgcccggcaaacaggctgccgccgaacaccgccaacatcatcagattgacgaggacgggataccaatacatcgaatcatgccgcccgaacaccaatactgcggcaaaaaacagtgtaataaacaaagccgcataacgctgttggggcagtttggcagtcagggcgcgcagcagccacaacccgcacatcgccgccgccagccaaacaaaccagcccgcctccctgccgtatatagtggattaacaaaaaccagtacagcgttgcctcgccttgccgtactgtctgcggcttcgtcgccttgtcctgatttttgttaa

SEQ ID NO: 5752 - DNA, 246 bp, Neisseria meningitidis
atgaccgaacaagaaatctaccggttgttgcgcgataccctgaccgagttgtttgaaatcgaaccggaacggattacgcctgataccaatctttacgaagatttggaaatcgacagcatcgatgccatcgacctgattgaccgcatcaagcgcgaaaccggccgcaagctgcaggccgaagatttccgcaatgtccgcaccgtcaacgacgtggtacaggcggtattgaagattcaggcgggctaa

SEQ ID NO: 5753 - DNA, 261 bp, Neisseria meningitidis
atgaacgacttggaaaaccaaatcaaacaactgattatcgacagtttggctttggaggatataaccgccgccgacatcggcagcgaagacgcgctgttcggcgacggagggctgggactggattccgtcgatgcgctggaattgggcttggcggtgcaaaaacatttcggtttccgattggacggcgagcaggagaacttgcgcgaacattttgccaatgtcaaaacactcgccgcctttgtcaaaagccgccaagcataa

SEQ ID NO: 5754 - DNA, 759 bp, Neisseria meningitidis
atggataaattggattattgccgccgtttttttgcgacttggttaggatttgtgattttcggtgtcggcggcattatgatgaaattggttttgttgccttatactttgaacggcacttcagggtctgtcgcccgccaattggcggcgcgccggattatcggaacatcttggcgtttgttcgttgcttatctgaaatggtcgggcgtgttggaggtatcgttcaagggtgttgaaaaactcaaccgcccgggacagttgattttggcaaaccatccgtctttgctggatgtggtgctgcttgtcggccatgtgcccgaaatgaactgtatcgtgaaaaaagatttgcagcacaatccggcaatgagcagccagattaaaggtgcgggctatattccgaacgaagagtcggaagcaatgctggaaacggtaaaggcggtttttgacagcgggcagagcctgctggtgttccccgaaggaacgaggacggggtgggacggacgggtaaaaatgcaccggggcgcggtttctttgggactgcggtatgccgaagtgattacgcccgtatgtatcaaaatgaatccgcccaattttaaaaaggggcagccgtggtaccgcatccccccgaaaaggatacggtatgaaattaccgtcggagacgacatcctcccccaagactggctcgccgagaaaccgttgccgattgcggcgcggcggctgaatgaatatctgcaggactattttacaaggaaaaccatatga

SEQ ID NO: 5755 - DNA, 366 bp, Neisseria meningitidis
atgagcgagcagacggcattggccgtgtgtgccgacggtgtggaaacggcattggcggaagcggcatcactgttggaagagggatgcgggtcggttttggttttggcggcggacgatccgctgccggaaggatatgccgtatcggcgactcgcgcgccgtttgcttatgctttggcgatggttctgaccaaagggacgcgttacagcctgactttgtctgcttcggacgatatgccgtctgaagccggtatgctgcccgaggcatattggagcggtttggaatgggtgcgctttctgctgaacggcagtcgagaatgccgccgggtatatcgcaatcgtgaatggctgtggcagcggaatggataa

SEQ ID NO: 5756 - DNA, 366 bp, Neisseria meningitidis
atgggcggaggcaatgtcccaagccgcgtcgcataccaaacgcgccgccttactcaaacggcggcgctgcatagcgggcaggaacggcaattccggcctgacatcgggcaaaccgtcggcaaaatccggacattccgcccattttgcccactgggccatatcgcgcattttgctgcccgaaacccgccaggcggcgatgtcgaagtggaaccggcaaataatcgacggcatagtttctttcaaaaatttacactgtgccgcattctaaccaaagcctatccccctgacaatgccgaaattcaaacgcatttctgccccctttctccgacaacgccgcccctcggaaaaccgccagaattagcctga

SEQ ID NO: 5757 - DNA, 501 bp, Neisseria meningitidis
atggacacactgccagaatgcccgattaccaacaccgcctccctgctgccgcacagcgggcgtatggttctgatagaccgcattacccgatacggcgatgattttgtcgaagcaggggcacaggtaagccccaatcacatccttttacttgacgacaaactgccctacacggcatttatcgaactgatggcacaggctgtcggcgcgtatgccggtatccaagcccgaaaaaacgcacggtcggtccggctcggcttcctgctcggcacgcgcaaacttgaaatcttcgcccaatccgtcccaatcggcacgcatctgctggcaacggcgcatatgtctattcaggatgccgggggtatgggcgtgtttgactgcgaactgcgttggacagacgcgccggaaacttcgtccgaaacactcccttcagacggcattttggcgcgcgcctcactcaacgtgtacagccccgaacaccctgccggaacaaccgatgccgtctga

SEQ ID NO: 5758 - DNA, 729 bp, Neisseria meningitidis
atgaccgaaactgtcctgattaccggctccaacaggggcataggcaaagccgtcgcattcggtttggcggaagacggctttgatatcgctgtccactgccgcagtcgccgcgacgaagccgaagccgtggcggaagaaatccgcgctttgggcagaaatgcgcgcgtgttgcagtttgacgtgtccgaccgcgaagcctgccgcgagattctgaccgccgacatcgaagcaaacggcgcgtattacggcgtggtgttgaacgccggactgacgcgcgacaataccttccccgcgttttcagatgacgattgggatgtggtgctgcggactaatttggacggtttttacaatgtattgcatccgctggttatgccgatgatacgccgccgcaaagccggacggattgtgtgtatggcatcagtgtccggcctgacgggcaaccgcgggcaggtcaattacagcgcgtcaaaagcaggcattatcggcgcggcaaaagccttggcggtcgaactggcgaaacgcaaaatcaccgtcaactgtgtcgcgccgggtctcatcgataccgatattatcgatgagaacgtacctgtcgaagaaatcttaaaggctgtccccgcagcgcttatggggctgccggaagaagtggcgcacgcggtgcgtttcctgatggatgaaaaagcggcgtacatcacgcgccaggtgattgcggtgaacggaggtttgtgttga

SEQ ID NO: 5759 - DNA, 1251 bp, Neisseria meningitidis
gtgttgaataccagaagggtcgcagtaacaggcataggcggcattaccgccttcggccgggattggcaaagcatacaggcagcattcaaagccgaaaaaaacgccgtcaaatatatggattggcacgaacgtttccccgaattggaagcgcaactgggtgcgccgattgaaaattacgcgccgccgaaacattggacgcgcaagcagctcagaagtatggggcgcgtgtcgtacctgtgcgtcgatgcggcggagcaggcgctggcggatgccggtttgctcggggacgaaagcattaccgacggacggatgggcgttgcctgcggctcttccagcggcagcaccaaagacatcggcgatgtgggcgaattgttgctgaccggcacgtcgcgcaacttcagcgccaacacctatgtgcgtatgatgccgcacaccaccgccgccaatatcggcatctttttcgggctgaaagggcgcatcatcccgacatcgagcgcgtgttcgtccggcagccaaggcataggttatgcctacgaagccatcaaatacggtctgaccgatatgatgctggcgggcggaggcgaagaatttttcccgtccgaagtgtatgttttcgactcgctttatgccgccagccgccgcaacggcgaaccggaaaaaaccccgcgcccatacgacgcgaaccgcgacgggctggtcatcggcgaaggcgcggggattttcgtgctggaagaattggaacacgccaaacggcgcggtgcgataatttacgccgaactcgtcggctacggagccaacagcgatgcctaccatatttccacgccccgccccgacgcgcaaggcgcaatccttgcctttcagacggcattgcaacacgcaaaccttgcacccgaagacatcggctggattaatctgcacggcaccgggacgcaccacaacgacaatatggaaagccgcgccgttgcagcggttttcggcaacaatacgccctgcacgtccaccaagccgcaaaccggacacacgctgggcgcggcggacgcaatcgaagccgcgttcgcgtggggcattgccgaccggcaaagcaatcccgaaggaaaacttccgccccggctttgggacgggcagaacgaccccaacctgcccgccatcaacctgaccggcagcggcagccgctgggaaaccgaaaaacgcattaccgccagctcgtcgtttgccttcggaggaagcaactgcgtcttaatcatcggatga

SEQ ID NO: 5760 - DNA, 759 bp, Neisseria meningitidis
atgaaaaaagtcagcgtattgattgttgccaaaaacgaagcaaaccacattcaggaatgtattgaaagttgccgtttcgataaagaagttatcgttatcgacgactacagcaccgacaatactgccgaaattgccgagggtttgggcgcaaaagtcttcagacggcatttgaatggggatttcggagcgcaaaaaacatttgccatcgaacaggcaggcggagaatgggttttcctgattgatgcagacgaacgctgcacgccggaactatctgatgaaatctcaaaaattgtccaaaccggcgattatgccgcctattttgtcgaacgccgcaaccttttccccaaccatcccgccacacacggcgcgatgcgtcccgacagcgtatgccgtctgatgccgaaaaaagacagttcggtgcaaggcaaagtacacgaaaccgtacaaaccccctaccccaaacgccgtctgaagcattttatgtaccattacacgtacgacaactgggaacaatatttcaacaagttcaacaaatatacttccatttcagccgaaaaataccgagagcagggaaagcccgtgcgtttcgttagggacattatcctccgcccgatttgggggtttttcaaaatttatatcctgaacaaagggtttcttgatggaaaaatgggttggattatgtccgtcaaccacagctattacacgatgattaaatatgtcaaactatattatctgtacaaatccggcggaaaattttaa

SEQ ID NO: 5761 - DNA, 1065 bp, Neisseria meningitidis
atggaaaaagaattcaggatattaaatatcgtatcggccaagatttggggtggaggcgaacaatatgtctatgatgtttcaaaagcattggggcttcggggctgcacaatgtttaccgccgtcaataaaaataatgaattgatgcacaggcgattttccgaagtttcttccgttttcacaacgcgccttcacacgctcaacgggctgttttcgctctacgcacttacccgctttatccggaaaaaccgcatttcccacctgatgatacacaccggcaaaattgccgccttatccatacttttgaaaaaactgaccggggtgcgcctgatatttgtcaaacataatgtcgtcgccaacaaaaccgatttttaccaccgcctgatacagaaaaacacagaccgctttatttgcgtttcccgtctggtttacgatgtgcaaaccgccgacaatccctttaaagaaaaataccggattgttcataacggtatcgataccggccgtttccctccctctcaagaaaaacccgacagccgtttttttaccgtcgcctacgccggcaggatcagtccagaaaaaggattggaaaacctgattgaagcctgtgtgatactgcatcggaaatatcctcaaatcaggctcaaattggcaggggacggacatccggattatatgtgccgcctgaagcgggacgtatctgcttcaggagcagaaccatttgtttcttttgaagggtttaccgaaaaacttgcttcgttttaccgccaaagcgatgtcgtggttttgcccagcctcgtcccggaggcattcggtttgtcattatgcgaggcgatgtactgccgaacggcggtgatttccaatactttgggggcgcaaaaggaaattgtcgaacatcatcaatcggggattctgctggacaggctgacacctgaatctttggcggacgaaatcgaacgcctcgtcttgaaccctgaaacgaaaaacgcactggcaacggcagctcatcaatgcgtcgccgcccgttttaccatcaaccataccgccgacaaattattggatgcaatataa

SEQ ID NO: 5762 - DNA, 171 bp, Neisseria meningitidis
atgcaacaaaccactaaattatattcgttcattggaaagaaacaccccgaattcatccttcaaaataagaaaatcccaatatcccccgatattacgcagcctattggcaaagttttgcagcgtcttccccggcttgtgctgccgcgtcaagtgctttgttacaatgtatag

SEQ ID NO: 5763 - DNA, 1338 bp, Neisseria meningitidis
atgagtaaccatacttcttggtcgtccaaaatcggtttcgtccttgctgcggcaggttcggccatcggtttgggcgcgatttggaaatttccttatacggcaggcaccaacggcggcgcggtgtttttcctgctgtttttgatatttactatcttggtcgccctacccgttcagcttgccgaattttatatcgggcgcacgggcggtaaaaatgccgtcgattccttcagggttctgcgtccgggcacgcaatggctttgggtcgggcgtatgggcgttgccgcctgctttattttgctgtcgttttacagcgtggtcggcggatgggtattaaattatgtcgtccacagttttacgggggcggttcataccggcgcggactttgaagccttgttcggcgcgacgatttccaatccggcaggttcgctgtcctatcaggcactgtttatgctgattacggtttgggtggtcaaaggcggcatttcagacggcattgaaaaggcaaaccgttatctgatgccggggctgtttatcctctttattgcgctggcaatccgttcgctgacgctgccgggtgcaatggagggcgtgtctttcctgctcaaaccgaattggtcgtactttaaagccgatacgatgattacggctttaggccaggcgttttttgccctgagcatcggcgtttccgccatgattacctacgcttcatatttgggaaaagatcaggatatgttccgttccggccatacgattatgtggatgaacctcttggtttcgctgcttgccggcctggtgatttttccggcggtgttcgccttcggttttgaaccgagccaggggccgggattgatttttatcgtattgcccgcagtgtttatgaagatgccgttcggtacggttttgtttgcggtatttatgctgctggtcgttttcgccacgctgacttcggcattttcgatgttggaaacggtcattgcctcaaccatccgccaagacgagcgcaaacgcaaaaaacacacttggcttatcggcacggccattttcattatcggcatcccgtccgcgctgtctttcggcgtatggggcgagtttaaggttttcggcaaaaccatttttgatttgtgggactatgttatttccgccgtcattatgccgattggtgctttgagtgtttccatctttaccgcctggattcaggacaagcagtctgtgttaaaagatgccggcgcgggcagcaccgtaccacgggcagtgctgctgctgtggctgaataccttgcgctaccttgccccgattgccattattattgttttcatcaattctttggacatcctttaa

SEQ ID NO: 5764 - skipped

SEQ ID NO: 5765 - DNA, 795 bp, Neisseria meningitidis
atgaaagcctatttggacttgatgcgccacgtcctcgacaacggtacggacaaatcagaccgcaccggtacgggtacgcgctccgtattcggttatcagatgcgttttgacttgggcaaaggttttccgctgctgacgaccaaaaagctgcatctgcgttcgattatccacgagctgctttggtttctcaaaggcgataccaatatcaaatacctaaaggacaacaatgtttccatttgggacgagtgggcggacgaaaacggcgacttaggcccggtttacggctaccagtggcgtaactggcccgcgcccgacggcaggcatatcgaccaaatcgccaatgtgctggaacaaatcaagaagaatcccgactcgcgccgcctgattgtatcggcgtggaatccggctttggtcgatgaaatggccttgccgccctgccacgcgctgtttcagttttacgttgccgacggcaaactgtcctgccagctttaccagcgtagtgcagatattttccttggtgtgccgtttaatattgccagctacgcattgttgaccatgatgatggcgcaagtgtgcggattggaggcgggcgagtttgtccatacgtttggcgacgcgcatttgtaccgcaaccatttcgagcaggccgcattgcagttggaacgcgaaccgcgcgccttgccagtgatgaaaatcaatcctgaagtcaaagatttgttttccttcaagtttgaagatttcgagttggaaggttacgaccctcatccgcatatcaaggcggcagtgtcggtttag

SEQ ID NO: 5766 - DNA, 1335 bp, Neisseria meningitidis
atgactgacctgaacaccctgtttgccaacctcaaacaacgcaatcccaatcaggagccgttccatcaggcggttgaagaagtcttcatgagtctcgatccgtttttggcaaaaaatccgaaatacacccagcaaagcctgctggaacgcatcgtcgaacccgaacgcgtcgtgatgttccgcgtaacctggcaggacgataaagggcaagtccaagtcaaccggggctaccgcgtgcaaatgagttccgccatcggtccttacaaaggcggcctgcgcttccatccgaccgtcgatttgggcgtattgaaattcctcgcttttgaacaagtgttcaaaaacgccttgaccaccctgcctatgggcggcggcaaaggcggttccgacttcgaccccaaaggcaaatccgatgccgaagtaatgcgcttctgccaagcctttatgaccgaactctaccgccacatcggcgcggacaccgatgttccggccggcgacatcggcgtaggcgggcgcgaaatcggctacctgttcggacaatacaaaaaaatccgcaacgagttttcttccgtcctgaccggcaaaggtttggaatggggcggcagcctcatccgtcccgaagcgaccggctacggctgcgtctatttcgcccaagcgatgctgcaaacccgcaacgatagttttgaaggcaaacgcgtcctgatttccggctccggcaatgtggcgcaatacgccgccgaaaaagccatccaactgggtgcgaaagtactgaccgtttccgactccaacggcttcgtcctcttccccgacagcggtatgaccgaagcgcaactcgccgccttgatcgaattgaaagaagtccgccgcgaacgcgttgccacctacgccaaagagcaaggtctgcaatactttgaaaaacaaaaaccgtggggcgtcgccgccgaaatcgccctgccctgcgcgacccagaacgaattggacgaagaagccgccaaaaccctgttggcaaacggctgctacgtcgttgccgaaggtgcgaatatgccgtcgactttgggcgcggtcgagcaatttatcaaagccggcatcctctacgccccgggaaaagcctccaatgccggcggcgtggcaacttcaggtttggaaatgagccaaaacgccatccgcctgtcttggactcgtgaagaagtcgaccaacgcctgttcggcatcatgcaaagcatccacgaatcctgtctgaaatacggcaaagtcggcgacacagtaaactacgtcaatggtgcgaacattgccggtttcgtcaaagttgccgatgcgatgctggcgcaaggcttctaa

SEQ ID NO: 5767 - DNA, 780 bp, Neisseria meningitidis
atgaaactggtaaggcctcagaaaatcagcgatcaggtattgtcggtattggaggagcgcattgcggaaggggtttacgcggaagggggcaagattccgcccgaacgcgttttggcggaagagttcggcgtttcgcgcccgtcggtcaggtcggcattgaatgttttggtcgcccgtcaggttttggaagcgaggcagggagacggttattatgtttcggtcaagccgcagcaggattttttgcaaagttggcaggagcttttgggcaagcattccaattgggaacaggatgtttttgatttcagttgccacatcgagggctgtatggcggcattggcggcagaacgccgcacggatgccgatttgaagcggattgggttttggcttgaaaagtttgaggaggcgtgcgaaagcggcaatttggaacatcagagcgaagctgatgtcagctttcatcagacgattgccgatgcggcgcacaatttgttgttcagccatttgtcgggcggtttgttgaaaatgctgtaccggcagacgcgcagcagccttatttatctgaatcaggaagaagatccgcgtccgaagctgatggcgcagcaccgtgtattgtatgaggcaatatcaaaccgccggccgggcgaggcttcggaggcggcaaaggcacatttgaattatgtggcgagcagcatcttgaaagacagggaatatcagagccgtaaccgccacgcagatactttggcgcaaaatgatttgaagcgcgtgcaggattgggcggtgtga

SEQ ID NO: 5768 - DNA, 300 bp, Neisseria meningitidis
atgcaacgttgctttaattggtttgaccactattgccgacgattagaaaaatattttcggagatgttcaattatggaaacttgggttcaaaactacacggcaatcggcggcagcctgtatctgactgccgccgccgcactcttacccatcgtctttttctttgccgcgctgaccgtcctgaagctgaaaggctatcaggcggggctttatacgctgctgattgcgcttgccgttgccgtattcggcttcgggatgccgacgggtatggcggtttcttccctgccgccgcagccgcattga

SEQ ID NO: 5769 - DNA, 966 bp, Neisseria meningitidis
atgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacacccttatccgccgcaaactcagtcccgaacaagtatgcgcctacctgtgcaaacaccaccggatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 5770 - DNA, 1404 bp, Neisseria meningitidis; identical to SEQ ID NO: 3447

SEQ ID NO: 5771 - DNA, 3204 bp, Neisseria meningitidis
atggctaaattttttatcgaccgccccatttttgcgtgggttatttcgattttcattattgcggcgggtattttcggcatcaaaagcctgccggtttcgcaatatccgtccgtcgccgccccgaccatcaccctgagggccacttatccgggcgcgtccgcgcaggtaatggaagacagcgtgctttccgtgatcgagcggaatatgaacggcgtggaaggtttggattatatgtccacttccgccgattcgagcggcagcggcagcgtgagcctgacctttacgcccgataccgacgagaatctggcgcaggtggaagtgcagaacaagctttccgaagtattgagcacgctgccggcaactgtccagcaatacggcgtaaccgtatccaaggcgcgttccaatttcctgatgattgtgatgctttcgtcggatgtgcagtcaaccgaagagatgaacgactacgcgcagcgtaatatcgttcccgagttgcagcgtatcgaaggcgtggggcaggtacgcctgttcggcgcgcaacgcgcgatgcggatttgggttgatcctaagaaactgcaaaactacaatttgtcgtttgccgatgttggcagcgcgctgtccgcccagaacgtccagatttcagcgggttctatcggttcgcttcccgccgttcgcggacagacggttacggctaccgtaacggcgcaagggcagttgggtacggcagaagaattcggcaacgtcatcctccgcgccaataccgacggttctaatgtttacctgaaggatgtggcaagggtcggactgggtatggaagactattcttcctcaacccgtctgaacggtgtaaataccaccggtatggcggtgatgctgtccaacagcggcaatgcgatggcgacggcaaaggcggttaaagaacgcatggcgacgttggaaaaatactttcctcagggtatgagctggaaaaccccttacgatacttccaaattcgtcgaaatttcgattgaaaaagtgattcacactttaatcgaagcgatggtgctggtgtttgtcgtaatgtatctcttcctgcaaaacatccgttatacgctgattccgaccatcgtcgtaccgatttcgctgttgggcggtttcgccttcatctcttatatgggcatgtcgattaacgtactgaccatgtttgcgatggttttggtcatcggcatcgtggtcgatgacgcgattgtggtggttgaaaacgtcgagcgcattatggcgggtgaaggcttgccgcccaaagaagcgaccaaaaaagcgatgggtcagatttcgggcgcggtcatcggtattaccgccgttctgatttccgtgttcgtaccgttggcgatgttcagcggggcgacgggcaatatttacaaacagtttgccctgacgatggcgtcatcaatcgcattctccgccttccttgcgctgacccttacccctgctttgtgtgccacaatgttgaagacaatcccgaaagggcatcacgaagagaaaaaaggtttcttcggctggtttaacaagaaattcaacagttggacgcacggttacgaaggccgggttgccaaagtgctgcgtaagactttccgcatgatggttgtctatatcggcttggcggttgtgggcgtgttcctgtttatgcgcctgccgacttcattcctgccgaccgaagaccaaggcttcgtcatggtcagcgtgcaactgcctgcaggagcgacccaagagcgcaccaatgcgactttggcgcaagttacccaactggcgaaaagcattcctgaaatagaaaacatcattaccgtttccggcttcagcttttcgggcagcggtcagaatatggcgatgggttttgccatattgaaagattggaacgagcgtaccgcgcccggcagcgatgccgttgcgattgccggcaagctgacgggtatgatgatggggacgcttaaagacggttttggcatcgccgtcgtcccgcctccgattctggagttgggcaacggttcgggtctgagcatcaacctgcaagaccgcaacaataccggccataccgcattgctggcgaagcgcaacgagttgattcagaaaatgcgtgccagcggtttgtttgaccccagcaccgtccgtgctggcggtttggaagactcgccgcagttgaaaatcgacatcaaccgtgccgcggcggcggcgcaaggcatttcgtttgccgacatccgcaccgcattggcaagcgcgctgagttcgtcttatgtcagcgacttcccgaaccaaggccgtctgcaacgcgtgatggtgcaggccgacgaggatgcccgtatgcagcctgccgatattttgaacctgaccgtgccgaacaaatccggcgtcgccgtaccgctttccaccattgctactgtttcttgggaaaacggtacggaacagagcgtacgcttcaacggttatccttcgatgaagctgtccgcttcgcctgcaaccggcgtttccaccgggcaggctatggcggcggttcaaaaaatggttgacgaattgggcggcggttacagcctggagtggggcggacagtcgcgcgaagaggcaaaaggcggctcgcaaaccctgattttgtacggtttggcggttgcagccgtatttttggtacttgccgcgctttatgaaagctggtcgattccgctggcggtcatccttgtgattccgttgggtttgatcggtgcggctgcgggcgtaaccgggcgcaacctgtttgaaggactgttgggcagcgttccctcgttcgccaacgacatctactttcaagtcggtttcgttaccgtgatgggtttgagtgcgaaaaatgcgattttgattatcgaatttgccaaagaccttcaagcgcaagggaaaagcgcggttgaagccgctttggaagccgcccgcctgcgtttccgtccgattatcatgacctcgttcgcctttattttgggcgtggttcccctgtatattgccggcggtgcaagttctgccagccagcgcgccatcggtacaaccgtattctgggggatgctcatcggcacgctcttgtccgtgttccttgttccgcttttctatgtggtggtgcgcaaattcttcaaagaaaccgcgcacgaacacgaaatggcagtaaaacacgccgccgaagcgggcatcaccggttcggacgacagccaacattaa

SEQ ID NO: 5772 - DNA, 1239 bp, Neisseria meningitidis
atggctttttatgcttttaaggcgatgcgtgcggccgcgttggctgccgccgttgcattggtactgtcgtcttgcggtaaaggcggagacgcggcgcagggcgggcagcctgctggtcgggaagcccctgcgcccgtcgtcggtgtcgtaaccgtccatccgcaaaccgtcgcattgaccgtcgagttgccggggcgtttggaatcgctgcgtaccgccgatgtccgcgcccaagtcggcggcatcatccaaaaacgcctgttccaagaaggcagttatgtccgtgccggacagccgctgtatcagatcgacagttccacttatgaagcaggtctggaaagcgcgcgcgcgcaactggcaacggctcaggcaacgcttgccaaagcggatgcggatttggcgcgatacaagcctttggttgccgccgaagccgtcagccggcaggaatacgatgctgcggtaacggcgaaacgttctgccgaggcaggcgttaaagcggcgcaggcggcaatcaaatccgccggcatcagcctgaaccgttcgcgcattaccgcgccgatttccggctttatcggtcagtccaaagtttccgaaggtacgttgctgaacgctggcgatgcgaccgtactggcgaccatccgccaaaccaatccgatgtatgtgaacgttacccagtctgcatccgaagtgatgaaattgcgccgtcagatagccgaaggcaaactgctggcggcggatggtgtgattgcggtcggcatcaaatttgacgacggcacagtttaccctgaaaaaggccgcctgctgtttgccgatccggccgtcaacgaatcgaccggtcagattaccctgcgcgccgccgtaccgaacgatcagaatatcttgatgcccggtctgtatgtgcgcgtgctgatggaccaagtggcggtggataacgcatttgttgtgccgcagcaggcggtaacgcgcggtgcgaaagataccgtgatgattgtgaatgcccaaggcggtatggaaccccgcgaggtaacggttgcgcaacagcagggtacgaattggattgttacgtcgggtctgaaggacggggacaaggtggttgtggaaggcatcagtatcgccggtataacgggtgcgaaaaaggtaacgcccaaagaatgggcgtcgtctgaaaaccaagccgccgcgcctcaatccggcgttcagacggcatctgaagccaaacctgcttctgaagcgaaataa

SEQ ID NO: 5773 - DNA, 633 bp, Neisseria meningitidis
atgagaaaaaccaaaaccgaagccttaaaaaccaaagaacacctgatgcttgccgccttggaaaccttttaccgcaaagggattgcgcgcacctcgctcaacgaaatcgcccaagccgccggcgtaacgcgcggcgcgctctattggcatttcaaaaataaggaagacttgttcgacgcgctgttccaacgtatctgcgacgacatcgaaaactgcatcgcgcaagatgccgaagatgccgaaggagggtcttgggcggtattccgccacacgctgctgcactttttcgagcggctgcaaagcaacgacatctactacaaattccacaacatcctgtttttaaaatgcgaacacacggagcaaaacgccgccgttatcgccattgcccgcaagcatcaggcaatctggcgcgagaaaattaccgccgttttgaccgaagcggtggaaaatcaggatttggctgacgatttggacaaggaaacggcagttatcttcatcaaatcaaccttggacgggctgatttggcggtggttctcttcctgcgaacgtttcgatttgggcaaaaccgccccgcgcatcatcgggataatgatggacaacttggaaaaccatcccgacctgcgccggaaataa

SEQ ID NO: 5774 - DNA, 258 bp, Neisseria meningitidis
atggtattgttattaattgtaaataaatattggaaggtaaatgatatgaaaaatgaaattcaaaaaaatatggacaaatataatccctggcatgaagatgattttgagtcgtatgaagacattgccagagatgtatcgctgacgacagataaaacgttcattgaacattatttgttagaagtttattcagaagaaaacggacattttgaccaagagaatgtccatgcaatgatagaagaaattaaaaatgcaatttag

SEQ ID NO: 5775 - DNA, 1569 bp, Neisseria meningitidis; identical to SEQ ID NO: 135

SEQ ID NO: 5776 - DNA, 3210 bp, Neisseria meningitidis
atgttttatctgtatcaatccaaccgtcttgaaacgctggcggcattgtttgcccgcattcaaaaagtcaaaccgctgaaatcggctttacagcccgaacagattattgtgcagagtcaggggatgcgccgctacctcaatacctgcctcgcccgcgatttgggcgtggcggcgaatttgtcgttcagcctgcccgccggcctgacgtggaagctgatgaaaaaactgattcccggtattccggaactcagcccgtttgcgcccgaagtcatgcgctggcggctgctggatttgttccgcagcgaggcatttcggaatacggcagaatttgaagatgtgaggaatgtgctgcaagactatctgggcagcggcgaatcggcagattaccagcttgcgggacagcttgcggacatattcgaccaatacctcgtgtaccgtcctcagtggatagacgcttggcagcagggcaggcggctcggtttgggcgacgacgaaatctggcagtccaaactgtggcgttacctcgacgacggcaggcagagcgcgccgcaccgtgtcgcgttgtgggaaaagctgttggaatctttgagcagtgataagctgcccgagcgttatttcgtgttcggcatttccacgatggcgccgatgtatttgcaacttttgcacaagctgtccgaacattgcgacgtgttcgtgttcgcactcaatccgagcgggatgtactggggcaacgtcatcgaagcggcgcaaatcctcaaaggtggcggcgatcccgatttaactcaggcagggcatccgctgctcgcctcattgggcaagcaggggcgggactttttcgactttttgaacgaaatggaaatagaaggcgaaacgccggtatttgaggaaggcgggcgcgatacgcttttacacgccctgcaaaccgatattcaaaacctgaaaatgccgtctgaaatggcgggaagcgtcaacacgggcgacggctcgatacgcatcgtctccgcacacagccctttgcgcgaattgcagatactcaaagacaagctgttgaaaattctgcatgaacatcccgattggcagccgcacgatatcgccgtattaaccccgaatatcgaatcctatacgccttttatcgaagccgtgttcggacaggcgcagcccggtgcgcaggcattgccgtattccgtgtcagacgtgaaaatcagccgccgccaaccgctgtttcatgctttgtcatgcctgttcgacttgttggaaagccgatttgaagtcgataaagtgcttgtgcttttagaaaccgcgcccgtgttgcgccgtttcggactgactgaggacgatttaccgcttttgcacgacatggttgccgatttgaacgtccactggggtttggacggagaaatgcgcggcggcacggatcagctgttcacctggaagcaggcggtagaacgcatgatattgggctggatgctgcccaaaggcggcaatccgatgtggcaggatgtcagcgcgtggtatgccgacgtgaatcaaaccgccatgttcggacgttttgccgccttcctcgaaaccctgacggatattgtacggatatggcggcagcccgcaacggtcggcgaatgggtggcgcgttgccgggatttgcttgaaacattgttccaagctgaagccgatgaccaaaagtcagtccaaaaccttgaaaacgaatgggtcaaatggcaggcggaaaccgaattggcgcaattttccggacagttgccgccgcacaccgtcatccgccatatccgacgctttctcgacagcgaaagcgaggcaggctttttacgcggcggcatcaccttttgcagtatggtgccgatgcggagcctgccgttcaaagtcatctgcctgttgggtttgaacgacggagattttccccgtaataccaaagccgccgtattcgacctgattgccaaacatcccgccaaaggagaccgcgcccgccgcgatgacgaccgctacctgttcctcgaagccctcatcagcgcgcgtgaaatcctctacctgtcctacatcgggcgcgacatccgcaaagacgaagagcttgccccgtcttccctgttgggcgaactcatcgataccgttgccgctatggcgggcatcggtagccgccaacttgcacaaaacctgatagaacagcatccgctgcaagccttctcgcgccgatattttcaagaaggcggacgttcagacggcatattcggcacgcgtaccgactacgccgccgcgctcggacaaacgcccgaaccgccgcaaccctttttcgatcaacccgtagaaaacgccgaacctgttgccgaaatcggacaggacgaatttatccgtttctggcgcaaccctgtcaaagtatggcttcagcagcagcttgcgtggagcgaaccccatatcggcgaagcctgggagcctgccgaacccttcgagccgcaacacgccgatcaaatcgccgaaatctacatcgaagcacggtgcgaaggacgggattttgcccaaaccgccgcccgcatcggggcggaaagcctcctgccgtcgggagagttgggcagactttggcagcaggacttccaaactgctgccaaacaaatcgacacggcggttttaaacagccccaaactgccaccgctttcatatgccataccgtcggacgggcaaatcctgaaaggcagcttgggcaatctgtaccgctgcggacaagtgttttacgcctacggcaaacccaacgcgccgcaacgtatcgcttttctgctggaacacctgatattttgcgccgttatgccgtctgaagccgaaatgcggcaaacctttatcgtccaatccggagaaaccgaaatattggcggaaatcgcgcaagacagggcattgcagctattgtcggaatggatggcgtttttcaatatcgggcaaaaccgcccgctgccgttttttgccaaaacctcgcttgccaccgccgaagcgtttgcccaaaaacaagattgggaagccgccctgaaaaaagcccaaaccgcctaccacggcagcaaagtcagcaaagggcagaaagactataccgaagtcgccctcgtgttcggcaacgcaagccaaaacccgctcgaacagcccctgtttgaaaacctcgtccgtctgcttgccgacacgcttgccgcagcggaaaaaaaggaagaggccggagaagcctga

SEQ ID NO: 5777 - DNA, 1410 bp, Neisseria meningitidis
atggatacacaaatcaaaactgaagccgacaatcagagcaaccggcgttatctgaccgtttggcggtggcatttttatgccggtctgctggttatgccttttcttaccctgcttgccgttacgggtttgggtatgctgctgtttgccaatattaccggtaaggagggcgagcggattcatgttgtgccgcaggcaacggtacaacctctgtctgttcaggcggaagcggcacgcagtgccgttaatccggaaacttcgtccgtcgttcagtatattgcgccgcgtgccgatgatatggttgccgtgttccgtgtcaacaatgagggcaaagcaacgatggtcgcggtcgatccttatacggcaaaagtggtcagtaccatgccgcgcaatcagggttggtattacacgatggatgaaatccacagcgatatgatgctcggtgcggcaggcgattatcttttggaaacggcagcttcactgaccattattatggttgtcagcggcttgtacctttggtgggtgaaacggcgcggcatcaaggcgatgctgctgccgtcaaaaggcagggcgcgttcttggtggcggaatctgcacggcacgtttggaacttgggtgtcgttgattttgctgttgttctgcctgtcgggtattgcttgggcgggtatttggggcggcaagttcgtacaggcttggagtcagttccctgccggtaaatggggtgtcgaaccgaaccccgtttcagtcgtgccgacccacggcgaggtattgaatgacggcaaggttaaggaagtgccgtgggttttggagcttacgcctatgcctgtttcagggacgactgtgggcaaagacggcattaaccctgacgagccgatgacattggaaaccgtcgaccgctttgcgcgggaaatcggtttcaaagggcgttatcagttgaatttgcccaaaggcgaggacggcgtatggactttgtcgcaggattctatgagttacgacatgatcagcccgtttgccgaccgcacggtacatatcgaccagtacagcggcaaaatccttgccgacatccgttttgacgattacaacccgttcggcaaatttatggcggcaagcattgcgctgcatatggggactctgggctggtggagcgtgttggcgaacgtcttgttctgccttgccgtcatttttatcggtatcagcggctgcgtgatgtggtggaaacgccgtccgaccggagcggtgggcatcgttccgccggcgcagaaagtcaagctgccggtttggtggatgatggcattgccgctattggcaatcgcactgctcttcccgacctcactgcttgccattgccgtgatttggctgttggatacgctgctgttgtcgcggattcctgttttgaggagatggtttaaatga

SEQ ID NO: 5778 - DNA, 126 bp, Neisseria meningitidis
ttgcacaaacacgcgatcgaaggtttcaatacgatgcccgcaaaaggcggtcgcggcgatttgagcgatgatgaggttaaagctgcggttgactatatggtcaaccagtcaggcggcaaattctaa

SEQ ID NO: 5779 - DNA, 1098 bp, Neisseria meningitidis
atgaacacaacatcccaatttaccagtaatttctggaatatatatattgcagttattgtcttactgagctttatcgctttggcttggctgctgctgtctcaaaatgttgtcaaacgtccgaagaagggcgaagaagtacaaactacgggtcatgagtgggacggcattgccgaatacgacaatccgctgccccgctggtggttttggctgtgtgttttgacgtggctgttcggtatcggttatttggttatgtatccgggtgtcggcgactacaaaggtctgctgaaatggaccagccataaccaatatgaaaaagaggtcaaaaaagccgatgagcaatacggcaaactgtatgccaagtttgcggatatgccgattgaaaaagtggcaaaagaccctcaagccaagcaaatcgcccaaaacctgtttaacacttattgtatccagtgccacggctctgatgctaaaggctctaaaggttttccgaatctgaccgatagcgattggttgtggggcggtgatcccgataaaatccacgagaccatcgaaaaaggccgtgttgcgactatgcctgcctggggtcctgctttgggcgaagaaggcgtgaaagacgttgcccattatgtgatgtccctttcaaaacccgaaggtcagtatgatgaggaacgtgccgcgcgcggacaagccttgttcagcggtccgcctgccaactgtttcacttgccacggcgataagggacaaggtatccaaggtttgggtccgaacctgactgatgacgtgtggttgtggggcggtacgcaaaaatccattatcgaaaccattaccaacggtcgcagcagccaaatgcccgcttggggacatttcttggataaagacaaactgcatattatgactgcttatgtatggggtctttccgataaagacggtaaagctccggtgaaaaaagccgagcctgcaccgactcccgcaccggcggcagaacccgcagcctctgctcctgcagaagcagcacaagccgtgtccgaagccaaacctgccgcagcagaacctaaagccgaggaaaaagctgcacctgctgccaaagcggacggcaaatag

SEQ ID NO: 5780 - DNA, 612 bp, Neisseria meningitidis; identical to SEQ ID NO: 2297

SEQ ID NO: 5781 - DNA, 1446 bp, Neisseria meningitidis
atggagactctcatggacacacaaacttacaactacaaagtggtgcgccagttcgccatcatgactgtagtttgggggattgtgggtatgttggtcggcgttatcgtcgccgcccagctttttgctcctgccctcgacttgtctaatatcggaccttggttccacttcggccgcctgcgtccgctgcacaccaatgcggttattttcgcatttggcggttgcggcctgatcggcacatcatactacgttgtccaacgtacttgtaatacccgtcttttcggcggttggctgccggcatttaccttttggggctggcaggcggtaatcgttgccgccgtcgtcagcttccctatgggttggacccaaggtaaggaatatgccgaactggaatggccgatcgatattctgattactttggtttgggtggcttacgccatcgtattcttcggtacgattgccaaacgtaagattaaacatatttacgttgccaactggttctacggcggctttattttggcggtcgcacttttacacatcgtcaacaatatcagcatcccggccggtttgatgaagtcataccccgtctattccggtgcgattgatgctatggttcaatggtggtacgggcataatgccgtgggcttcttcctgactgccggcttcttgggtatgatgtactatttcgtacccaaacaagcagcccgccccgtttactcctaccgcctgtccgtcgttcacttctgggcgttgatttttacctatatgtgggcgggtccgcaccatcttcactacactgcgctgcctgactggacgcaatctttgggtatggttctgtctttgattctgttcgcaccctcttggggcggtatgattaacggcatcatgaccttgtccggcgcgtgggacaaactgcgtacagacccgattcttaaattcctgattgtatccttgtccttctacggtatgtctacctttgaaggcccgatgatgtcgattaaaacggtcaatgcattgagccactatacggactggaccgtcgcgcacgttcatgcgggtgcgttgggctgggtaggctttgtaaccatcggttccgtctattacatgattccccgtctgttcggcaaagaacagatgcacagcaccaagctggtagaagcacatttttggattgcgaccatcggcgtggttctgtatatcgctgccatgtggattgccggtgtgatgcagggtttgatgtggagttctttgaacgatgacggtacgctgacctactcgtttgtcgaatccgtaaaacgcaccatgccttactacgtgatccgttttgcaggtggtttattgtatctgagtggtatgtgcattatggcgtacaacgtgtaccgcacagccatcggtggtaaagcagtcgatgccgaaatccctgcggtttcccaaacacagcaccactaa

SEQ ID NO: 5782 - DNA, 1749 bp, Neisseria meningitidis
atgattcattataaaataaccccgtcccctctcgaccacgagtggcacatcctgctgacattcacacaagatgatgatcttcctatagaaataagcctgccaaactgggttccgggcagctatctgattcgggatttttcccgccacatcacttctatccatgcatcctgtaacggcacgtccatgccgctcgaacaaattgccaaaaaccgctggcatgccgccgccgtacgcggcgagtggcaaatccgctacaccgtatatgcattcgatttgtcggttcgaggttctttcctgacgacagaacgcggtttttttgacggatcgtgcctgtttttgaaagtcgaaggaacggaaacgctgccgcaccgcttggaattgacgggtattccgtccgaatggcgtattgccacaacgctgccggaaacagggaggtttgtctttcaggcggcatcttatgccgaattgattgaccgacctgtcgagatgggcttgattgaatttttagattttgaggcggcaggcattccgcacacaattgccttaagcggcatatatcccgatttcgaccgcaacaggctggtttcggatatcaaaaaaatctgcgaaacagaactggcggtgttttcctcccctgccccgtttcaaaaatatttgttcctgctccacgtcggcgaccatatttacggcggtttggaacacaccgacagcaccgccctgctcgccgaccgccacagccttccgccgtacggtatgaccgatgccgacgatacctacaccacattgctcggacttttctcccacgaatattttcacgcgtggaacgtcaaatccatcaaacctgccgcgttcgtcccttatgacctcgacaaagaaaactataccgaacaactatgggcattcgaaggtattacatcctattacgacgatttgtttttggcacgcagccgcaccatctcgcccgaatcttatttaaacctgctggcacaaggcattacgcgcgtacaacaaacccgcggccgtttgaggcagaccttggcggaatcgagttttaccgcgtggaacaaattttacaaaccggatgaaaacagccccaacgccatcgtcagctactaccagaaaggcgcgcttgccgcattgtgccttgatctgataatacgcaaccgaagcaacggcagacattctctcgatacgttaatggacaaactctatcgggagtggagggacacacactcgggtattccggaaaaacactggcaaatccgctgtcaggaaattaccggcttggatttggaagattttttccaaaaagcgttatacagtaccgaagatttgccgcttgccgaatgcctggcaaccgcaggcgtgggactgaccttcctgccgcttccccgacaacacggcggcggatacgcagaacacatctgccccgtcccgtcggcaggcgattttggcgcacgtttcaaacaaaacaccgaccacatcgtcctgacccatgtcttcaacggcggcagcgcggaatctgcggcactgtgcccgcaagacaaaatcattgctttagacggttatgcctgcaccgactttaccgcacaatgggcccgataccacgtcaatgcaaaaatcaatatccacttcttccgtgccggcatattgcgtcaaaccgtcttgacggttcaggcagcggcagcggatactgccatcctacatatcacagaccggaacctgttggacaactggttgttcggttaa

SEQ ID NO: 5783 - DNA, 429 bp, Neisseria meningitidis
atggccattctgaaacttgacgaacacctctatatttctccgcaactgaccaaagccgatgcggaacaaatcgcgcaactgggcatcaaaaccgtcatctgcaaccgccccgaccgcgaagaagaatcgcaacccgacttcgcccaaatcaaacagtggctggaacaagcaggcgttactggattccatcaccaacccgttaccgcacgcgacatccaaaaacacgatgtcgaaaccttccgccaactcatcggacaagccgaatatcccgtccttgcctattgccggaccggtacgcgctgctccctcctgtggggcttccgccgggcggcagaaggtatgccggttgacgaaatcatccgccgcgcccaagcggcaggcgtaaatttggaaaacttcagagagcggctggacaacgcccgcgtctga

SEQ ID NO: 5784 - DNA, 435 bp, Neisseria meningitidis
atggcatttggttcgatgaattccggcgacgattctccgatgtccgacatcaacgttacgccgttggtggacgtgatgctggtgttgctgattgtgtttatgattactatgccggtgctgacgcattccatccctttggaactgccgaccgcgtccgagcagacaaacaagcaggacaaacagcctaaagaccccctgcgcctgacgattgatgcgaacggcggctattatgtcggcggggattctgcaagcaaagtggaaatcggggaagtggaaagccgtctgaaagccgccaaggagcagaatgaaaacgtgattgtggcgattgcggcagacaaggcggtggaatacgattatgtaaacaaagctttagaagccgcccgtcaggcaggaatcaccaaaatcggttttgtaaccgaaaccaaggcgcaataa

SEQ ID NO: 5785 - DNA, 663 bp, Neisseria meningitidis
atgaatttgaaattagtgtttgaatcgggcgatcccgtcctgattggtgtgtttgtgttgatgctgttgatgagtatcgtaacgtggtgtttggttgtcttgcgctgcatcaagctgtatcgggcgcgcaaagggaatgccgccgtcaaacggcatatgcgcgatactttgtcgctgaacgacgcggtcgaaaaagtgcgcgccgtcgatgcgcctttgtccaaactggcgcaagaggcattgcagtcttaccgcaactaccgccgaaacgaagcgtccgaactggcgcaggctttgccgttgaacgagtatttggtcattcaaatccgcaacagtatggcgcagattatgcgccggtttgattacgggatgaccgcgcttgcctccatcggcgcgaccgcgccgtttatcgggctgttcggcacggtttgggggatttaccacgccctgatcaatatcgggcaaagcgggcagatgagtattgcggcggttgccggcccgattggcgaggcactggtggcgacggcggcgggtttgttcgtggcgattccggcggtgttggcatacaacttcctcaatcgcggcacaaaaatactgacccaggatttggatgcgatggcgcacgatttgcacgtccgcctgcttaatcaaaaggatagctga

SEQ ID NO: 5786 - DNA, 843 bp, Neisseria meningitidis
atggataaagaacgaattttaacccccgcagtcgtgttttccgtcgcactgctgcatttggcaatggtggcattgctctggcaggcgcacaagctgcccgtgatagagtcaggcaatgttattgaatttgtcgatttgggcgattttggcggaggggacggcgcccccgaaggtgcaggcgcgcctgctgcgcccgaaccgcaacccgtgcccgagccgcccaaacctgtcgagccgcccaagccggttttgaagccggtggttacgaaaaaggcggatgcggatattcagcagcctaaggaagagccgaaacctgaagaaaagccgaaacccgaagaaaaaccgaaaccagagcctaagccggaagcgaagcctgtcccgaaaccggcggaaaaaccggtcgagaagccgtctgaaaaacctgccgaacatcccggcaatgcttctgccaaagcagacagcgagcagggcaatggggaagataagggaactggtaccaaaggagacggaacggggcgcggagaaggcagcggtaaaggtagcggcggtgtcaaaggcgaacacggggaaggagccggcagcagcaaaggcaatcctttacgcgccaacggcagcattccgcgcccggcttatcccacgctttctatggagaatgacgagcagggtacggttgttttgagcgttttggtttctccgggcggtcatgttgagtccgttaaaatcgtgaaaagcagtggtttttcccggttggacaatgcggcacgcaaggcggcgcaaaacgggcattttcaagccaatgcctggacggagtttaaagtccccgtcaagtttgaattgaattag

SEQ ID NO: 5787 - DNA, 639 bp, Neisseria meningitidis; identical to SEQ ID NO: 939

SEQ ID NO: 5788 - DNA, 801 bp, Neisseria meningitidis
atgaaaaagaccatttttaacattaccaaaatggactgcccgtccgaagaacagctcattcgcatgcgtttaaaagatgtgtctgatatttatgaattacagtttgatattgctgggcggtgcttaaccgtctatcacgataatcaagatacaacgattttacaagtacttgaaccgcttaattttgatagtcatatcatttccaccgaagtgattgttgataagatagtgtttaacaagcctgatgagcacttagaaaaaagattattatatcaagtgctcatgattaactttgtgttttttatcatagagtgttcggttggtatttttgctaattctatggggctgattgctgatagtctagatatgctggcggacagctttgtctatatattggcgctatcagccattggtatgacgctggcgtataaaaaacgtgtggcatttttggcggggataacgcagataatattggcgttatttggggtgatagaagtgattaggcgttttatcggtgctgagcagctgcccaattatcaactgatgattggcacggcatttttggcattgattgcaaactggctgtgcttatatctactgagcaaaaatcaaaataaagaaatccatatcaaagccagcatgatttttacatccaatgacattatcatcaatatcggtgtgatagcggcgggagcattgacgttattgactcattctagctatcctgatttaatcattggcatgattgtctttgtcattgtactatttggtgccagaaatattttaaaattggcaaaataa

SEQ ID NO: 5789 - DNA, 504 bp, Neisseria meningitidis
atggacgcctttgatttttttatgcaaggcaattttaaaaaaattgcaactgaacaaggtttagaccgtaaatattttatattccaatatatcgtatgtaatttatctgccatttcttctttttgtctaatgaagattattcatacttatactattctctatatattaatagctgtcatcggtattattaatggctttctcttgagaagcaaggttctatctatagtaaaaaataaacaaaagtttttatctgacatgtttcccttggaaatgcctttcttttttgtagaatacaaaatacctatcttggctagattcttgaataggggaatgaaatggctttatctcccaagttttttctgtttagttgcgatttgtttctcaatatatatccttaatgaagaaggggggtggatgccttattttgcctgctattggtttggactttgttatccagtaagcacttattacgtttttttatccagagattataaacatatctaa

SEQ ID NO: 5790 - DNA, 642 bp, Neisseria meningitidis
atgaaactgtatatttacgaccattgcccgttttgcgtgcgtgcgcggatggctgccgggctgtttggcgcggacgttgaagaagccgtgctggcaaacgacgacgaggcaacgccgatcggtatgatcggtgcgaaacaagtgcccgtcctgcaaaaagaagacggttcgtttatgggcgagagtttggacattgtgcggcatttcgaccgcgaagaccgtctgaaagacgaagtccgccccgagatacgggcgtggctggacaaggtgggcggatacaacgacaaactggtgcagccgcgcgtgatcaaaatcgggctgcctgaatttgcaacgccggaagcggtgaaatattttacagacaaaaaagagaaaagcatcggcagcttttccgccaatttgaataaaaccgcccaatacctcgaacggataaacgcagatttgcaagagttggaaaatttgatggacggtgcttcagacggcatcaacggcggaatcggtatggaggatattttggttttccccgttttgaggaatctgaccgtggtgcgcggcatcgaatggccccaaaaggtgatgggttatttgatgacgatgagtgaaaaatcgggcgtgccgctttattttgacagggcattgtaa

SEQ ID NO: 5791 - DNA, 2214 bp, Neisseria meningitidis; identical to SEQ ID NO: 1401

SEQ ID NO: 5792 - DNA, 812 bp, Neisseria meningitidis
ctatattacgaacaatgcaaaaacatcagccaaaccgcagcaacgtttaacttgtcaagaaacacactttacctgtggattcgccttaaaaaacaaacaggcagcctaaaacatcaagttaccggtctaaatgccgtcaaatcggataggcaaaaaccggctcaatatgttgggcaacaccaggatgcctatctgcatgaaatcgccaaacattttgattgtacggcagccaccgtttgctatgcactcaaacagatggggataacgcgcaaaaaaagaccaccacttacaaagaacaagacccggccaaagtaacgcattatttgacacagccggccgaattttctgactaccaacgcgtttatttggatgaaacaggatttgaccgccacctgttccgtccctatgcccgcagcctgaaagggcaaatagtgaaagcgcagataagtggaaaaagataccgacgcttatctctggtgtccgcacaagtcggcaaccggctgattgctccgatggtttatcaaaatacgatgaccggagtcttttttgaagcgtggtttcagcaatgcctactgcccgcattgactcaaaaatcggtgattattttagataatgcacgatttcaccgtatgggtgtcttacgggaaatggcggaaaaattgggacataaggtattgcctcttgcaccttattcacctgagctcaacccgattgagaaggtttgggcgaatattaagcggtatctgcgaaccgtattgtctgattacgcccgatttaacgatgcactactgtcctattttgattttaattga

SEQ ID NO: 5793 - DNA, 1404 bp, Neisseria meningitidis; identical to SEQ ID NO: 3597

SEQ ID NO: 5794 - DNA, 1428 bp, Neisseria meningitidis; identical to SEQ ID NO: 3601

SEQ ID NO: 5795 - DNA, 354 bp, Neisseria meningitidis
atgtttaccacaaacgatttacgccatttcctagaaggtttggccatcctattctcaatcggctattggggcaccatgctgctgttgctttggtttctcgtccgctttgcctataaaaagcccaaacggaaccccggcaaaatcctttcaggcagcctgaccgccgccgctatcctgatgctgtttgtttggattattcccaaacaattcggcccgatcaaagaagaaatacaggcacaagaagagtgggacagaaaatacaaagaagccgaagccgtgtttaacgaacaatgcaaaacggcgggggaaagatttaccagacggcggacaatgtggaagggattatgctgttga

SEQ ID NO: 5796 - DNA, 411 bp, Neisseria meningitidis
atggggaataccgctatgtggatgtcctgcaacccaaccattccgatattattcggtattcaggtaaagatttttccgctaaatcaaatatttaatcatatacaccccgcccgttatgcggtaacgttcgaaaacaatgtcgattccaagctgcgcaggcactgggtggcaggtgcgaccatacggattatcgaccgccaaactgacgaagtgattgccaagaaaaccatctatgtctttgaaaaaggcttggacggcacgggtggggcgagaatgccgtggaagtttgctatcttgtgcaataaagaaagacttacttcttcagagccgttatcggattttgttcttagcgttttaaaaccttatatattgcgtcccttatatattgcgtccctaagaagggacgattaa

SEQ ID NO: 5797 - DNA, 1343 bp, Neisseria meningitidis; identical to SEQ ID NO: 4542

SEQ ID NO: 5798 - DNA, 291 bp, Neisseria meningitidis; identical to SEQ ID NO: 4541

SEQ ID NO: 5799 - DNA, 198 bp, Neisseria meningitidis; identical to SEQ ID NO: 4540

SEQ ID NO: 5800 - DNA, 285 bp, Neisseria meningitidis; identical to SEQ ID NO: 4539

SEQ ID NO: 5801 - DNA, 279 bp, Neisseria meningitidis; identical to SEQ ID NO: 4538

SEQ ID NO: 5802 - DNA, 291 bp, Neisseria meningitidis
atgaataaaaatgaacgtgactttttctatatatcaaattctgatttagataaattgtcagaatcttatcctgataggcctctttcttatgtgttttattgttatttgaaagaaactggtctattgaaaaatttctcaatggataaatgtcataatttttttaatagaattaattttaatgaatcttgctttgaaattaaattcaaggatgattcatttttcattattggcaatggaaaaattgatgtttcggattctaataatttcttttctgtttcttttgagtgctaa

SEQ ID NO: 5803 - DNA, 1506 bp, Neisseria meningitidis
atgtatgcactttcggaaaaatataacgataatggatttaaggcatacaaagttttaggtgagggaggaggaattcatacagaatataattacaaatttgataaaagtttgaatttgaatgtattagaaagttcaacaggcgcacgctctcttgaaaaagtccccgttaaagtaactgcatcagtttcccgcgccgccgtcttgtcaggagtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatcgttgcacatttaattggaatggcggagattgtttggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccggaccgcccaaacggtaggcatcgcaaagaaaggaaagaaggcgaagacggcgggcttttgtgcgattattttccggaaatcctagcctgtcaggagatgggcaaaccttcagacggcatgtttcacgatataagcataccgcaggttatagacgataaaacatggtcttcacataactttttaccgtctaacggcgtatgtccgcagccgaaaacctttcatgttttcggtaggcaatatcaggcaagctatgagccgttatgcgtgtttgccgaaaaaatccgttttgccgtactgctcgcctttatcattatgtcggcttttgtcgttttcggttcgttgaaggggaaataa

SEQ ID NO: 5804 - DNA, 291 bp, Neisseria meningitidis
atgccattacttgccggtctgattccacttttaggcatacttctgaaaatgctgattgtcagaataatccttgcaacaggtctgacatttgtaacctatgccgggtatctcatcgcgctggaaaagttcaaagactacacgtcaaatgcgatcaattccatgccttccgacatactgaaccttcttttaatttcgggattcggtcaggggttgggctacctgttcggcgcattctcgttcttcattggtatgcacgcattcaaaaaactgacgtttgtctttccaggatga

SEQ ID NO: 5805 - DNA, 1086 bp, Neisseria meningitidis
atgatttatctgtttacaggaaacatggggacaggcaaaacctcccgcgtcgtctctatgattttgaacaacgaagacggattgttcaaaatgaaattggaagacggcacagaggtagacagaccgctttatttctgccatatcgacggattggataaacggcagtttaaagcccacgaactgacggaagagcaaatcatgtccgccccgcttcgtgatgtcataccggaaggcgcagtgctgattgttgacgaagcgcactacacttatccggtacgcgcggcaggccgtcccgttccgccttatattcaggaactgacagaactccgccatcacgggcataccgttattttgatgacgcagcacccgagccaacttgatatattcgtccgcaaccttgtttcaaagcatgtacaccttgaacgcaaggcaatcggaatgaaacagtattattggtataaatgcgtaacctcgttggacaatcccgcaggcgtaagcggcgtagaagtcgcaagttggaaaccgccgaaagaagcctttaaatactataaatcagcaagccagcaccaaaagttcaagaaaaaagtaccttgggcggtttgggcgttgattgcgattgtagggtttgtaggctggaaaagttacggcatttttaaagtttacagcaaagccacagacagccggattgagcaggaagcgcaaaaagaaagcgttgtgcagacgatgacggagcagcctgcatcatcagaggaaatgcctttaaaaaattcagacaatttgaaacctgaagactttgtgccgactttacccgaaaagcccgaaagcaagcctatttataacacagtccgacaagtaaaaacctttgagcaaatcgccggatgtatagacggcggaaaatcagattgcacatgctattcaaatcaaggaacacccttgaaagaaataacaaagataatgtgtaaagaatatgtgaaaaacgggttgcctttcaatccttataaggacgaacagcaaaggacggaacaggtggaacagtccgcgaaagcggacaagccgcaagttctcgtaatgggcggaaagccgtag

SEQ ID NO: 5806 - DNA, 951 bp, Neisseria meningitidis
atgtacttaggaatagacgtttcaaagctcacaatagattgctgtttgattgtagacggtcaaaattatcaaaagaagtttcagaacaacaaaggaggatttgaacaattaataaattggctacaaagtcataaagtaaacgataagctccattgcgtgtgcgaagcaacaggcacatattacgaagcattagccgaatatctttattcaagatatacaattaccgtagagaatccacgaaagataaaaggatatgcgatagcagaactacaacgatcaaaaacagatacacaagacgcaaagttgatagcccaatattgccaagaccgaaagcacaaattaaaagcatggaaaccgccgacaaaagaacagaagcaattacaggaaatcgcccgatatttagactatctgaaacagcaacgcgcaacagaaaaagctaaacaacacgaagcacccgactatatcaaatcccatattcaaacaactatttcaaacctgacagcacaaatacagatagtcaaaaagcaattactccagttctacaaagacaatccaagttataacaatctacgcaaaaggctgaaaacaataacaggcataggcgagcaagcgacagcagtattgctatcaacctataaaagacatgaatttaaaaatgcaagacagttcacggcttatctaggcctagaccctagaaaatttcaatcaggaacaagcgtgaacggaaaaagcagaatatcaaaaataggaagttcggaaataaggaaaagcctttatatgcctgcacttgttgcatatcgttgtaatgccttccctgaatttgtagggcgtctgaaaaataaagggaagcatataaaattgatattaattgccatcatgcggaaactggcggtaatagcgtttacgattttgcaaaacggccaagatttccaagtggaaagatataaataa

SEQ ID NO: 5807 - DNA, 381 bp, Neisseria meningitidis
atgccatccgttgaactgctgttggtgattgtcggactgccacgcggcaccttctattaccaattggttgtccaatcggcagaagacaaatatgccgatttgaaacggcatatccatgatatttatcaaaagcagttgaaagacaacggtctggttcagagtatgtcccgcaagggaaactgcttggacaatgcggcaatggaaagtttcttcggaacgttgaaatcggaatgtttccatacgtgcaaatatgattccgttaccgaattggaagctgtactgcacgaatatatccgttactacaacaacgatagaatcaagttgaaattaaaaggactgagccctgttcagtacagaattcagtccctgaaagccgcttga

SEQ ID NO: 5808 - DNA, 477 bp, Neisseria meningitidis
atgaattccgacttgccgtcgttcaatactatttggcagggaacagcagaccatctttctatttccgattcattggtacgcagatgggtgacaaaatacagattacacggagagagtggcatcaaacgtagaaagcatacgacaaaatattcggtcgaatacaaacttgaggcaatccgcctggtggcggggtagggaatgtcccaaaaagctgccgcagaccaactgaatttgcccgactgctccatcttgctgcaatggttgcgcctctaccatttgaatggtattaacggtttaaagcccaaaccctaaacccaaaggaagaaagcccgtgaaaaaacagcatccgccggaaacgaaaaagccgactatctgaaaaccaaggaagaactgcttgcggaattggcttgccttaaagcggaaatggctgccctaaaaaagctcgatgccttaatctatgggaaagaagtgcggtag

SEQ ID NO: 5809 - DNA, 438 bp, Neisseria meningitidis; identical to SEQ ID NO: 3571

SEQ ID NO: 5810 - DNA, 102 bp, Neisseria meningitidis
ttgtttcacaccctacccgaagctctaaaacgcacagaaatcgccgcagcgcgccaaaaactgacagagctgcggcggatgttggtgagtaaaggaggttaa

SEQ ID NO: 5811 - DNA, 345 bp, Neisseria meningitidis
gtggcaaaccgatgccgtctgaaaccgtacaacaggagacaaaataatgcttgctcaaatcgaactcacaccctgccagctaatggtttacgtaacttaaggttactggatttacgcactaaggttactgaacttaagcatatcggcggccaaagtaccgctgccattgccgatctcgctggggaaatgagaaggctcgctaaaaaatcaaaaatgttactgaaaggactttggccatttttatcctctacaatatctgcatttaaaataaatcagtcattgtttaaacattactataaaactgtacaactgctaaactgtaaacacagaaagaagaattactaa

SEQ ID NO: 5812 - DNA, 195 bp, Neisseria meningitidis
atggttctcttcaagtcaatcaaacaggaaagtatttcttttctgtctgaagatttgaaaaaggactggatgtttcacaaggttaaaactggggaaaaagatggatatggttcagatgaaatgctgagcgtaccccgtgtctatttggaaatgatgtcgcggaaaacgggagtcccctactccagtattctttaa

SEQ ID NO: 5813 - DNA, 231 bp, Neisseria meningitidis
atgcaaggatgcgatcactacatctttttattccgaagcgtttatgattttacggtcaactgctactctatgtgcctagcttttcagctccctattttcgaatattggaggaggcattttcatcagtgtcgtaatgccgaccaaaactctcacaaaccatattggttcttgtggcagcaacacctatccgtttgttcaagcgaccacaagagtaacatgattggctggtag

SEQ ID NO: 5814 - DNA, 213 bp, Neisseria meningitidis
atgcgtagccgctcggtacgtttgagccaaatgttatcttcgccatttgtaccaatttgtttttacattaggctgtgttttagtaatctattgatttcaattatttgcaagggaaaagacaattattttccggttaggaataaacctatcctgttgaataccttaaagccaaatacgcctatcaacaccatattaaaacacagccttttttaa

SEQ ID NO: 5815 - DNA, 1365 bp, Neisseria meningitidis
atgcagcatctcactgaaagaatgacgcaaattgccaagctgctgaattcttccgcaaacaatcctgatatagacattcccgattttcttactgaaatcaaagattattcagaattttccgtgacagatgaaaatggaacctacctgcattgggacaaattccgccggattcacacggaagatacgcggatgaaatggcgcgccgttaaggaaagccgcaaaaaaatccaaaaaccaattgatttcccgtttgaacatcagttttggttctgcattcccgactctttgcaggcacggcttcatttgattgacaaaagctgcggcagttctatcggcacgtctagcttgggtggcttcggcagaagcgagcaaaacagattcttgctcaagtctctgattatggaagaagcgattacatccgcccaactggaaggtgcggctaccacgcgtaaagtggccaaggatatgctcaaatcgcagcgtaaacccaaaacaaaagacgaaatcatgatagtgaacaactatcacttgatgaaaaaagcggtagaattgaaaaatacgccgttaagtgttgaaatgattttggatttgcaccgcattgctaccagtaacgctattgaaaacaaggccgagcccggacaattcaggcaggatgacgaaatctttatcgccgatatcaatggtaacagcctgtatcaaccaccgccgcacggacaggttcatacgctgatggaagaggtgtgtgcgtttgccaataatacctatgacggcgtggaaaatccgtttatccatccggttgtccaagctattatcttgcatttcctcatcggctacatccacccatttggtgatggcaacgggcggacagcgcgggctttgttctattggtttatgctcaaaaacggctactggctatttgaatacatatccatcagccgtcttctgaaaaacgctcctgcccaatacgccaaatcctatttgtatgcggaaactgacgatttagatttaacctatttcatctattaccaatgcgatattatcaagcgggcggttgccgatttggagcactacatttccgacaaacaaaaacaccaacaggaattcaaagcagcgattgcccaatatactgaaaagataggaaagttgaaccaacggcaaattggtatcctgcaaaaagcagtggaagaaagcggaaaaatctttactgcacaagaaattgccaaccaatacggcatctccctgaatactgcccgtagcgatttgagtaaactgggagaatatagattcctagtgccgttcaaatcaggaaatgctttagagtatgttgctcctcaggatttattggaaaggttagaaaaaaaatag

SEQ ID NO: 5816 - DNA, 507 bp, Neisseria meningitidis
gtggaaaccacttttgctctgctaaattttaaggaatctttatgttacatataccccccaacggaacctgttcgatatgttagcagtattgtagccttaaacgtgcatagtcctaacggtacaggcgactggcatagtgcaaaggcattgagtgatcgggcttaccctgaaaaattttatatttacggtgaaaatcaagagcgaaataccaatcatttatttggtgataatggcattattgatgggacggatcgactgaacaaaatgggttatttccctgaaaacatcccagtttggctcgcagatcacccccgtgcttgcgtggattatctttacacagcagtgttacaaactggctcaatcggtcgggtgattttagatgattggtttccaagcgatgaagacaagcaatcagtttatgacttacttaaccaaatcgaaccgcacttgaatactcaagaatgggagaatttacagctatggaaacgcaaaaacccaataatgtaa

SEQ ID NO: 5817 - DNA, 1254 bp, Neisseria meningitidis
atgcgtaaacccagaatcacctatttggatgtttgggcaaacgatgaaagaatcggtactttggaaaagggggccatgtatcggttcgcatacgacaatcccaattcttcgttgctgggcctgcattatcaagacagaagcaaggtatatatcagcaacaatatgccgcatatctttgcacagtattttccggaaggctttttggatgcacacatcacaagcaaatatgcttttcatgatgcgccttttgaagacaatgagatgctgcgcttggcaattctgtgcagagagactttgggtcggatacatgtgcgctgtaatgacccgctttttaatgaatggattgacgggttggagatgaaaaatccaagaatattgactgaacgggatttgctgggcataaatgcccgacaggtttttcagcaatatatggcagaaatcttccatcacggccgtttcgtcagtgtatccgggatacagcagaagatgtccttagatgccatccgcagaaataccaagcaaactgcctcatatattgccaaaggttttgatgcatccgaatatccttgcttggctgccaatgaatttttatgcatgcagaccatcaaacaagccggcattgccgttgcacagaccagcctgtcggaagattcatcagtcttattggtacgtcggtttgatgtcagtgaacagggttattttttagggatggaagactttaccagtctgcgccagtattcggtagaagataaatataaaggcagttatgcggctattgcacagattatccgacagatatccggcagaccagatgaagatttaatccatttctttaatcagcttgctgccagttgcatattgaaaaacggcgatgcacacctcaaaaatttttcagtactctatcatgacgaatacgatgttcgtcttgcacctgtctatgatgtattggatacatcaatatacagggttggaacacaaggaatttttgatgcttatgacgatacgctggcattaaacctgactaaccacggtaagaaaacatatccttccaagaatacattgttggattttgctgagaaatattgcgatttgggaagagaagatgcatcctttatgatagatacaatcgttcaagctaaagaacaggttcttgttaaatactcggatgtattgcgtgagaatgaatggttggcgcagaagtggcattttatcccggatgaaaatgaagaaggtctaccgtttacattccggtag

SEQ ID NO: 5818 - DNA, 1788 bp, Neisseria meningitidis; identical to SEQ ID NO: 3837

SEQ ID NO: 5819 - DNA, 459 bp, Neisseria meningitidis; identical to SEQ ID NO: 3567

SEQ ID NO: 5820 - DNA, 315 bp, Neisseria meningitidis
atgaagaaaaccctttctaatttagtgctaatatcattctgctcaacaatgctaacagcttgccctttttggggtagttgtgcagactggaattgctccaaacttaatccacgctgggagaaagccgttgacacatgtgaaactgaaaatctcacctttgttttgcatgaattaggcaatcaattaggatataaatctattaccgaagtctcatttagtgaaattgggcaacatatttcttatcagtgtattcaccatggcggtggatacaatattcgtaaagataagcagtatggtcatttgtttgtgcaataa

SEQ ID NO: 5821 - DNA, 300 bp, Neisseria meningitidis
atgaaaaagaagctttctaaatattctctgtttctttcatctgttttttgtctaacagcttgcgctactaccttattaggtactgtcgtagtcggtacagccttgtacggtactagtagtaactggacaactactgataaggaacaccaagaaattatgaattgccttgataaggcattagtaaaactgaatatctattttgagaatgatgaagaaaagtacaaaaacaaaacagtaatggatatttactatcagtgcattaaaaatcctaattatgttgtaacacacaataacttataa

SEQ ID NO: 5822 - DNA, 1014 bp, Neisseria meningitidis; identical to SEQ ID NO: 3561

SEQ ID NO: 5823 - DNA, 417 bp, Neisseria meningitidis
atgaataaaaatatactttatatattttctttattaatcactattgttattttctttatatttgaaaagaatgtaataagaaaaataagttttaattataataaaaaagaattcttaattagtgatataacgaattttaattgggattatgtaaaactgtatataatcaattcagatttccaaaaaattgttttttatcataaaagtaagatagtttttgaggaattaatagaactagataaggaagggaatgttttacctcaatatctatttgattcagatttgaaaaatgttgaatattacgaatgtgattacaagaatggcaagatgcaacttttaaaaaaagaaaaatcacatttttttgatggatatttttattattataaacctataaattgtaggccgaaacttttgtaa

SEQ ID NO: 5824 - DNA, 7545 bp, Neisseria meningitidis; identical to SEQ ID NO: 2649

SEQ ID NO: 5825 - DNA, 195 bp, Neisseria meningitidis
cggttaaaaatcccattcgaacgaaatggcaaggtttataccgtcgttgtccctaatgcgcaatcagcaacattattgccgattatccgagagaaagttaagtctgatggcattgtgtatacggatacctttcgtagttatgatgtacttgatgtcagtgaatttagccatttacgcaagttttccagtatttga

SEQ ID NO: 5826 - DNA, 966 bp, Neisseria meningitidis
atgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacacccttatccgccgcaaactcagtcccgaacaagtatgcgcctacctgtgcaaacaccaccggatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 5827 - DNA, 435 bp, Neisseria meningitidis
atgaataaaaattatttattttatcttattcaaaatattaaatctattttcttaataggtggagtattttttggccttttaattttttcaggtttatggggtaatgattttaaactatcttttttaggggtaatagattttatatttgggatggtagggggtgggtttatagttatgttatggtttctaattccagtgatattatcaactttattcagatgggtatttcaaaatcaacttgctgtatctgtcatattaaccttcattgttttttatacatatgggtacttttctttatttaattcatctgaaagagtcggtagtttttggtatttggtaatcccaaccataatgtttattggactgtctgaatggtttatctataaatctagcgtgcatagtttaggtgaaaatgtaactccacgttccaattga

SEQ ID NO: 5828 - DNA, 1839 bp, Neisseria meningitidis
atgcgtaaggtgtgtgcttcagcacgcacgcgttccatgatttacggctcaatgccgtctgaaaagctcacaatttttcagacggcatttgttatgcaagtaaatattcagattccctatatactgcccagatgcgtgcgtgctgaagacaccccctacgcttgctatttgaaacagctccaagtcaccaaagacgtcaactggaaccaggtacaactggcgtacgacaaatgggactataaacaggaaggcttaaccggagccggagcagcgattattgcgctggctgttaccgtggttactgcgggcgcgggagccggagccgcactgggcttaaacggcgcggccgcagcggcaaccgatgccgcattcgcctcgctggccagccaggcttccgtatcgctcatcaacaacaaaggcaatatcggtaacaccctgaaagagctgggcagaagcagcacggtgaaaaatctgatggttgccgtcgctaccgcaggcgtagccgacaaaatcggtgcttcggcactgaacaatgtcagcgataagcagtggatcaacaacctgaccgtcaacctggccaatgcgggcagtgccgcactgattaataccgctgtcaacggcggcagcctgaaagacaatctggaagcgaatatccttgcggctttggtgaatactgcgcatggagaagcagccagtaaaatcaaacagttggatcagcactacattacccacaagattgcccatgccatagcgggctgtgcggctgcggcggcgaataagggcaagtgtcaggatggcgcgataggagcggcggtcggtgaaatcctcggcgaagccctgctggacggcagagacccgggcagcctgaatgtgaaagaccgggcaaaaatcattgctaaggcgaagctggcagcagggacggttgcggcgttgagtaagggggatgtgaatgctgcggcgaatgcggctgctgtggcggtagagagtaatgcgcttagcaaggaaagaatggataaattgacaaaatgcctttccggtaaaacttgttctactacgatggaaaaagtaaatgccatcaaaaaggatgaacaatttagcaaagtaattgatacggaaattcaaaaagtctgttctaggaacccattgggcgatggttgcagaaacggcattaatatgtctattaaatatattgccatgcctgctgcgtggaagtatatgcctacggatgtatcacgggttgccaaagaagtttttggctatttatataactcacaaggggcatctacaagatttgacaagtatttcaacaccattgacaatcgtgcagatttctttgctgccagcaatctttatgagcaaaatttgggttcaaaagcacgatggtttggtggagctgattttgtatcgcgtgctgctataactgggttaggggcagacggagaagcttcttatataacttttgcggcaggtaaagttgttggtaatcctccaatttatgaatggagggctgcgtcaggcaatgcactgatagtaaatggattttataattttagagacttgttcaataaaaaaactaatcctagggagtgggatattcaacagttgaaaagcgagcaaaagttattacagcctattcaccaaaaatatttgagtaatgagaaggattatttgtcattgattaaaggggtaacatcaaataagatattttcaataattccaaatcctttagatgagaggaaaaaaatagaggatggaattaatatgttagattacaaatctagaattaaatatggttgtaagcttatgggatattctgagaaacagggatgcaagccatga

SEQ ID NO: 5829 - DNA, 375 bp, Neisseria meningitidis; identical to SEQ ID NO: 4557

SEQ ID NO: 5830 - DNA, 378 bp, Neisseria meningitidis; identical to SEQ ID NO: 4556

SEQ ID NO: 5831 - DNA, 1806 bp, Neisseria meningitidis
atgaaaaccgccctgccctcaagggtagttgcagaatcggccaacctgcaatcaggctgggacgccaaactgcaaggcacccagtttgaaaccacgctgggcggcgcagccatccgtgcaggtgtaggcgatcaggcacgagcagatgccaagattattcttgaaggcatcaaaagtagtgtgcgcactgaaacagtaagcagtagcaaatctgccctctggcagaaacaggccggacgcggcagcaatatcgaaaccttgcaactgccaagtttcacaggctccgttgcgcccgtactctctgctcccggcggctacattgtcgacatccccaaaggcaatctgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattatcgcgctggctgttaccgtggttactgcgggcgcgggagtcggagccgcactaggcttaaacggcgcagccgcagcagcggccgatgccgcctttgcctcactcgcttctcaggcttccgtatcgctcatcaacaataaaggcgatgtcggcaaaaccctgaaggaactgggcagaagccgcacggtaaaaaatctggttgtagcggcggcaacggcaggcgtatccaacaaactcggtgcctcttcccttgccacttggagcgaaaccccttgggtaaacaacctcaacgttaacctggccaatgcgggcagtgccgcgctgatcaacaccgctgttaacggcggcagcctgaaagacaatctggaggcaaatatcctggcggcattggtgaataccgcgcatggggaggcggcgagtaagatcaaaggactggatcagcactatgtcgcccacaaaatcgctcatgccgtagcgggctgtgcggctgcagcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaaggtcaaggaagttttagaaaaaaatcgtccttatatccctaataaaggtgctgtaccgaatatgagtacatacatgaaaaataatccttttggaaaacagctggctcaaatttcagaaaagacaacgcttccgacgcagcaagggcagtctgtcttcttggtaaaaagaaaccaagggttattaaaaaccggtgataggttttatttagatggccaacataaaaatcatttagaggtttttgataaaaatgggaactttaagtttgttctaaatatggatggttcgcttaaccaaatgaaaactggggcagcaaaaggtcgtaaattaaacttaaaatag

SEQ ID NO: 5832 - DNA, 105 bp, Neisseria meningitidis
atgccgtggaagatctcaactacgacaaacttgacacccgtaccaagcgcaaatttatcggcattacctacgacaaggtgcacgacaccaccacccacaccatga

SEQ ID NO: 5833 - DNA, 246 bp, Neisseria meningitidis
atggaagaactgttaaatgacggttcaatccgtttacatgattataccgacggtatcggaattcctctaactggaacttcaaaagaacaagtgcagaaattgaaagacatatggcctactttggaagatgcccaagcaatatggcctgaagacccttggtattacttagaatggctttggtgggatattgcgtgtccaatagatttggccgatttgccgaatattgatatttatgagcaagcgtag

SEQ ID NO: 5834 - DNA, 105 bp, Neisseria meningitidis
atgagaaacaaaaaattaagattcttgattttcaaatcgatttatcctcaatttttaactcttataaaaatcaaatgggtattaatattcaagatgaaaacttaa

SEQ ID NO: 5835 - DNA, 5988 bp, Neisseria meningitidis
atgaataaaggtttacatcgcattatctttagtaaaaagcacagcaccatggttgcagtagccgaaactgccaacagccagggcaaaggtaaacaggcaggcagttcggtttctgtttcactgaaaacttcaggcgacctttgcggcaaactcaaaaccacccttaaaactttggtctgctctttggtttccctgagtatggtattgcctgcccatgcccaaattaccaccgacaaatcagcacctaaaaaccagcaggtcgttatccttaaaaccaacactggtgcccccttggtgaatatccaaactccgaatggacgcggattgagccacaaccgctatacgcagtttgatgttgacaacaaaggggcagtgttaaacaacgaccgtaacaataatccgtttgtggtcaaaggcagtgcgcaattgattttgaacgaggtacgcggtacggctagcaaactcaacggcatcgttaccgtaggcggtcaaaaggccgacgtgattattgccaaccccaacggcattaccgttaatggcggcggctttaaaaatgtcggtcggggcatcttaactaccggtgcgccccaaatcggcaaagacggtgcactgacaggatttgatgtgcgtcaaggcacattgaccgtaggagcagcaggttggaatgataaaggcggagccgactacaccggggtacttgctcgtgcagttgctttgcaggggaaattacagggtaaaaacctggcggtttctaccggtcctcagaaagtagattacgccagcggcgaaatcagtgcaggtacggcagcgggtacgaaaccgactattgcccttgatactgccgcactgggcggtatgtacgccgacagcatcacactgattgccaatgaaaaaggcgtaggcgtcaaaaatgccggcacactcgaagcggccaagcaattgattgtgacttcgtcaggccgcattgaaaacagcggccgcatcgccaccactgccgacggcaccgaagcttcaccgacttatctctccatcgaaaccaccgaaaaaggagcggcaggcacatttatctccaatggtggtcggatcgagagcaaaggcttattggttattgagacgggagaagatatcagcttgcgtaacggagccgtggtgcagaataacggcagtcgcccagctaccacggtattaaatgctggtcataatttggtgattgagagcaaaactaatgtgaacaatgccaaaggcccggctactctgtcggccgacggccgtaccgtcatcaaggaggccagtattcagactggcactaccgtatacagttccagcaaaggcaacgccgaattaggcaataacacacgcattaccggggcagatgttaccgtattatccaacggcaccatcagcagttccgccgtaatagatgccaaagacaccgcacacatcgaagcaggcaaaccgctttctttggaagcttcaacagttacctccgatatccgcttaaacggaggcagtatcaagggcggcaagcagcttgctttactggcagacgataacattactgccaaaactaccaatctgaatactcccggcaatctgtatgttcatacaggtaaagatctgaatttgaatgttgataaagatttgtctgccgccagcatccatttgaaatcggataacgctgcccatattaccggcaccagtaaaaccctcactgcctcaaaagacatgggtgtggaggcaggctcgctgaatgttaccaataccaatctgcgtaccaactcgggtaatctgcacattcaggcagccaaaggcaatattcagcttcgcaataccaagctgaacgcagccaaggctctcgaaaccaccgcattgcagggcaatatcgtttcagacggccttcatgctgtttctgcagacggtcatgtatccttattggccaacggtaatgccgactttaccggtcacaataccctgacagccaaggccgatgtcaatgcaggatcggttggtaaaggccgtctgaaagcagacaataccaatatcacttcatcttcaggagatattacgttggttgccggcaacggtattcagcttggtgacggaaaacaacgcaattcaatcaacggaaaacacatcagcatcaaaaacaacggtggtaatgccgacttaaaaaaccttaacgtccatgccaaaagcggggcattgaacattcattccgaccgggcattgagcatagaaaataccaagctggagtctacccataatacgcatcttaatgcacaacacgagcgggtaacgctcaaccaagtagatgcctacgcacaccgtcatctaagcattaccggcagccagatttggcaaaacgacaaactgccttctgccaacaagctggtggctaacggtgtattggcactcaatgcgcgctattcccaaattgccgacaacaccacgctgagagcgggtgcaatcaaccttactgccggtaccgccctagtcaagcgcggcaacatcaattggagtaccgtttcgaccaaaactttggaagataatgccgaattaaaaccattggccggacggctgaatattgaagcaggtagcggcacattaaccatcgaacctgccaaccgcatcagtgcgcataccgacctgagcatcaaaacaggcggaaaattgctgttgtctgcaaaaggaggaaatgcaggtgcgcctagtgctcaagtttcctcattggaagcaaaaggcaatatccgtctggttacaggagaaacagatttaagaggttctaaaattacagccggtaaaaacttggttgtcgccaccaccaaaggcaagttgaatatcgaagccgtaaacaactcattcagcaattattttcctacacaaaaagcggctgaactcaaccaaaaatccaaagaattggaacagcagattgcgcagttgaaaaaaagctcgcctaaaagcaagctgattccaaccctgcaagaagaacgcgaccgtctcgctttctatattcaagccatcaacaaggaagttaaaggtaaaaaacccaaaggcaaagaatacctgcaagccaagctttctgcacaaaatattgacttgatttccgcacaaggcatcgaaatcagcggttccgatattaccgcttccaaaaaactgaaccttcacgccgcaggcgtattgccaaaggcagcagattcagaggcggctgctattctgattgacggcataaccgaccaatatgaaattggcaagcccacctacaagagtcactacgacaaagctgctctgaacaagccttcacgtttgaccggacgtacaggggtaagtattcatgcagctgcggcactcgatgatgcacgtattattatcggtgcatccgaaatcaaagctccctcaggcagcatagacatcaaagcccatagtgatattgtactggaggctggacaaaacgatgcctataccttcttaaaaaccaaaggtaaaagcggcaaaatcatcagaaaaaccaagtttaccagcacccgcgaccacctgattatgccagcccccgtcgagctgaccgccaacggcataacgcttcaggcaggcggcaacatcgaagctaataccacccgcttcaatgcccctgcaggtaaagttaccctggttgcgggtgaagagctgcaactgctggcagaagaaggcatccacaagcacgagttggatgtccaaaaaagccgccgctttatcggcatcaaggtaggcaagagcaattacagtaaaaacgaactgaacgaaaccaaattgcctgtccgcgtcgtcgcccaaactgcagccacccgttcaggctgggataccgtgctcgaaggtaccgaattcaaaaccacgctggccggtgcggacattcaggcaggtgtaggcgaaaaagcccgtgccgatgcgaaaattatcctcaaaggcattgtgaaccgtatccagtcggaagaaaaattagaaaccaactcaaccgtatggcagaaacaggccggacgcggcagcactatcgaaacgctgaaactgcccagcttcgaaagccctactccgcccaaactgaccgcccccggtggctatatcgtcgacattccgaaaggcaatttgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattgttaccataatcgtaaccgcactgacttatggatacggcgcaaccgcagcgggcggtgtagccgcttcaggaagtagtacagccgcagctgccggaacagccgccacaacgacagcagcagctactaccgtttctacagcgactgccatgcaaaccgctgctttagcctccttgtatagccaagcagctgtatccatcatcaataataaaggtgatgtcggcaaagcgttgaaagatctcggcaccagtgatacggtcaagcagattgtcacttctgccctgacggcgggtgcattaaatcagatgggcgcagatattgcccaattgaacagcaaggtaagaaccgaactgttcagcagtacgggcaatcaaactattgccaaccttggaggcagactggctaccaatctcagtaatgcaggtatctcagctggtatcaataccgccgtcaacggcggcagcctgaaagacaacttaggcaatgccgcattaggagcattggttaatagcttccaaggagaagccgccagcaaaatcaaaacaaccttcagcgacgattatgttgccaaacagttcgcccacgctttggctgggtgtgttagcggattggtacaaggaaaatgtaaagacggggcaattggcgcagcagttggggaaatcgtagccgactccatgcttggcggcagaaaccctgctacactcagcgatgcggaaaagcataaggttatcagttactcgaagattattgccggcagcgtggcggcactcaacggcggcgatgtgaatactgcggcgaatgcggctgaggtggcggtagtgaataatgctttgaattttgacagtacccctaccaatgcgaaaaagcatcaaccgcagaagcccgacaaaaccgcactggaaaaaattatccaaggtattatgcctgcacatgcagcaggtgcgatgactaatccgcaggataaggatgctgccatttggataagcaatatccgtaatggcatcacaggcccgattgtgattaccagctatggggtttatgctgcaggttggacagctccgctgatcggtacagcgggtaaattagctatcagcacctgcatggctaatccttctggttgtactgtcatggtcactcaggctgccgaagcgggcgcgggaatcgccacgggtgcggtaacggtaggcaacgcttgggaagcgcctgtgggggcgttgtcgaaagcgaaggcggctaagcaagctgctcctaaagaaacaataaacaatttggcaaatttagccaaagcagaacagcagattttattccgtattgcccaacgcgatacgcaactggatgcatggaagacgggatttaacaatagagtaaggaaaggagcaggcttgcttgatgcaagtaatattccgataaccattaacggaaaaaccatcaaacctgtacaagccataagcttaaagggagcacccgtttacagcggcgtaagcgaacaggagatttttgcgctttatcggcagatgactggccagaatccgaattttagagttttgcctgacggaagattagcaaatggcattatcagtactggagaatgggcaggaacaaaaattgcattaagaaatttttcaaaaacagagaattcaactcaagcacgatggacattagatttgcagaatcctccatcatttattaaaggtactaaattggagcttaaattccaataa

SEQ ID NO: 5836 - DNA, 1743 bp, Neisseria meningitidis
atgaaattttttcctgctccatgtctgttggttatcctggctgtcataccccttaaaaccttagctgccgatgaaaacgatgcagaacttatccgttccatgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggtgcgcaaattttcttttcttccttctgtgctcatgaaagaaacagcttttaaaactgggatgtgtttaggttccaataatttgagcaggctacaaaaagccgcgcaacagatactgatcgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatgaaattatggacacgccaaacctataaatacatcgacgatgccgaaatcgaagtacaacgccgccgctctgcaggctgggaagccgaattgcgccaccgtgcttacctcaaccgttggcagcttgacggcaagttgtcttacaaacgcgggaccggcatgcgccaaagtatgcctgcaccggaagaaaacggcggcgatattcttccaggtacatctcgtatgaaaatcattactgccagtttggacgcagccgccccatttattttaggcaaacagcagtttttctacgcaaccgccattcaagctcaatggaacaaaacgccgttggttgcccaagataaattgtcaatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaa

SEQ ID NO: 5837 - DNA, 171 bp, Neisseria meningitidis
atgatgtttgccaaacattatcaattcatcgcactcggcatcatgctgcttctttatatgttgattctctatacgaccgatttttccaatctgacgtattggatgctgttttttatctgttttattacaggaaaaatattagctcgtttgttagagaaaagctttaaataa

SEQ ID NO: 5838 - DNA, 303 bp, Neisseria meningitidis
atgacttgggtcggaggctcaggtaatgcgcaacaaagctcatattattgcgaaatttgcgaatctgcagggcttaacgatacgggaaatcctgataaatctttaggattgccaaacaatacgttcagtaatccgcctggttggggagctacaatcggagctttagcaggtagccgcatagggatgcctgaatttggtacgtttgcgagccatgccattgaaaatttcgactggtcatggtatcgacgttatagggaaattgccgaaacgattgaacgagaatattcaggcggtttgccttaa

SEQ ID NO: 5839 - DNA, 1225 bp, Neisseria meningitidis
atgaatagacccaagcaacccttcttccgtcccgaagtcgccgttgcccgccaaaccagcctgacgggtaaagtgattctgacacgaccgttgtcattttccctatggacgacatttgcatcgatatctgcgttattgattatcctgtttttgatatttggtaactatacgcgaaagacaacagtggagggacaaattttacctgcatcgggcgtaatcagggtgtatgcaccggatacggggacaattacagcgaaattcgtggaagatggagaaaaggttaaggctggcgacaagctatttgcgctttcgacctcacgtttcggcgcaggaggtagcgtgcagcagcagttgaaaacggaggcagttttgaagaaaacgttggcagaacaggaactgggtcgtctgaagctgatacacgggaatgaaacgcgcagccttaaagcaactgtcgaacgtttggaaaaccaggaactccatatttcgcaacagatagacggtcagaaaaggcgcattagacttgcggaagaaatgttgcagaaatatcgtttcctatccgccaatgatgcagtgccaaaacaagaaatgatgaatgtcaaggcagagcttttagagcagaaagccaaacttgatgcctaccgccgagaagaagtcgggctgcttcaggaaatccgcacgcagaatctgacattggccagcctcccccaagcggcatgagacagaacaaagctggcttgaacgcaccattgccgatatttctcaagaagttttggattttgaaatgcgctctgaacaaatcatccgtgcaggacggtcgggttatatagcaataccgaacgtcgaagtcggacagcaggttgatccttccaaactgctcttgagcattgttcccgaacgtaccgagctatatgcccatctatatatccccagcagtgcagcaggctttatcaagccgaaagacaaggttgtcctacgttatcaggcatatccctatcaaaaattcgggcttgcttccggcagtgtcgtatcagtagcaaaaacggcactgggcagacaggaattgtcgggattgggcatggtatcctccgatttggcgaagagcaacgaacctgtttatcttgtgaaaataaaacccgacaaatcaaccatcactgcatacggtgaggaaaaaccgctgcaaatcggcatgacgttggaagcagacatcctacacgagaaacggtga

SEQ ID NO: 5840 - DNA, 354 bp, Neisseria meningitidis
atgattgaacttcaacttcatgaattgaagctggtttcagggggaggtcctgtaacagacaatatagctggaaatgtagctaatgctgccacaaccaaaggaggtcccacatggggggatttggttgcaatacctgctgccgcagcggcagtttattatctgccgaaaaatgcttacggtgctgctggtgcaaatggtgtatacaatgtgactcgtaattgggtaaatgatgccgttaatgcacctccttataacggaagaccaatctttgagattgaacatggattaactgctcccgcaacaaaagcagataaatcaggaaacggctacactgacggtacagattactgctga

SEQ ID NO: 5841 - DNA, 240 bp, Neisseria meningitidis
gtgagggattctatgaaaaactggaagcaatttacatttttcgtaatattagtaatagcttgttatcaagtgctatattttttatcagatatgtttcttctcgactacattaacaaatatagttggaatttgaattttattcagggtactttgaattttttttcaatatatctgccatatgtttttgttagccgaatttttaggaataccaaccaagaaaaggagtataaaaatgattga

SEQ ID NO: 5842 - DNA, 1155 bp, Neisseria meningitidis
atgagcatccatctcgacttcggcattagtcctaaaacgttccgacagacttatctgtatcaaaagcccaagctctttaaaggagcggttcggaatctcgaatccgcatcttggaaagatatcaacgagatataccaacgagcagacccaaccgcaccgctgtttcatctgcgtaaaaaaggcgcaatcgttcctaaagaagaatacgtcgaaagtttcgacgatttgggcaaaactcgctaccgttttattaaatccgttatctacgaacatatgaagaatggtgcgtcgttagtctataaccatattaacaacgagccgttttcagaccatatcgcccgtcaagtcgcccgctttgccggcgcacatactattgttagtggatatcttgcttttggcagcgacgaatcttataaaaaccattgggacccccgcgatgtgtatgccatccagcttttcggcaagaaacgttggcaacttactgcccctgatttccctatgccattgtatatgcaacagactaaagatactgatatttccattcctgaacatatcgatatggatattatccttgaagcaggtgatgtcctctacatcccacgcggttggtggcacagacctatcccgctcggctgtgaaaccttccacttcgctgtcggtacctttccacccaacggctataattacctcgagtggctaatgaagaaatttcccaccatagaaagtctgcgccacagtttctcagactgggagcaagataggacgcgtatcaacgatactgccgcacaaattgctgccatgattgccgaccccgtcaattatgaagccttcagtgaagactttctcggcaaagaacgtaccgataccgcttttcatctcgaacagttcgcgaatcccaacgctactccgctttcagacgacgtcaggttgagattaaatgccaataatttggatacgttggaaaagggatatttgattgggaatgggatgaagataagcgtagatgagttggggaaaaaagtgttagaacacatcggtaagaatgaaccgttattgttgaaaaatctactggttaacttcaatcagggaaaatatgaagaagttaggaagttgatttatcagttgatagagttagattttctggaaattttgtga

SEQ ID NO: 5843 - DNA, 1044 bp, Neisseria meningitidis
atgagtaaaaaaatcaaagtcggcattgtcggcgcgacgggctacaccggcgtggaactgctgcgcctgcttgccgcccatcccgatgtcgaagtcgccgccgtaaccagccgcagcgaagcgggaaccgcagttgccgattactttccgagtttgcgcggcgtgtacggcctcgccttccaaacgcccgacgaggcaggtttggaacaatgcgacatcgtcttcttcgccacgcccaacggcatcgccatgaaagacgcgccgcgcctgattgaacagggcgtgcgcgtcatcgacctttccgccgacttccgcatacgggacattccgacctgggaacactggtacggcatgacccacgccgcccccgacctcgtttcccaagccgtgtacggattgagcgaactcaaccgcgaagccgtcgcacaggcgcgcctcgtcgccaaccccggctgctacccgacctgcgtatccctaccgctcgtgccgctgttgcggcaatgccgtctgaagcccggtatgccgctgattgccgactgcaaatccggtgtgtccggcgcgggcaggaaaggcaatgtcggttcgctgttgtgcgaagccggcgacaacttcaaagcctacggcatagccggacaccgccacctgcccgaaatcaggcagaccatcgccgggcttcaggacggcatcgccgaaggattcgtgttcacgccgcacctcgcgccaatgatacgcggtatgcacgccaccgtttacctccacctttcagacggcagcgaccccgaaaccgtcctgcgcgactactaccgcgacagcccgttcgtggacatcctgccgaccggttccgcccccgaaacccgcagcgtgcgcggcgcaaacctctgccgcatcagcatccaacaggcggcgcaatccgatgtgtgggtcgtcctttccgtcatcgacaacctcgtcaaaggcgcggcgggtcaggcagtccaaaatatgaacattatgttcggactggaggaaacacacggcttggacgcaatccccctgctcccctga

SEQ ID NO: 5844 - DNA, 2043 bp, Neisseria meningitidis
atgatgtcgcccgaaacccgaaaacagctcaaaatcaccgatgtttccgccaagaagctcgacaaactcaacctccataccgcgtgggatttggtgttgcacctgccgctgcgttacgaggacgagacgcacattatgccgattaaggacgcgccgattggcgtgccgtgtcaggtcgagggggaggttatccatcaggaagtaacgttcaaaccgcgcaagcagctgattgtccaaatcgccgacggctccggcagcgtcctttttctgcgcttcatccacttttacgccagccatcagaaacagacggcggtcggcaaacgcatccgcgccgtgggcgaaatcaaacacggcttttacggcgacgagatgattcatcccaaaatccgcgatgccgagggcggcggtttggcggaaagcctcacgccggtttacccgaccgtaaacggtttgaaccagcccactttgcgccgtattattcagacggcgttggacgttacgccgctgcacgacacgctgcccgatgccctgctgtgccgtctgaagctgccacacctcgccgaaagcctgcgtcttttgcattcgccgccgccgagtttcacgattcatcagctttcagacggcacgctgcctgcatggcaacggctcaaattcgatgaacttttggcgcaacagctttcgatgcgcttggcgcgacagaagcgtatcggcggcacggcggcggcattgggcggcgacggcacattgacccaagccctgcgccaagccctgccgtttgccctgaccgatgcgcaagaaaaagttgtttccgaaatctgccgcgatatggcgcaaacctacccgatgcaccgcctgctgcagggcgatgtcggcagcggcaaaaccattgtggctgctttgtctgctttgacggctatcgaatccggtgcgcaggtggctgtaatggcgcccactgaaatccttgccgaacaacattttattaaatttaaacaatggctcgaacctttgggcattgaagttgtccgcctttttggcagtttgcgtaaaaaagccaaagacgaagccaaagccaaactcgccgacggcagcgtcaaaatcgccgtcggcacgcacgccctgttttcagacggcgtggcgtttcacaatttgggcttgaccattgtggacgaacagcaccgtttcggcgttgcccaacgcctcgccctcaaaaacaaagggcgcgaagtccatcagctgatgatgtccgccacgcccatcccgcgcacgcttgcgatgagttttttcgccgatttggacgtgtccgtcatcgacgaattgccgcccgggcgcacaccgattaaaacgcgcctcgtcaacaacgtccgccgcgccgaagtcgaaggcttcgtcctcggcacttgccgaaaagggcggcaggcgtattgggtctgcccattgattgaagaaagcgaaaccctgcaactgcaaaccgccgccgaaaccctcgcccggcttcagacggcattgcccgaactcaatatcggactggtacacgggcgcatgaaggccgccgaaaaggccgaagtgatggcgcggttttcttcgggggggctgaacgtcttggtcgccaccaccgtcatcgaagtcggcgtagatgtgcccaatgccgccctgatggtcatcgaacacgccgagcgcatgggcttggcgcagctgcaccaattacgcggtcgggtcgggcgcggcgcggcagaaagcgtgtgcgtcctcctgtttgccgaacccttgggcgaactcgccaaagcgcggctgaaagtcatctacgaacacaccgacggctttgaaatcgcccgccaagacctcaacatccgcggccccggcgaatttctcggcgcgcgccaaagcggcgtgcctatgctgcgtttcgccaagctcgaagaagacctgcacctcttggaacaagcgcgcgaaaccgccccgatgctgattgaacaaaaccccgaaatcgtcgaagcgcatttggcaaggtggctttccggcagggaagggtatttgggcgtgtga

SEQ ID NO: 5845 - DNA, 444 bp, Neisseria meningitidis
atgagcgaagaactgcaacccgtattcagcatcgagcgactgtatgtcaaagacttgtctttggaagtgccgcacgcgccgcaaatctttttggaacagggcgagcccgaagtggagatgcgcgtttccaccggcagccaaaagctggaagacggctactacaacgtggatgtaaccgttaccgtaaccgccaaattggataacgagcgcacgatgtttttgaacgaagtaacccaaagcggtattttccgtttggaaaacatccccgaagaagatgccgacctgctgctcggcgtggcgtgtccgaacatcctcttcccttacgcgcgcgaagccgtttccggtacggtaacgcgcgccggcttcccgcccgtcctgctcgcgccgattaattttgaggcgatttaccaacaacagcaggaagccgaagccgccggggcttga

SEQ ID NO: 5846 - DNA, 258 bp, Neisseria meningitidis
atgcagaccgttaccatgtacacaggtccgttttgcccctactgcgcgatggcgaaaaggctgctgcacgcggcaggtgtcggacatatcgacgaaatccgtgtcgatgcaagccccgaagcctttgccgaaatgcagcagctttcgggacagcgcagcgtgccgcagattttcatcggcgaaacgcacgtcggcggatttaccgacctctaccgcctccagcaggaaggcgggctggacggactgctgaacccttaa

SEQ ID NO: 5847 - DNA, 1530 bp, Neisseria meningitidis
atgcaaaatatttttattacattttcaggaaaaaccatgttgtcaggactccccatccccaaagacatcgcgcgcccgcccgaaacgatattggtcaacatcacgccggcagaaacgcgcgtagcggtgttggaggaaaacaatatctgcgagctgcacatcgagcgcaacagcgaacacagcctagtcggcaatatctatttgggcgtggtgcgccgcgtgctgcctgggatgcagagcgcgtttatcgacatcggcttggaacgcgcggcgtttttacacatcgtcgatgtcctcgaacaacgccgcaaccccgaagaaacccagcgcatcgaacatatgctgtttgaagggcagtctgttttggtgcaggtcatcaaagacccgatcaacaccaaaggcgcgcggctttccacccaaatctcgctggcggggcgtttcctcgtccatcttccgcaagaagaccacatcggcgtgtcccaacgcatcgaagacgatgccgaacgcagcagcctgcgcgaacgcctcgacaagctcctgccggaaaatgcctgccggggctacatcatccgcaccaacgccgaaaacgccaccgacgaacagctccagtccgacatcgactacctgaccaaagtgtgggaacacatccaagaacaggcgaaaatccggccgcccgaaaccctgctttatcaggatttgcctttaagcctgcgcgtgttgcgcgatatggtcggctgcgacacgcaaaaaatcctcgtcgattccaccgtaaaccacgggcgcatgacgcgttttgccgaacaatacgtccacggcgcattgggcaggatagagctgttcaaaggcgaacgcccgctgtttgaaacccacaacgtcgaacaggaaatcagccgcgccctgcaaccgcgcgtcaacctcaacttcggcagctacctgattatcgaatccaccgaagccatgaccacgatagacgtgaacaccggcggcttcgtcggcgcacgcaacttcgacgaaaccatcttccgcaccaacctcgaagcctgccacaccatcgcccgcgaattgaggctacgcaacctcggcggcatcatcatcatcgacttcatcgatatggcacaggaaagccaccgcgaagccgtgttgcaggagcttgccaaagccctcgccttcgaccgtacccgcgttaccctgcacggttttaccagcctagggctggtcgagctgacgcgcaaacgctcgcgcgaaaacttaaaccaagtcctctgcgaaccctgcccttcctgccaaggcagaggccgtctgaaaacgccgcaaaccgtatgctacgaaatccagcgcgaaatcgtccgcgaagcgcgccgttacgatgccgaaagtttccgcatcctcgccgcccccaacgtcatcgatttgtttttggacgaagaatcgcaatccttggcaatgctgatagatttcatcggcaaaccgatttctctggcggtcgaaaccgcttacacgcaggaacaatacgacatcgttttgatgtaa

SEQ ID NO: 5848 - DNA, 945 bp, Neisseria meningitidis
atgcaggaaaacgaataccgtgaagatttggcggcggatgcggcacggcaaagcgtgttgcccctgttggcggcactgccgctgatgattttgctgaccgtgtggattacgcacaaagccatgcgccccgtccgcaaattgtcgcaaagtctcgaacaacgccgaatcaatgacctgtctgctttgagtgtggacaatattcccagtgaaatcagaggtttcgtaaccgccatcaacctgcttttgaaacgtgcggatgaagacatccgccaccgtcagcggtttgtcgccgacgcggcacacgaattgcgtacgccgatgaccgcccttccccttcaggcggaacggctcaacaatatgccgctcccacccgatgcggcgcggcagcctgccgttttgcagcaaagcatacggcgtaacaaacacctgctcgaacagcttttggcattggcgcgttcgcagtcggatgaaatccctctgacgaaaacgacattcggtctgcaaagccgtttccgccaagtgttgcaggaactgatgccgctggctttggaaaaatgtcaggacatcggcgtggcggtcggaggcgatgtcgaagtgtctgccgacgaaacggaaatctatacgctgattaaaacctttgccgacaacgcggtacgttatacgccgcccgaaggcaggatagatttgggtttcacggacgaagggaaatatcttgccgtgtgggtggaagataacgggaaaggcattcccgaatccgaacgcgcccgtgtcctcgatccgttttaccgtattttgggaacggagcagcaggggacggggctgggtctgtccatcgccgacacgcttgccaaaaaatacggcggatatttggaattgtccgacagccgacgtttcggacgcggtctgctgatacgcgcgttgttggacaaggaaaccctgaaatag

SEQ ID NO: 5849 - DNA, 422 bp, Neisseria meningitidis
atgcgtgttttgctggtggaagacgatgcgatgattgcggaggcggtgtcggcaagtttgaaagacggcggctatgcggtggattgggtcaaaaacggcgcgcggctgccgctgcccagccttatgacttgatgctgctggatttgggtttgccggggcgggacggtttggatgtttgttccgctggcaatgcttgcaggtatgttttcctactacgaaaccttccacgaaacggaagcgttgcaggacgacctgctccgtcaggcggcattgtacgtcgcccccgattccaaacccgaaactttgcccgagggcgacggcgatacgcgtattttggtacagatgccgcagcaggaagaccctgttgtcagcctgcctgcgcatctggcggacggtctgcacacgcttcaggcggacgatga

SEQ ID NO: 5850 - DNA, 1314 bp, Neisseria meningitidis
atgctgacgtttatcggactgctgattatcggggtcatcgtatggctgctgctgacggaaaaagtgtcgcccatcatcgcattaatcttggtgccgctgtttggggcgttgctggcggggtttgatgtatcccaattaaaagaattttattcgggcggcaccaaatcggtgatgcagattgtgattatgtttatgttttccattttgttttttggaatcatgaacgatgtggggctgttccgtccgatgataggcggtttgattaagctgactcggggtaatatcgtggcagtgagtgtggggacggtcttggtgtcggtggtggcgcagttggacggggcgggtgcgacgacgtttttattggtcgtccccgcccttttgccgctttacaagcgtctgcatatgaatccttacctgctgtttttgctgctgacttccagtgcgggattgattaaccttctgccgtggggcgggccgaccgggcgggttgcaagcgtgttgggcgcagatgtgggcgaattgtataaacctttgttgacggtgcaaattatcggtgtggtgtttatccttgcgctgtccctgcttttgggtgtgcgtgaaaaaaggcggattgtccgggagttgggcgcgttgcccgccgtggcggatttgataaagccggtgcctttgtcggaagaagaacaaaaattggcgcgtccgaaactgttttggtggaatgtcctgctgtttttggcggcgatgagcctgcttttttcgggcatcttcccaccgggttatgtatttatgctggctgcaacggcggcgttgcttttgaattaccgcagcccgcaggaacagatggagcggatttatgcccacgccggcggcgcggtgatgatggcgtccattattttggcggcaggtacgtttttggggattttgaagggtgcggggatgttggacgcgatttccaaagacattgtgcatatcctgccggacgcgctgctgccttatctgcatattgccatcggtgtgttgggcattccgcttgagttggttttgagtacggacgcttattatttcggactgtttccgattgtggagcagattacctcgcaggcgggcgtggcgcccgaagcagcaggttatgcgatgttgatcggcagtatcgtcggcacttttgttacgccgctttcgccggctttgtggatgggcttgggtttggcgaaattgtcgatgggcaaacacatccgttattcgtttttctgggcgtggggtttgtcgctggcgatattggccagttcgatagcggcaggaatcgtgcctctgccgtaa

SEQ ID NO: 5851 - DNA, 159 bp, Neisseria meningitidis
atgataggggcggtttcgtttgaatcggcgcaccgggatgaatgcccccgcgccgtcccgataccgatttaccggttgttccgtatcggttgccgctgtgaaatgacggacggatgcaggaatggcggcaggcgtaaatgggaggaaatgaccgattga

SEQ ID NO: 5852 - DNA, 573 bp, Neisseria meningitidis
atgattatggctaagaaaatcagtattttggtgggcagcctgcgccgtgcttcttttgcgcgcaaagtggcattgaatgcggcggagatgttccccgaaggctggcaggcggaaatcgttgaaatcggacatctgccgctttacaatttcgattatgacgaccctgcggtggaagatgtgccgctacccgaaagctacacggctttccgcgaaacgattaaggcttcggacggcattttgttcgttacgtccgaaaataaccgcaccattcccgcctgtttgaaaaatgcggtggacatcggctcgaaaccgaatgccgacgtggcgtggaaaaacaaaccggcaggcatcatcagccattccgtcggcaagatgggcggttacagttcccaaaaaaacctgcgccttgcgctgtcttatttcgatatgcccgtaaccggacagccggaagtgtttttgggcaattcgccgacgctgtttgatgaaaacggcaaattgattgactcggcaagggattttgttcagtcatatattaatcagtttgtcggtttgattgaaagaaatgccaaataa

SEQ ID NO: 5853 - DNA, 1410 bp, Neisseria meningitidis
atgaatttccccaaaacagcggcctccctgctgctgcttctcgcctccctcgccgcacacgcgctcgataccggccgcattccgcaaaacgaaatcgccgtatatgtccaagagcttgacagcggaaaagtcatcattgaccaccgctcggatgtccccgtcaaccccgcctccacaatgaaactcgttaccgcgtttgccgccttcaaaaccttcggcagcaattaccgctgggcgaccgagtttaaaagcaacggtacggtaaacgacggcacgcttgacggaaacctatattgggcgggcagcggcgaccccgttttcaatcaggaaaacctgcttgatgctcaaaaacagttgcgcgaacaaggcatactcaatatcacgggacacctgatgctcgaccacagcctgtggggcgaagtcggcagccccgacgatttcgaagccgacagcggttcgccgtttatgacgccccccaatccaactatgctgtctgccggtatggttatggtgcgcgccgaacgcaatgccgccggcagtaccgacatcctcaccgatccgcctttgccgcatattttcgcccaaaacaacttgaaaattaccgcctcccaagctgcctgcccttcgatcaaaaaactgatgcgtgcatctttttcggacaatacgctgaaattgcgcggcaatattcccgagagctgtttgggcaagcctgtcggtgtccggatgttcgcgcttgacgaactgatccggcaaagttttaccaaccactggctgctcggcggcggacggatttcagacggtatcggcatagccgacacgccggaaggcgcgcagacacttgccgttgcacacgccaaaccgatgaaagaaattttgacggacatgaacaagcgttcggacaatctaattgcgcgttccgtcttcctcaaactcggcggcgacggcaaactgcccgccgtttccgaacaggcggcgtctgccgtccggcgcgaacttgccgtatcgggcatcgatgttgcggatttggttttggaaaacggttcgggcctgtccagaaaagaaagggtaacggcgagaatgatggcgcaaatgttggaaacggcttatttcagcccgtttgcacaagatttcatcgacacgctacccatcgccggcacagacggaactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgccagacttggacaacttcgttgccaacaacatcatctccggcggcgatggctggctggatgcgaaactgatgtgcaaagaacgccgagcctga

SEQ ID NO: 5854 - DNA, 643 bp, Neisseria meningitidis
atgagaaaaagtcgtctaagccggtataaacaaaataaactcattgaactgtttgtcgcaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagtattgtttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaatcaggcaaaacgtcatttacgcaagtttaacggcattcccaaagcgcattttgagctgtatttaaaggagtgcgaatggcgttttaacaacagtgagataaaagttcttgttccattttaa

SEQ ID NO: 5855 - DNA, 1170 bp, Neisseria meningitidis
atgagcgaatatctgtttacttccgaatcggtatccgaaggccatccggataaagttgccgaccaagtatccgatgcgattttggatgccatcttggcgcaagacccaaaagcacgtgtcgccgcagaaaccttggtcaacacaggcttgtgcgtattggcaggcgaaattaccaccaccgcccaagtagactacatcaaagtcgcacgcgaaaccatcaaacgcatcggctacaactcctccgagctgggctttgatgccaacggctgcgcagtcggcgtgtactacgaccagcaatcccccgacatcgcccaaggcgtgaacgaaggcgaaggcatcgacttgaaccagggcgcgggcgaccaaggtttgatgttcggctatgcctgtgacgaaacccctaccctgatgccgtttgccatctattacagccaccgcctgatgcagcgtcaaagcgaattgcgcaaagacggccgcctgccttggctgcgtcctgatgccaaagcccaactgaccgtggtttacgacagcgaaaccggcaaagtaaaacgcatcgacaccgtcgtcctgtctacccagcacgatccgtccatcgcttacgaagagctgaaaaacgccgtaatcgaacacatcatcaaaccggttctgccgtctgaactgctgaccgacgaaaccaaatacctgatcaacccgaccggccgcttcgttatcggcggcccgcaaggcgactgcggtttgaccggccgtaaaatcatcgtcgatacctacggcggcgcggctccgcacggcggcggcgcattctccggcaaagacccgtccaaagtggaccgttccgccgcttacgcctgccgctatgtcgcaaaaaacatcgtcgccgcaggtttggcaacccaatgccaaatccaagtttcctacgccatcggcgttgccgaaccgacttcgatttccatcgatactttcggcaccggcaaaatcagcgaagaaaaactgattgccttagttcgcgaacatttcgacctgcgccccaaaggcatcgtccaaatgctcgatctcttgcgcccgatttacagtaaatccgccgcttacggacatttcggccgcgaagaacctgagttcacttgggagcgcaccgacaaagctgctgcattgagggcggcagcggggctgtaa

SEQ ID NO: 5856 - DNA, 204 bp, Neisseria meningitidis
atgaacataatgtcgacagcgggaaatatagcaaaatttccctattcataccattcagttgagaaatattcccatttgaatagcactttggaatctctgcccgtacgtttcttacaggcaaaaaaattcccgcatcaagcgggtttggattgctctggtgagccacatcggcttttcaaccgtccaccttacttttccttttga

SEQ ID NO: 5857 - DNA, 897 bp, Neisseria meningitidis; identical to SEQ ID NO: 567

SEQ ID NO: 5858 - DNA, 1065 bp, Neisseria meningitidis
atgttggtattaggaatcgagtcttcttgcgacgaaacaggtgttgcgctttacgatacggaacgtggattgcgggcgcactgcctgcacactcaaatggcaatgcacgccgaatacggcggggttgtgccggaattggcaagccgcgaccatatccgccgccttgttccgttgacggaaggctgtctggcgcaggcaggcgcatcgtatggcgacattgacgcggttgcctttacgcaggggcccggtttgggcggcgcgctgctggcgggttcgagctacgccaacgcgctggctttagcgttggacaagcctgttattcccgtccatcatttggaaggacatctgctgtcgccgctgttggcggaggaaaaacccgactttccttttgtcgcgctgttggtttcgggcgggcatacgcagattatggcggtcaggggcataggcgactacgcgcttttgggcgagagcgtcgatgatgcggcgggcgaggcattcgacaaaacggcgaaactgctgggcttgctgtatccgggcggtgcgaaactgtcggaacttgcggaatcgggcaggttcgaagcgtttgtttttccgcgcccgatgattcattccgacgatttgcagatgagtttttcaggtttgaaaaccgccgtattgaccgccgtcgagaaagtgcgcgcggaaaacggggcggatgacattcctgagcagacacgcaacgacatctgccgtgcgtttcaagatgcggtagtcgatgtgttggcggcgaaagtgaaaaaagccctgttgcagacagggttcagaaccgtagtggtcgccggcggggtcggtgcaaaccgcaagctccgtgaaactttcggcaacatgacggtgcaaatcccgacccccaaaggcaagccgaaacatccgtccgaaaaagtcagcgtgtttttcccgccgacggcatactgcacggacaacggtgccatgattgcctttgccggtgcgatgcacctgggcaagggcagggaggtcggtgcgttcaatgtccgtccgcgctggccgctgtcggaaatcgtcagatga

SEQ ID NO: 5859 - DNA, 1188 bp, Neisseria meningitidis
atgactgaacactataaaacccttccggaacacgagctgctgattcagaagtctttgatcagcaatctgaatctttgggattgggtatttgccgtgctggtttttgcggctacggttttcgtacagacccgttccggtatgcatatggacatttacgaaacggtcatgttgtgggcaagtgccggtattgccgtgtttttgggttggtttttcaaaccgatgcgctggtttgttcctttaagcgtattgcttgcctatgccgccgtcggtttgtacggaggcgacatcaaatcggcagagattttcctgttgcggtatttcctcagcagccagtcggcgatcatgtggcagtgcgcctttgtctttttcgccctgttcgcctatatttcgggcgcggttttggcaagcgtaaaaaatgtgccgaccaacacgctgttgggtatgggaaccgtgtttgcatgggtgtctgccgtagcaggctttaccggtctgctggtacgttggcacgaaagctatctgctccgtcccgatgcggggcatattccggtttccaacctgtatgaagtgttcatcctgtttttggtgattaccgcgctgatgtatctttattatgaaggtaagttcgccatacagaaattgggcggcttcgtgttcggctttatggcggtcgtggttggatttgtcttgtggtacagcgtgtcccgcgaggcgcataccatccagccgctgattcccgcgctccagtcctggtggatgaaaatccacgttccggcaaactttatcggttacggcgcgttttgcatttccgcgatgctcggtattgccgaactggtttccctgcgtgcggaaggaaaaggcggaaaactgtggctgccgccgtcggcattgatcgacgaggtgatgtataaggcgattgccgtcggctttctgttctttaccattgccaccattttgggtgcgctgtgggcggcagatgcttggggacgctattggagttgggatccgaaagagacgtgggcgttcatcgtctggctcaattacgccgtttggctgcacttgcggctggttgccggttggcgcggcaaagtgctggcgtggtgggcgattatcggtttgttcgtaaccgcatttgcctttatcggcgtgaatatgtttttgagcgggctgcattcttacggaacgctttga

SEQ ID NO: 5860 - DNA, 2016 bp, Neisseria meningitidis; identical to SEQ ID NO: 329

SEQ ID NO: 5861 - DNA, 624 bp, Neisseria meningitidis
atgaaacgattgactttattggcctttgttttggctgccggtgcggtttccgcctctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaactatcggcatccgcgacggtaaacgcacccacggttcggcagctgtgatgaaaccggtggtaatgaatttgagcgatcaggatattttgaacgtatccgcattctatgccaaacagcagcccaaatccggtgaagccaatcctaaggaaaatcccgaattgggtgcgaaaatctatcgcggcggtttgagcgataaaaaagtgccggcgtgtatgtcctgccacggtccgagcggtgcgggtatgccgggaggcggaagcgaaattcaggcttatccgcgtttgggcggtcagcatcaggcatatattgttgaacagatgaatgcctacaagtccggtcagcgtaaaaataccatcatggaagatattgcaaaccgtatgtctgaagaagatttgaaagcggtcgccaactttatccaaggtttgcgttaa

SEQ ID NO: 5862 - DNA, 636 bp, Neisseria meningitidis
atgcccatgaacctttttcaaaacgccaaattcttcacgacgatcaaccaccttaaagacctgcccgacacccctctcgaaattgcctttgtcggcaggagcaatgccggaaaatccagtgccatcaataccctgaccaaccatgtccgtcttgcctacgtttcaaaaacacccggacggacgcagcatatcaacttcttcgagctgcagaacggcaattttatggtcgatttgcccggctacggttatgcccaagtccccgaagcagtacgcgcacattgggtcaatctgctcggcgactatctgcaacagcgcaaacagcttatcgggctggttttgattatggatgcccgccatcctttaaaagaactcgacatccgtatgctggattttttccacacgaccggcagaccggttcacatcctgctgtcaaaagccgacaaattatccaaaaacgaacagataaaaaccctgtcccaagtcaaaaaactgctcaaaccttattccgacaggcaaaacatcagcgtacagctgttttccagcctgaaaaaacaaggtattgacgaggccaaccgaactgtcggaagctggttggacgcagcagatgccgccgcttcctctccagaggaaaactga

SEQ ID NO: 5863 - DNA, 2397 bp, Neisseria meningitidis
atgattaaaaagattttaacgacttgttttggtttggtttttgggttttgtgtatttggagtgggtttggttgccattgctattttggtaacgtatccgaaactgccgtctttggattctttgcagcattaccagcctaaaatgccgttgactatttattcggcggatggggaagtcatcggtatgtatggggagcagcggcgcgaatttacaaaaatcggcgatttcccagaggtgttgcggaatgcggttatcgccgccgaggataaacgcttttaccggcattggggggtggatgtttggggtgttgcccgcgctgccgtcggcaatgtcgtgtccggcagcgtgcagtcgggtgcgagtacgattacgcagcaggtggcgaaaaatttttatttgagcagtgaaaaaacgttcacacgcaaattcaatgaggtgttgcttgcctataaaatcgagcagtctttaagcaaagacaaaatcctcgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccagaacgtgccaagttgcgccagaagtatattttgaacaatatgctcgaggagaagatgattaccgtgcaacagcgcgatcaggcgttgaatgaggaactgcattacgagcggtttgttcggaaaatcgatcagagtgcgttatatgtggcggaaatggtgcgtcaggaactgtatgagaaatacggtgaagatgcctatacgcagggttttaaggtttataccacggtccgcgccgatcatcagaaggtggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgtgactaaaaagaaaaatgtcgtcatacagctgcccggcggcaggcgggttacgcttgacaggcgcgccttgggttttgcggcccgcgcggtcaataatgaaaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggtcgtccgagctgccggcaagcctgtctatggctttaggtacgggcgagacaacgccgttgaaagtggcggaggcatatagcgtatttgcgaacggcggatatagggtttcttcgcacgtaatcgataagatttatgacagagacggcaggttgcgcgcccaaatgcaacctttggtggctgggcaaaatgcgcctcaggcaatcgatccgcgcaatgcctatattatgtataagattatgcaggatgtggtccgtgttggtacggcaaggggggcagctgcgttgggaagaacggatattgccggtaaaacgggtacgaccaatgacaataaggatgcgtggtttgtcggttttaaccctgatgtggttactgccgtatatatcggcttcgacaaacctaagagtatggggcgtgtcggctacggcggtacgattgcggtgccggtttgggtggactatatgcgttttgcgttgaaaggaaagcagggcaaggggatgaaaatgcctgaaggtgtggtcagcagcaatggcgaatactatatgaaggaacgtatggtaaccgatccgggcttgacgctggacaacagcggtattgcgccgcaaccttcccgacgggcaaaagaagatgacgggggcgcggcagaaggcggacggcaggcggcggatgacgaagtccgccaagatatgcaggaaacgccggtgcttccgagtaatactggttccaaacagcagcagttggattctctgttttaa

SEQ ID NO: 5864 - DNA, 1116 bp, Neisseria meningitidis
atgcgcttgtttaaaagcttgaaaaaccctaaaaaaacagatgccaagctccctaaaaaatcttcgggactcaataaccgcgcggcaatcggcatcgatatcgaccagcattccatcaaaatggtccaattgtcaggacgtagtttaaaccaaattcaattggaaaaatacgtcattgccaaattaccaaagaatatcattcaaggcaataaagtccaaaattacgatcaacttgttacatatttgcaacaagcctatgccaaactgggtacttcgtgcaaaaacatcatcgcgtccgtcccgcaaaatttggcaaccatcgaacaattgacctacacagacaaagatgcagaattagacctgcaggggttcgtggagtcctccatctccgaagtcagctcgatatcgctcgaagaagccaattacgactatcaggtcttgtcccaatcggccgccggcgaagctgtgttggccgtcgcatcgagaaaggatgaaatcgaacccctgattgacgcattcaacgccgccggtatgaaattatccgcgcttgatgtggacattttcggacaatacaacgcctacgcgctatggataaaccatttcgcccccgagcttgcagccgaaaaagtcgccattttcggcgtatatgccgcacagacctacgccttggtcatccaagacggaaaaatcctatacaaacaggaaacctccgtcagcgaagaacagctcaaccaactcatccagcgcacctatcaggtaacagaagaaaaagcggaagaaatcatcaactccccgcaaaaaccttccgattaccaagaaagcgtggcaaactatttcaaccagcagattacccaagaaatacaaagggtcttgcagttttattacaccacgcagaccgcagacgatatgaccgacatcaagcatatcctgctgaccggggaagcggcgcgccaggaaggcatcgcccaaaccgtcgcctcacaaaccaatgcagatgtacaatgcgtccatcccgcgcgttattttgcggacaacctcaaaacagacaaacaacaattcgaacttgatgcgccgacactgaccagggcgttcggtttggcggtacggggattataa

SEQ ID NO: 5865 - DNA, 600 bp, Neisseria meningitidis
atgaacaatttaatcaaaatcaacctcctcccctacagggaagagatgaacaagcgcaaacagcagcagtttaaaacgctgatgtacggtgccgtgctgacgggcgttgccgccgttgcggcaacctacctgtttatcgacaatatgatcaataaccagtcggaaagaaacacgctgctggaaacctccatcgcacacttggataccgagctgtcggaaatacaaaagctcaaacaggaaaaagatgccttcctgattaagaaaaacaaaatcgaggagctccagctcaaacgcctccaagccgcaaaaatcctcgacagcctgaatgaggccgtccccggaagcacctacctgacctcgctggatgccgttaccgccgactcttatcggctcagcggcaggacatccagcgacaaccgcgttgccgccatgatgagggcgatgcccaataccggcatattcaagcaacccgaattgttaagcatcaagaaaaacaattcgcatcaagaatttacccttcaggcaacattacaacccatcgtaaaggcggccgaatccaaagagaatccggcttcgggaaacgcacaggaggcaaactga

SEQ ID NO: 5866 - DNA, 648 bp, Neisseria meningitidis
atggcttctaaatcatctaaaaccaacttggatctcaacaaccttcacctgctcaaccttcctgccaggctttttatcgccctgctggccgttgccgccgtgctggggctcggttatgccggattgttcaaaagccagatggaatcccttgaggaatacgaagcaaaagaaaccgaactgaaaaacacctacaaacagaaaagtatcgacgcggccagcctgaacaacctgagggacgaacttgcctcaatccgctctgccttcgatatcatgttgaaacagctgccgacagatgcagaaattcccaatctggttcaagagcttcatcaggcaggttcgagcaacggtctgcgcttggacagcgttatgccccaacctcccgtagatgacggccccatcaaaagattaccctattccatttccattaccggaaattacgaacagatcagccaatttacccgcgatgtcggcagcctctcccgaatcattacccttgagtcgctgaaaatcgcccaatctccggaaaacggcggcaatcctgacggcaagagcagcatcctgaacctcagcgccattgccaccacctaccaagcaaaatccgtagaagagcttgccgcagaagcggcacaaaatgccgagcaaaaataa

SEQ ID NO: 5867 - DNA, 546 bp, Neisseria meningitidis
atgaaacactatgccttactcatcagctttctggctctctccgcgtgttcccaaggttctgaggacctaaacgaatggatggcacaaacgcgacgcgaagccaaagcagaaatcatacctttccaagcacctaccctgccggttgcgccggtatacagcccgccgcagcttacagggccgaacgcattcgacttccgccgcatggaaaccgacaaaaaaggggaaaatgcccccgacaccaagcgtattaaagaaacgctggaaaaattcagtttggaaaatatgcgttatgtcggcattttgaagtccggacagaaagtctccggcttcatcgaggctgaaggttatgtctacactgtcggtgtcggcaactatttgggacaaaactacggtagaatcgaaagcattaccgacgacagcatcgtcctgaacgagctaatagaagacagcacgggcaactgggtttcccgtaaagcagaactgctgttgaattcttccgacaaaaacaccgaacaagcggcagcacctgccgcagaacaaaattaa

SEQ ID NO: 5868 - DNA, 2310 bp, Neisseria meningitidis
atgaataccaaactgacaaaaatcatttccggtctctttgtcgcaaccgccgcctttcagacagcatcggcaggaaacattacagacatcaaagtttcctccctgcccaacaaacagaaaatcgtcaaagtcagctttgacaaagagattgtcaacccgaccggcttcgtaacctcctcaccggcccgcatcgccttggactttgaacaaaccggcatttccatggatcaacaggtactcgaatatgccgatcctctgttgagcaaaatcagtgccgcacaaaacagcagccgtgcgcgtctggttctgaatctgaacaaaccgggccaatacaataccgaagtacgcgggaacaaagtttggatattcattaacgaatcggacgataccgtgtccgcccccgcacgccccgccgtaaaagccgcgcctgccgcaccggcaaaacaacaggctgccgcaccgtctaccaagtccgcagtatccgtatccgaaccctttaccccggcaaaacaacaggctgccgcaccgtttaccgagtccgtagtatccgtatccgcaccgttcagcccggcaaaacaacaggcggcggcatcagcaaaacaacaggcggcagcaccagcaaaacaacaggcggcagcaccagcaaaacaacaggcggcagcaccagcaaaacaaaccaatatcgatttccgcaaagacggcaaaaatgccggcattatcgaattggctgcattgggctttgccgggcagcccgacatcagccaacagcacgaccacatcatcgttacgctgaaaaaccataccctgccgaccacgctccaacgcagtttggatgtggcagactttaaaacaccggttcaaaaggttacgctgaaacgcctcaataacgacacccagctgattatcacaacagccggcaactgggaactcgtcaacaaatccgccgcgcccggatactttaccttccaagtcctgccgaaaaaacaaaacctcgagtcaggcggcgtgaacaatgcgcccaaaaccttcacaggccggaaaatctcccttgacttccaagatgtcgaaatccgcaccatcctgcagattttggcaaaagaatccggaatgaacattgttgccagcgactccgtcaacggcaaaatgaccctctccctcaaggatgtgccttgggatcaggctttggatttggttatgcaggcgcgcaacctcgatatgcgccagcaagggaatatcgtcaacatcgcgccccgcgacgagctgcttgccaaagacaaagccctcttacaggcagaaaaagacattgccgatttgggtgcgctgtattcccaaaacttccagttgaaatacaaaaatgtggaagaattccgcagcatcctgcgtttggacaatgccgacacgaccggaaaccgcaacacgcttatcagcggcaggggcagcgtgctgatcgatcccgccaccaacaccctgattgttaccgacacccgcagcgtcatcgaaaaattccgcaaactgattgacgaattggacgtacccgcgcaacaagtgatgattgaggcgcgtatcgtcgaagcggcagacggcttctcgcgcgatttgggcgttaaattcggcgcgacaggcaagaaaaagctgaaaaatgatacaagcgcattcggctggggggtaaactccggcttcggcggcgacgataaatggggggccgaaaccaaaatcaacctgccgattaccgctgccgcaaacagcatttcgctggtgcgcgcgatttcctccggtgccttgaatttggaattgtccgcatccgaatcgctttcaaaaaccaaaacgcttgccaatccgcgcgtgctgacccaaaaccgcaaagaggccaaaatcgaatccggttacgaaattcctttcaccgtaacctcaatcgcgaacggcggcagcagcacgaacacggaactcaaaaaagccgtcttggggctgaccgttacgccgaacatcacgcccgacggccaaatcattatgaccgtcaaaatcaacaaggactcgcctgcgcaatgtgcctccggtaatcagacgatcctgtgtatttcgaccaaaaacctgaatacgcaggctatggttgaaaacggcggcacattgattgtcggcggtatttatgaagaagacaacggcaatacgctgaccaaagtccccctgttgggcgacatccccgttatcggcaacctctttaaaacacgcgggaaaaaaaccgaccgccgcgaactgctgattttcattaccccgaggattatgggtacggccggcaacagcctgcgctattga

SEQ ID NO: 5869 - DNA, 513 bp, Neisseria meningitidis
atgaaaaactttaacggcaaactcatcctcatcggactgatgggcgcgggcaaaaccacgctgggccggcaaatggcgcagcggctggattaccgtttttacgacagcgatcacgaaatcgccgcagccgccggcgttcccatccccaccatatttgaaatggaaggcgaacagggattccgttcgcgcgaaaccgccatactcaaaaagctggttatcctgccccatatcgtcctgtccaccggcggcggcgcggtgttaaaagaagaaaaccgcgcccttatccgcaaaagcggcacggtcgtctatctgcacgccccgcccgaaaccctgctcgaacgcacgcgctgcgacaacagccgtcctttgctgcaagttgccgatcctttggcgaaattacgtgaactctacgccgcacgcgaccccgtttaccgccaaaccgccgactttaccgtagaatcggcaaactgccgggaaaccgtgcaaaccctgctcaaacgcttatcccgataa

SEQ ID NO: 5870 - DNA, 1080 bp, Neisseria meningitidis
atgaaaacactgaccgtacacaccccgtcccacagctaccccatctttatcggcaacggactgctgccgcaggcaggaagcctgctcaaaccgcatttgggcaaacgcgccgccatcatcgccaacgaaaccgtcgccccgctctacctcggcacgcttcagacggcattggatgcggcaggcgtatcccatttcagcatcatcctgcccgacggcgaggcgcacaaaaactggcagacgctcaacctcatctttgacgggctgatgcaaaaccgcgccgaacgcaaaaccacattaatcgcactgggcggcggcgtgatcggcgacatggtcggctttgccgctgccacctaccagcgcggcgcaccgttcgttcaaataccgaccacgctgttgagtcaggtcgactcatcggtgggcggcaaaaccgccatcaaccacccgctcggcaaaaatatgattggcgcgttttaccagccgcaggcggtgcttgccgacttggacacgctgcacaccctgcccgcccgcgaattgtccgccggtatggcggaagtcatcaaatacggcgcgctcggcgacatcggcttttttgaatggctggaacagcatatgcccgaactgatgacgctcgatcgggaaaaactcgcccaagccgtgtaccgctgctgccaaatgaaggcagacatcgtcgcccaagacgaaaccgaacagggcatacgcgcatggctcaacctcggacacaccttcggacacgccattgaaaccgagatgggttacggcacttggctgcatggagaagccatcgccgccggctgcgtgttggcggcgcgtttgtccgaacaactgggcaaaacctccgccgcagataccgcgcggctcgccgccctgctcgaagccgccggactgccgtccgcgccacccgtgtttgcctttgaaaaatggctggaacacatgagccacgataaaaaagtcagcggcggcatcatgcgctttatcggtctgaaccggctgggcgaagccaacatcaccgaaattaccgacacggacatcctccgccgcaccctgcaaccgtatctctga

SEQ ID NO: 5871 - DNA, 843 bp, Neisseria meningitidis
atgtgtcaactgctgggcatgaactgcaatacgccgaccgatattatgttttcctttgaaggcttccgccgcaggggcggcattaccgaccaccatgccgacggtttcggtatcggctttttcgaaggcaaaggcgtgcgcctgttccacgacgacaagccgagcgtaaattcccccgtcgccgacctcgtgcgtgcctaccaaatcaaatcggaaaacgtcatcgcacatatccgcaaagcatcgcaaggacaaacctcgctggcgaacacccatccctttatgcgtgaaatgtggggcggctactggctgtttgcccacaacggacatttgattgattttttccccgaacagggcgaatttttccaccccgtcggcacaaccgattccgaacgcgcgttctgccacatcctcaaccgcctgcgcacccgctttgccgcccgtcccgacgacgacacgctgtttgacgcgattgcggggctgacgcacgaaatccgcaagttcgggctgtttaactttatgctttcagacggcattgccctgtttgcccacgccagcacgctgctgcactacatcgtccgccaagccccgttcggcaaggcgcgcctgctcgacgacgacgtgatggtcgattttgccgaagtaaccacgccctccgaccgcgtcgccgttatcgccaccctgccactgacccgcgacgaatcatggtcccaacttgccgtggacgaactggtcatgttccgcgaaggcaacatcgtccgacacgaccgtcccgaaaaccccgtctatatgagtgccgaagaaggtctggaaatcgcccgcgccgccggcgtcgccgtctga

SEQ ID NO: 5872 - DNA, 465 bp, Neisseria meningitidis
atgaaatgcccgttttgcgcccaccccgacacccgcgttgccgattcgcgtctgatggaagaacgcaacgccgtgcgccgccgccgccactgccccaactgcggcaaacgcttcggcacgctcgaaaccgccgaactcaaaatgcccgccgtcatcggtccggacaaaaaacgctcgccctttaatgcacaacgcctccgcaacgacctgaccgccgccgcccgaaaatccgccctgacacccgaacagatcgacgaaaccgtccgcctgacggaacacaggctctacacttcgggtcagcgcgacatcccctctgccgcacttgccgacatggtgctaaaagaactgctccgacaagatacggaagccgccgtccgtttcgccgccctgcacaaacgcttcgacaatccggcagactttgcctcgtggctggcgcaagccgtcaaaacaggcggcaaagcctga

SEQ ID NO: 5873 - DNA, 1110 bp, Neisseria meningitidis
atgttttcggacacagatatatccatgatggaaaacgccctccgacttgccgctttggggcgtttttccacttcgcccaatccgcgcgtcggctgcgttatcgcacacggcagccaaattgtcgggcaaggcttccacgtcaaagcgggcgaaccccatgccgaagtccacgccctgcgtcaggcgggcgaaatggcacaaggcgcgaccgcctttgttaccctcgaaccgtgcagccattacgggcgcacaccgccctgtgccgaagcactggtgcgggcgggcgtgtcccgcgtcgttgccgccatgcgcgaccccaacccgctggttgcaggcaaagggcttgccctgctcgaagcagcaggcatcaagacggaatgcggtttactcgaacatcaggcaagggaactcaaccgaggcttcctgtcgcgcatcgaacgccgccgcccctttgtccgcctcaaatgcgccgtttcgctggacggcaaaaccgccctttcagacggcagcagcttttggattaccggcgaagacgcgcgtgccgacgtacaggttttgcgtgccgaaagctgcgcggtgctgaccggcatcggcacggtgttggcggacaatccccggctcaacgtccgcgcttttccaactttgcgccaacccgcacgcatcgttttagacagccgcctgcgcctgcccccgaacagccatttggttaccgacggacaatctccgacctacatcgccacactcgaacgcaacgaagacagactgcacccctatcgggaacacgcacacgtccgcatcctgatgccgtctgaaacggcagacagcaaaatcgacctgcaccacctgatgcgcctccttgctgacgaaggtttcggcgaaatcatggtcgaagcaggctccgaactcacatccgcatttttggcagaaaatctggcagacgaaatcgtcctgtaccgttcgcccaaaatcctcggcagcggcaaagacctgttttccctgctcgaaaaccgcgccgccctttccgcaccgcccttgtggacacccgtttcaagcgaaatcctcggacacaacatcaaaaccgtgttccgaaaaaacggcaacgccttttaa

SEQ ID NO: 5874 - DNA, 1422 bp, Neisseria meningitidis; identical to SEQ ID NO: 375

SEQ ID NO: 5875 - DNA, 156 bp, Neisseria meningitidis
atgaaaatcgttttgaccacatctatggcaggcttgggcggcacgggcacgatatcatcgattgccaaatggcgtgcaaaaacgaccccgttcagtccgacgaaatcgtccgccgcttcaggcgcgacatttcctatcggaaaatcgtcaacctga

SEQ ID NO: 5876 - DNA, 1242 bp, Neisseria meningitidis; identical to SEQ ID NO: 13

SEQ ID NO: 5877 - DNA, 1176 bp, Neisseria meningitidis
atgctgaacactttcctttccccgtggccctgcttcacccaagaagaagccgatgccgtttccaaagtcctgctgtccaacaaagtcaactactggacgggcaacgaatgccgcgaatttgaaaaagaatttgccgcctttgccggcacgcggtacgccgtcgcccttgccaacggcacgctggcactcgatgtcgcgctcaaagcaatgggcataggcgcgggcgacgatgtgattgttacctcgcgcaccttcctcgcttccgcgtcctgcattgtgaacgcgggcgcaaaccccgtgtttgccgatgtggatttgaacagccaaaacatcagcgcggaaaccgtcaaagccgcgctgacaccgactaccaaagccgtcatcgtcgtccacctcgccggtatgcccgccgaaatggacggcattatggctttggcaaaagaacataatctttgggtaatcgaagactgcgcccaagcgcacggcgcaaaatacaaaggcaaatccgtcggctctatcggacacgtcggcgcgtggtcgttctgccaagacaaaatcatgaccaccggcggcgaaggcggtatggttacgaccaacgacaaaaccctgtgggaaaaaatgtggtcgtacaaagaccacggcaaaagctacgatgccgtgtacaaccacgaacacgcgcccggtttccgctggctgcacgaaagtttcggcacaaactggcgtatgatggaaatgcaggcggtcatcggacgcatccagctcaaacgcctgcccgaatggacggcgcgccgccgagaaaacgccgccaagctggcggaaagtttgggcaaattcagcagcatccgcttggttgaagtcgccgactacatcggacacgcgcaatataagttctacgccttcgtcaaacccgaacacctcaaagacggctggacgcgcgaccgcatcgtcggcgaactgaacgcgcgcaaagtcccctgctatcaaggcagctgctccgaagtctatttggaaaaagccttcgacaacacgccgtggcgaccgaaagagcgtttgacaaatgctgtcgagttgggcgacaccagcctgatgttcttggtgcacccgacgctgaccgacgacgaaattgcgttttgcaaaaaacacatcgaagccgtcttgaccgaagccgcacgataa

SEQ ID NO: 5878 - DNA, 1911 bp, Neisseria meningitidis
atgaatctggaaactctgatcgccctgccgcgcaacatcaagaaaatctgtttcctcatacacgattttctgatgattttcattgccttttggttcacccaaagcctaaaggccgactactcggacgaatggttcgattttgccaactggcagtcttttttgctgactgccttgctgaccatcacattatttatccgaatggggctttaccacgccgttacacgcttcgtcagcttccgcatcctcaccaccgcactggcgggcagcctcgcctccgccgtgttgtttttcctcaatacgctgatatttgaagaaaggctgcgcctcgccctgccgattgtctatttcttactgctgtttgtttccgtgaccggctcgcgtatggttttgcgcggactgttgtccgaacaccccaaaaaacagatgatccctgtcatcatttacggcgcgggacggtcgggcagacaactgcttgaggccgtcaaacaaatgcgcgaatattccgccgccgcctttgtagacgacgaccccaaactgtggcacaccgtcatctacgaccttgccgtttaccagcccgatgccatcgccttcctcatcgaacgctacggcgtggaaaaaatcctgctcgccatccccggcgcgacccaggaacaacgccgccgaatcatcaacaaactggaagcctatccgtgcgaagtgttgaccattcccggaatgaaagacctgatggacggaaaaatcagcatcggcacgctcaaaaaaatctctgtgtccgacctgctcgggcgtgattccgtcgcgcccgacgaccgcctgatgagtgccgacatcgaaggcaaaaccgtcatggtaaccggcgcgggcggctccatcggttcggaactctgccgccagattatccgccgccgccccgaaaagctgctgctgttcgagttatccgaattcgccctgtacgccatcgaaaaagaattgcgcgaaacctgcatccaaaaacgcctcgacaccgaaatcctgccctttctcggttcggtgcaaaaccgcacgctgctcgaacacgtcatgaccgccttttccgttgcgaccgtctatcacgccgctgcctacaaacacgtccccatggtcgagttcaacaccgtcgaaggcatacgcaacaacatcttcggcacactcgagtgcgcgcttgccgccacgacatcgggcgtaagaactttcgtcctcatctccaccgacaaagccgtccgccccaccaacaccatgggtgccagcaaacgcatggcggaactctgccttcaggcactcgccgccgaacccggacaaaaaacccgcttcagcatggtacgtttcggcaatgttttaggttcgtccggctccgttgtcccgctgtttgaaaaacagattgcagaaggcggcccgcttaccctgacccaccccgaaatcacacgttatttcatgaccatacccgaagccgcccaactcgtcatacaggcaggcgcgatgggtacgggcggcgacgtattcgtcctcgacatgggtgaatccgtcaaaatcatcgaccttgcccgccaaatgattaccctaagcggcctcaaacccaacacacccgaacaacccgacggcgacatcgaaatcctcattaccggactgcgtcccggagaaaaactctacgaagagctgctcatcggcgacaacgtccgcaaaaccggccatccgcgcatcatgaccgccaacgagaccatgctgccgtggcacgagctctccgccctgctcgaccgcatccgtgcggcctgcgaccgttacgaccagcaggcaatccgcaccctgctcatcaacgccccgaccggctttgccccgagcgacggcatctgcgacctgctttgggtacgagaaacacacagaaaaaatgccgtctga

SEQ ID NO: 5879 - DNA, 1293 bp, Neisseria meningitidis
atgcagttctcagcattcggcgaaaaattcacgcaacacagcggcatcctccaactgatggacgacctcggcgacgcgctcaaaagcgacaagcccgtcaacatgctcggcggcggcaacccggcgcgcattccggaaatcgatcaggcgttcgccgacatattctccaaactggcggcagaacacgccgtcgaaaacatcggcaactactccaatccccaaggcgatgccgtgctgattgacgcgctgaccgccttcctcaaccgcgaatacagctggaatctgaccgccgacaatatcgcgctgaccaacggttcgcaaaacgcgtttttctatcttttcaacctcttcggcggcaaattcaacctttcagacggcacatccgcagaaaaagccattttgttgccgctcgcgcccgaatacatcggctatgccgacgtgcatgtcgaagggcagcacttcgtttccgtcaagcccaaaatcgaaaacgtcgaacacgaaggcgaagccggcttcttcaaataccgcgtggactttgacgcactggaaaacctgcccgaactcaaagcgggcaaaatcggcgcgatttgctgttcgcgcccgaccaacccgaccggcaatgtgttgaccgacggcgaaatggcgcgtttggacgctttggcgcgtgaacacggcattccgctgattatcgacaacgcctacggaatgccgttccccaacatcatttacagcgacgtaacgctgaattggcacgaaaacatcatcctctgcttcagcctgtccaaagtcggcctgccgggcgtgcgcaccggcatcatcgtcgccgcgcccgaagtcgtcaaagccgtcagcagcctgaacgcgattgtgaaccttgcccccacgcgcttcggcgcggccatcgcaacgccgctgctggaaagcggcgagatgaaacggcttgccgaccaagtcatccggccgttttaccgcaatcaggcgcaaaccgccgtctcgctgctcaagcgggagctgggcgcgtacccgatgaaaatccacaaacccgaaggcgcgattttcctgtggctctggtttgaaaacctgcccgtttcttcgcaaaccctgtacgaaatgctcaaagccgaaggcacactgattattccgggcgaacatttcttcgtcggcatcgacacgcaggattacccgcatgcgggcgagtgcatccgcatgagcatcgcgcaggacgctcaaacgctggaaaaaggcattgccgccatcggtaaaaccgtccgaaaactgtacgacaacgtttaa

SEQ ID NO: 5880 - DNA, 837 bp, Neisseria meningitidis
atgatagacctgcactgccattccaccgtttccgacggtatgctctcccccgccgaagtcgtgcgcctcgcgcatcaaaacggctgcacgctgctggcgttgaccgaccacgaccacaccggcggcatcgccgaagcgcgcgccgaagccgacaagctcggtttgcgcctgattaacggtgtggaaatctccgtaacgtggcgcgggcgcaccatacacgttgtcggtttggatttcgacgagcaggacgaaaacctgcaaaacctgttggcgcaagtgcggaaaggccgtctgaaacgtcttgaagccatcgccgccaagctcgaaaagaaaggcatcggcggcgcatacgacggcgcgctggcactggcggcaaacaaagaaatggtcagccgcacccacgtcgccgagttcctcatccaagcgggacacgtcaaaaacaagcagcaggcgttcaccaaatacttgggcgacggcaaatcctgcgccgtccgccacgaatgggcgacgctggaagactgcgtctccgccgtcaacggagcgggcggcatggcagtcatcgcccaccccatgcgctacgatttgtccgccaccgccaagcgcaatttgtttgaagaatttaaaaacctcggcggcgcaggcatcgaagtccacagcggaaactgctgcaaaaacgaccgcctcaactacgcgcttttggcagaacgcttcggtatgctcgccagcgcgggcagcgacttccaccgcttaaacgacttcagcggcggcatcctcggcgcgtgtcccgagctgccggaaaactgcaaaccggtttgggaacatttttcccgatattga

SEQ ID NO: 5881 - DNA, 204 bp, Neisseria meningitidis
atggatacgaccctgaagtataaagccgaagcccttttgggcgagccgcttttagacgaacccgtccgacccgagtcgtgggaatgctgcggcagcgactgcggcgaggcgtgcattcagacgatttactgggcggataaagccaaatacgacgtgcaacggcagaaattgaaagaagcgggttggtcggacgatgccgtctga

SEQ ID NO: 5882 - DNA, 372 bp, Neisseria meningitidis
atggcggcatatggggtttcagacggcatttttacttttacggaacaggcggtgcggatacatcgccggtttttcggtaattttgggtacggcggcggcaggtgctacaataacggcctctttctgcaagggaacattatggaagccactgtctatctcgaagacaacgaatacatcgccttgtgcgacctcttgaaattggtcggacttgccgaaagcggcggacaggcgaaagcgtttatcgccgaagggctggtgttgcgcaacggcgaaaccgaaacccgtaaaaccgccaaaatacgcggcggcgaagtcatcgagtttgacggcgctcgcttggaaatcgccgatggatacgaccctgaagtataa

SEQ ID NO: 5883 - DNA, 3435 bp, Neisseria meningitidis
atgaccgagccgacctacattcccctgcgcctgcataccgaattttcgattaccgacggtatggtgcggattaaaaaactgattgccaaagcgcaggaatacggtttgcctgctttgggcatcagcgatttgatgaacgaattcggtttggtgaaattttataaagcctgccgcagcgcggggattaagcctatcggcgcggcggatgtgcggataggcaatccggatgcgcccgacaagccgttccgcgctatgctgattatccgtaacgatgcgggctatctgcgcttgagcgagcttctgacggcggcttatgtcggcaaagaccgcaatgtccatcatgcggaactcaatcccgaatggctggaaaacggcgacaacagcggcttgatttgtttgagcggcgcacattacggcgaagtgggcgtgaatctgttgaacggcaatgaagacgcggcgcgtacggcggcgttgaagtatgcggcgtggttccccgatgcgttctatatggagctgcaacgcctacccgaacgccccgaatgggaggcttgcgtttcgggcagcgtgaagctggcggaggaattgggtttgccggtggtggcgacgcatccgacacagtttatgagccgcgacgatttcaacgcgcacgaggcgcgagtgtgtatcgcaggcggctgggtattgacggacaagaaacgtccgcgcgatttcacgccgggccagtttttcattccgccggaaaccatggccgaacgtttcgccgatttgcctgaagccttggaaaacacggtagaaattgccaaacgctgcaacctgcacatcacattgggcaaaaacttcctgccccttttccccacgcccgacggtttatcactcgatgactatctcatcaaactctccaacgagggtttgcaggaacgtatggttcagctttatcccgacgaggcggagcgggcggcaaaaatgccggaatatcaggaacgtttggattttgagctgaacatcatcatccaaatgaaattccccggctatttccttatcgtacaagactttatcaactgggcgaaaacacacggctgtccggtcgggccgggccgtggttcgggcgcgggttcgctggtggcgtattcattgaagattaccgaccttgatccgctcaaatacgcgctgctgttcgagcgtttcctaaaccccgaacgcgtttctatgcccgacttcgacgtggacttttgccaaagcaaccgcggccgcgtgattgaatatgtgcgcgagaaatacggcgcggaggcggtcagccagattgttaccttcggcacgatgtcgtccaaagcggtcatccgcgacgtcgggcgcgtgttagagctgccgtttatgctgtgcgacaaactgtccaagctgattccgttggaagccaacaaacccctgagtttggaaaaagccatggagaccgagccacagattcaggaattaatcgaagcggaagaagcggacgaactgattacgctggcgaaaaagctggaagatttaacgcgcggtttgggtatgcacgcaggcggcgtgttgattgcgccgggcaagatttccgattacagccccgtgtatcaggcggacgaatccgcctcgcccgtatccatgtacgacaagggcgacgtggaagatgtgggtttggtgaaattcgactttttgggtctgcgcaacctgaccattatcgaaatggcgcagaacaacatcaaaaacactaccggcgacatcatcgatgtcggcaaaatcccgcttgacgaccaggtcgcctaccaaatcttccgcgatgcgaacaccaccgccgtcttccagtttgagtcgaccggcatgaaaaaaatgctgaaaacggcgcacacgaccaagtttgaagaactcatcgccttcgtatcgctctaccgccccggcccgatggacaacattcccgacttcgtcgcacgtatgaaggggcaagaattccaatacatccatccgctactcgaaggcatcctcgcgccgacctacgggattatggtgtatcaggaacaagtgatgcaggcggcgcaaattatcggcggctactcgctcggcggcgcggacctgctgcgtcgcgccatgggtaagaaaaaacccgaagaaatggtgaaacaccgcgaaatcttcgccgaaggcgcggcaaaacaaggcatttcgcgcgaaaaatccgacgaaatcttcaactacatggaaaaattcgccggctacggtttcaacaaatcccacgccgccgcctacgccctgatttcctaccagaccgcatggcttaaagcgcactaccccgccgaatttatggcggcgaccatgtcgtccgaattggacaacaccgaccagctcaagcatttctacgacgactgccgcgccaacggcattgagttcctgccgcccgacatcaacgaatccgactaccgcttcacgccgtatccggacatgaaaatccgctacgcgctcggcgcgattaaaggcacgggcgaagccgccgtcgaatccatcaccgccgcgcggcaaagcggcggcaagtttaccggtctgttggacttctgcgagcgcgtcggcaaagaacacatgaaccgccgcaccctcgaggccctgatacgcggcggcgcgttcgacagcatcgaacccaaccgcgccatgctcttggcgaacatcgacctcgctatggacaacgccgaccaaaaagccgccaacgccaatcagggcgggcttttcgacatgatggaagacgccatcgaaccggtgcggctcatcgacgcgccgatgtggagcgaatcggaaaaactcgccgaagaaaaaaccgtcatcggcttttacctgtccggccacccgttcggcccgtatgcccaagaagtccgccaaatcgcaccgaccaaattagaccgtctgaagccgcaagacagcgtgcgcctcgccggattcgttaccgccgtgcgtacgatgatgggcaaacgcggcaaaatcgccttcgtcagcctcgaagatttgagcggacaggttgaaatcatggtcggcggtcagacgttggaaaactgcgccgactgcctcaaagccgaccaagtgctgattatcgaatccaaagtcagccgcgacgactacggcggcggcgacgggctgcgtattctggcaaaccaagtcatgaccctgcaaacggcgcgcgaacgctacgcccgcagcctcagcctcgccctcgccccgcatcacgacatcggcggactggtacggctgctcgccgcccaccaactgcccgacacgccgcgcatcccgctgcaactgtcgtatgccaacgaaaaagcgtcgggcaggcttcaagtgccgccgaaatggacggttacaccgagctccgcattgttcggcgaactggaaacattgctcggcagccggtcggtgcgcgtcaactggtaa

SEQ ID NO: 5884 - DNA, 933 bp, Neisseria meningitidis
atgctctcacaactggagtatggcattgcgaaggaaaatagaccgaaccggcaggcagaccgctttgccggttcggttttaccgcttgccgccagtctgacccacaagccgaacatcatgaaacccataccgaccgacacattccaacctgccatactgccccaagcctttgaaaccgaaatcaaatccacctgcacggggcgaatctatcggattcagacggcaacactcggcgaaataccgtctgaaggctatcccgtcctctttgtcctcgacggcgaagcctttttccccgcacttttcaacatcatgcagtcgctgatgaacaaccccgttacccgaagcaacgccccctgcctgattgtcggtatcggctacacgacaggcagtgtgcgcgatttggcacaacgtgccgccgactacacgccgccgcttggagacaacgccacagcagacgaacggcagcagttcggacaggcagaccgcttcgccgcctttatcgacagcgagctgaccgcctttttagaaagccgctacaccctcaaccgcaatgaaaccgccgtattcggacactcgttcggcgcactgttcggactgtattccctgctttcccaccgccgtttcagacggcattggctcgtatccccatcgatttggtggcacaacaggcggatactcgactttatgccgtctgaaaaccggctaaacggcatcgatgtctgcctcaacatcggcgcgctagaacggggtagcgattgtaaacgcagggaagaacgcgatatggcagggcaggccgaacaaatggcggcagagttagacaggcacggggccgccgtctttttccgggaatatccgaatgccgaccacggcaatgtcccgttctactcgctgaccgattgcgtcgaatatttgaggaaggcttggcagaggtag

SEQ ID NO: 5885 - DNA, 2127 bp, Neisseria meningitidis; identical to SEQ ID NO: 3587

SEQ ID NO: 5886 - DNA, 660 bp, Neisseria meningitidis
atgaccacgcccaaactcatcatcttcgactgggacggcacgcttgccgatacgacccaacccatcatcgacaccatgcgccgcagcttcgccgaatgcggttttccgccgcccgaagcggaacgcgtccgcagcctgattggctacagcctgcccgaaatcatccgcaccctgctcgaaatgccgtctgaaaccgccgttgccgacatcacacgcacttattccgcacattacctcaatcccaacaaccgcaatatgtccttatttcccgatgccctgccctgtctggacaagctcaaagcacaaggatactggcttgccgtcgccacgggcaaagggcgggcgggtttggacaacgccatcagtcaaaccgccaccggcggctattggctcgccaccgcctgcgcgggggaatatccctccaaaccctcgcccgaaatggtattcggaatctgcggcgaactgggactcgacccgaaagaggcattggtcgtcggcgatacggcgcacgacctgcatatggcggcaaacgcaggcgcggcggcagtcggcgtggccaccggcgcacattcgcgcgaacagctccttagcgcaccgcatctcgccgtattggacggtttgtccgaactgcccggttttcttgcacaacattacgcctga

SEQ ID NO: 5887 - DNA, 969 bp, Neisseria meningitidis
atgaacgagaaaaccatcatccttgccaatccgcgcggcttctgcgctggtgtggatcgggcaatcagtattgtcgaacgtgctttggaagagttcggcgcgccgatttatgtgcgccacgaagtcgttcacaacaaattcgtcgtggacaacctgcgtgaaaaaggtgcggtgtttattgaagacttggcggaagtgccgccgggcgcgacactggtttattcggcacacggcgtatcgaaggcggtgcggcaagaagcggcggagcgcggtttccgcgtgtttgatgcgacttgcccgctggtgacgaaagtgcataaggaagtcgcccgactggatgcccaagactgtgaaatcatcatgatcgggcataaggggcacgtcgaggtcgaaggaacgatggggcagcttgcgccgggcaaaatgcttttggtcgaaacggtcggagatgtggcaaaactcgaagtcagaaaccccgacaaactcgcctatgtcagccaaaccacgctctcggtcgatgaaaccaaagacatcatcgccgcgctgaacgcgcgtttccccaatatccgcaatccgcacaaggaagatatctgctatgcgacgaccaaccggcaaaccgccgtcaaagagttggcagaacagtgcgacatcgtgattgtggtcggttcgcccaattcgtccaacagcaaccgcttgcgcgaagtggcggcatcgcgcggaatcgatgcgtatatggtggataatgcaggctacctgcaacgcgcatggtttgagggcaaaaacaaagtcggcgtaacggcaggcgcgtccgcgcccgaagtgttggtgcgggaagtactggcaaccatacgcggatgggggcacgaaaccgtacgcgaaggcgagggtgcggaagaaagcattgtgttcgtcctgcccaaagagttgcgccgcgagggcgaaaccaaacccgatttgtgcaaacgttga

SEQ ID NO: 5888 - DNA, 528 bp, Neisseria meningitidis
atggtactcttttaccggctgttgaaaaatatgtcttcatctgtttcaagtaaaacgcgctattgggtattggcacttgccgccatcgtgctggaccagtggtcgaagtgggcggtgctgtcgtcgtttcagtatcgggaacgcgtcaatgtcattccttcctttttcgatctgacgctggtgtacaacccgggtgcggcgttcagcttccttgccgatcagggcggctggcaaaaatacttttttttggtgctggcggtggcggtgagcgcgtatttggtacgcgccatcttgcgcgatgagtttgcaaccctcggcaaaacgggtgcggcaatgattatcggcggtgcgttaggcaatgtcatcgaccgcctgatacacggtcatgtcgtcgatttcttattgttttattggcaaaattggttttatcccgcctttaatattgccgacagctttatctgcgtcggtgcggtgttggcggtgttggacaacatcgtccaccgtaaaacccaagaagaaaaatattga

SEQ ID NO: 5889 - DNA, 2790 bp, Neisseria meningitidis
atgaccgattacagtaaaaccgtaaacctgctcgagagcccgtttccgatgcgcggcaatcttgccaagcgcgagcctgcatggctgaaaagctggtacgagcaaaaacgctaccaaaaactgcgcgaaatcgccaaaggccgtccgaaatttattctgcacgacggcccgccgtatgccaacggcgacatccacatcggtcatgccgtcaataaaattctcaaagacatcattatccgcagcaaaacccaagccggttttgacgcgccttatgtgccgggttgggactgccacggcctgcccatcgaagtgatggtagaaaaactgcacggcaaagatatgcccaaagcacgtttccgcgaattgtgccgcgaatacgccgccgaacagattgcccgtcagaaaaaagactttatccgcttgggcgtgttgggcgactgggaccatccttacctgactatggatttcaaaaccgaagccgataccgtgcgtatgctcggcgaaatctacaaatccggctatctctaccggggtgcgaaaccggttcaattctgcttggactgcggttcttcgctggccgaagcggaagtggaatacaaagacaaaatctcgcccgcgattgacgttgcctatctgtttaaagacactgccgcgcttgccgccgcattcggtttggctggtttcgaaggcaaagcgtttgccgtcatttggacgactacgccttggacgctaccggcgagccaagccgtgtctgcgggtgcagacgtggtgtatcaactgattgatacgccgaaaggcaaattggtattggcgaaagatttggcagaagacgcgctcaaacgttacggtttttcagacggcattgctattctcgccgaaaccaccggcgacaagctggaaaatctgcacatgaaccatccgttcctcgaacgcgatattcccatgctcaacggcgaacacgttaccaccgatgccggtaccggcttggtacacaccgcccccgcgcacggtttggaagactacgccgtctgcaataaatacggcatcgagctttacaaccccgtcaacgccgaaggccgatacatcggcgaaacgccgcgtgtcgccggtatgcgcgtttgggaggcgaaccccgtcatcctgcaatggttggaagaaaccggcaaccttttggcaagcagtaaaatcgaacacagctacgcccactgctggcggcacaaaacgccgctgatttaccgcgcgacaggtcaatggtttgtcggtatggacaaagccggtgccgacggcaaaaccctgcgcgacaaagccatcaaggccgtggacgacaccgaattcttcccgtcttggggtcgcgcgcgtttggaagccatgattgaaggtcgtcctgactgggtggtttcacgccaacgctattggggcacgccgatgactttctttgttcacaaagaaacgggcgagctgcatccgaactctgccgaacttttggaaaaagttgccctgaaaatcgaagaaaaaggcatcgaagcgtggttctccctcgataagagcgaactcttgagcgcggaagattgcgaaaattacgataaactttctgacacaatggacgtatggttcgactccggctcgacccattattccgttgtgaaacaacgcgaagaattggaatggccggctgatttgtatctcgaaggcagcgaccaacaccgcggctggtttcaatcgtccatgctgaccggctgcgcctcatcaatgggtcgcgcgccgtataaacagctgctgacccatggtttcgttgtcgacggcgaaggcaaaaaaatgtcgaaatccatcggcaacgtcgttgcaccgcaagaggtttataacgaattcggcgcagacatcctgcgcctgtgggcggcatctaccgattacagcggcgaattggcgatttccaaagaaatcctcaaacgcgtaaccgaaagctaccgccgtatccgcaataccttgagctttttgtttgccaacttgagcgactttaatccgattgaagatgccgtgcaacaggcggatatggtggaaatcgaccgctacgccgtggtattggcacgtcagctgcaagagtgtctggcaggcgattactatccgcgttatgccttccactttgccgtaaaagacattgtttctttctgctcggaagacttgggtgcgttctacctcgacatcctgaaagaccgcctctacaccaccaaagcagacagccatgcacgccgcagcgcacaaactgccctgtatcacatcacacgcagtttggttctcttgattgcaccgattttgtgcttcaccggcgaagaagcgtgggacatcatcggcggcggcgaagaagacagcgtcctcttccatacttggcacgagttcccgaccatcaacgaaaaaaccgaagccgaactggtgaaaaaatggacggcaatccgcgaagcccgcgaagcggtaaccgccgccatcgagcctttgcgcgccgacaaaaccgtcggttcgtccttgcaagccgaagccgaaattaccgcgccggaagaaatggccggctatctgaatgctttgggcgaagaattgcgctttgctttgctggtgtctaaagcagaagtgaaagtaggcagcgaacttgccgttgccgctaaagccagtgatggtgaaaaatgcgaacgctgctggcactacacccgcgatgtgggcgcggttgcaggctatgaaaccgtctgcaaacgctgtgcagagaatgtcggcggagaaggcgaaacgcgccattacgcctga

SEQ ID NO: 5890 - DNA, 921 bp, Neisseria meningitidis
atgagaatcaggctggggcggcacaacgcgcccgactttccacagggtgccgccgtaaccataggcaatttcgacggcgtacacctcggacacaaacacatcctccaaaaactccgcctcgaagccgacgcgcgcggactgcccgtcgtgaccgtcgttttcgaaccccaacccaaagaatttttcgcactccgcaccggcaggatgccaccgtgtcggatcagccccctgcgcaccaagctcgaattattggaaggcacaggctgtgtcgatgccgtctgggttttgcgtttcgatcaaaatttttccgaaatatccgcgcaagggtttatcgaccgcctgctgcgtcaaaccttgaatacgcgttatttgctcgtcggcgatgatttccgtttcggtgcggggcgggaaggctgttttgaacttttggcacaacagcccgatatgcagaccgagcgtacgccttccgtcatcgtcgaagacatccgcaccagcagtaccgccgtgcgacaagccctttcagacggcaaccttgcctatgcgaaaaaacttttgggacacgactacgtcttgagcggcagggtggtgcacggcagaaaactcggacgcaccttaaacgccccgactgccaacatccgcctgccccgccaccgttatgcactcggcggcgtgtttgtcgtcgaagcagacggcgcattcggcacgcggcgcggcgtggcgagtttcggcttcaatcccaccgttgatagcggctgttctcaaaagcttgaagtccacctgttcgactttcaaggcgacctgtacggacaagggctgaacgtccgcttcctgcacaaactgcgcgatgaggaaaagtttgacggtatggaagaactgaaaaggcagattgaagccgatatggaagccgcaaggcgttggtag

SEQ ID NO: 5891 - DNA, 1296 bp, Neisseria meningitidis
atgagcgtcatccaagacctgcaatcgcgcggccttatcgcgcaaaccaccgacatcgaagccttagacgctttgttgaacgaacaaaaaattgccctttattgcggcttcgacccgaccgccgacagcctgcacatcggacacctgctgcccgtattggcattgcgccgcttccaacaggcggggcatacgccgattgctttggtgggcggcgcgaccggtatgatcggcgaccccagcttcaaagccgccgaacgcagcttgaattccgccgaaactgttgccggctgggtggaaagtatccgcaaccaattaacccctttcttgagctttgaaggcggaaatgccgccattatggcgaacaatgccgactggttcggcagcatgaactgccttgacttcctgcgcgacatcggcaagcatttctccgtcaacgccatgctgaacaaagaatccgtcaaacagcgcatcgaccgcgacggcgcaggcatttccttcaccgagttcgcctattccctgctgcaaggttacgacttcgccgagttgaacaaacgccacggcgcggttttggaaatcggcggctccgaccaatggggcaatatcaccgccggtatcgacctgacccgccgcctgcaccaaaaacaagtattcggtctgaccctgcctttggtaaccaaatcagacggtaccaaattcggcaaaaccgaaggcggcgcggtatggctgaacgcgaaaaaaacctcgccctatcagttctaccaattctggctgaaagtcgccgatgccgatgtgtataaattcctgaaatactttaccttcctgtccatcgaagaaatcgatgccatcgaagccaaagacaaggcaagcggcagcaagcccgaagcgcaacgcatcctcgccgaagaaatgacccgcctgattcacggcgaagaagcccttgccgccgcgcaacgcatttccgaaagcctgtttgccgaagaccaaagcagcctgaccgaaagcgacttcgagcagctcgccctcgacggcctgcctgcatttgaagtttcagacggcatcaatgtcgtcgaagccttggtaaaaaccggtttggcatcctccaataaagaagcgcgcggctttgtgaacagcaaagcggttttgctcaacggcaaacctgccgaagccaacaaccccaaccacgccgccgaacgccccgacgatgcctgcctgctgaacggcgaacacaaacgtttcggcaaatacactatccttcggcgcggcaaacgcaaccacgcgcttttggtttggaaataa

SEQ ID NO: 5892 - DNA, 1872 bp, Neisseria meningitidis
atgagccaagccttaccctaccgcccggacatcgacacattgcgcgccgccgccgtcttgtccgtcatcgtgttccatatcgaaaaggattggctgccgggcgggtttctcggtgtcgatatattctttgtgatttcaggctttttgatgacgacgattcttcaccgcgaaatgtcgggggggggggggaggttttccctgaaggcattttatatccgccgcatcaagcggattctgcccgcatttttcgccgtattggcggcaacgctggcaggcggcttctttttattcaccaaagatgatttctttcttttgtggaaatccgcgctgaccgccttgggtttcgcctctaacctgtattttgcaagggggaaggattatttcgatcccgcgcaggaagaaaagcccctgctgcacatctggtctttgtcggtcgaagaacaattttactttgtctttccgatactgctgctgcttgtcgcccgcaaaagcctgcgcgtacagttcggcttccttgccgcactgtgtgccttaagccttgccgcctcctttataccttccgcgctcgataaatattacctgccccacctgcgcgcctgcgaattactgataggatcgctgaccgccgtgtggatgcgctgccggcaacctgccgtcggcagacgctgtgccgccgtcggcgcattgtttgccgtgtgcatattgtcaacctgcctgttttcctattcggaacaaaccgcctatttcccgggccccgccgctttgattccctgtctggctgttgccgcgctgatttatttcaatcattacgaacacccgcttaaaaaatttttccaatcgaaaatcactgttgccgccggtttgatttcctattcgctttatctgtggcattggccgatattggcctttatgcgctatatcggcccggacaacctgccgccttattcgccggcggcggcggtcgtcctgatattgctgctttccctgttttcttaccactgcatcgaaaaaccgtttaaaaaatggcaaggttcgttcgcacaatccgttttatggatttatgccttgcctatgctcattttgggggcgggctcgttttttgcgatgagactgccgtttatggcgcaatacgaccgcttggggctgacgcgttccaacacctcctgccacaacaataccggcaaacaatgcctatggggggatacggaaaaacagccggaactgctggttttgggcgactcccacgccgaccattacaaaacattcttcgatgccgtgggcaaaaaagaaaaatggtccgccactatggtttccgccgacgcttgcgcctatgtggaaggctacgcgtcccgtgtgttccaaaactgggcagcctgccgcgccgtttatcgctatgccgaagaacacctgccccggtattcaaaagtggttttggcgatgcgctggggcagccaaatgcccgaaaacagccgctcccttgcctatgatgccggttttttccaaaaattcgaccgtatgctgcataaactctcgtccgaaaaacaagccgtttacctgatggcggacaaccttgcctcgtcttacaacgtccagcgcgcctatatcttgtcttcacgcataccgggttaccgccaagccctgcgcccggacgacgaaagcaccctgaaagccaatgcacgcatcagggaattggcagccaaataccccaacgtctatattattgatgccgccgcctatatccccgcagattttcaaatcggcggattgccggtttactcggacaaagaccacatcaacccttacggcggcacggaattggcaaagcgtttttccgaaaaacaacggtttctcgatacgcgccataaccattga

SEQ ID NO: 5893 - DNA, 255 bp, Neisseria meningitidis
atgattttcggcgtttcccgtaccgccggaatgcagccgcatcaaaataaactcccacccgcatttccgatttgccctccccgattcctgcaaaacaaaccgcctgccccgccgttacgggaagccgtccggcattccgaatatcccgatccccgatacgaaatgacctttcagacggcatttgcgccgccgcgtttcgagtatagtggattaactttaaatcaggacaaggcgacgaaaccgcagacagtatag

SEQ ID NO: 5894 - DNA, 1092 bp, Neisseria meningitidis
atgagtttgaaatgcggcatcgtcggtttgcccaacgtcggcaaatccaccctttttaacgcgctgacccaatcgggtatcgaagcggcaaactatcctttctgtaccatcgaacccaacgtcggcatcgtcgaagtccccgatccgcgtatggccgaattggcaaaaatcgtcaatccgcaaaaaatgcagcctgccatcgtcgaatttgtcgatattgccggtttggttgcaggcgcgagcaaaggcgagggcttgggcaaccagttccttgccaacatccgcgaaaccgatgcgattgtgaatgtcgtgcgctgctttgacgacgacaacatcgtccacgttgcaggccgcgtcgatccgattgccgacattgaaaccatcggcacagagttggcacttgccgacctggcaagtgtcgaaaaagccatcgtccgcgaagaaaaacgcgcccgctcaggcgacaaagacgcgcaaaagctggtcgatttgtgcaaaaaactgctgccgcatctggacgaaggcaaacccgtgcgttccttcggtttggacgcggaagaacgcgcgatgctcaaaccgctgttcctgctgaccgccaaaccggcgatgtatgtgggcaacgtcgccgaagacggttttgaaaacaatccgcacctcgaccgcctgaaagaattggcggcaaaagaaaacgcccccgtcgtcgccgtttgcgccgcgatggagagcgaaattgccgaattggaagacgacgaaaaagccgagttcctcgccgaaatgggcttggaagaaccgggcctgaaccgcctgattcgtgccggttacgacctcttggggctgcaaacctatttcaccgccggtgtgaaagaagtccgcgcgtggacgatacacaaaggcgacaccgcgccgcaagccgccggcgtgattcatacggattttgaacgcggcttcatccgcgcccaagtcatttcttacgacgactttgtctcgctcggcggcgaagccaaagccaaagaagccggcaaaatgcgtgtggaaggcaaggaatatgtcgtgcaagacggcgatgtgatgcactttttgtttaacgtgtaa

SEQ ID NO: 5895 - DNA, 1677 bp, Neisseria meningitidis; identical to SEQ ID NO: 1537

SEQ ID NO: 5896 - DNA, 432 bp, Neisseria meningitidis
atgggcagcaacgcatggctgttttgggcattggcatcggcaggcttcgcctcattgaccgctattttcgccaaaatgggtttacagggtatagattccgatttcgccacctttatccgcaccttggtcatccttgccgctttgttattgtttttaacctacaccggcaaatggcagggtgtgaacggctttacggggcgcaactggacattcctcatcctatccggtcttgctaccggcgcatcttggctcgcctattttaaagccctgcaactgggcaacgcctcgcaagtcgcccccatcgacaaattcagcctggtcttggtcgcgctgatggcggtggttttcttggacgaacgcccgaacacgcaggaatggataggcttggggctggtaacggcgggcgtgttggtgctggcgttgaaacgttaa

SEQ ID NO: 5897 - DNA, 696 bp, Neisseria meningitidis
atgaaagcgatgatactggcggcaggacgcggcgagcgtatgcgccctttgaccgataccactccgaagccgctgctcgatgtggcgggtaagcctctaatcggttggcacctatgccgtctgaagcaggcggggtttaccgaaatcgtcatcaaccacgcttggctgggtcggcagatagaagatgctttgggcgacggctcggcttatggcgtgaacatcgcctattcgcccgaacccgcaggcggtttggaaacggcaggcggcatcgcgcaggcattgccgctgttgggtgggcagccgtttttggtggtcaacggcgacgtgctgaccgacatcgattttaccgccgcgtttcagacggcatcgtccctgccggaacatatttccgcccatctgtggctggtggaaaatccgccgcacaaccccgacggcgatttttccctgctgcccgacagcagcgtgcggccggaagtaaatggcggcaacggattgacattcagcggcgtgggtatttaccgtcctgaaatgtttgacggaatcgaagcgggcagtgtggcgaaactcgcgcccgtattgcgtggcgaaatgcggcaaaaccgcgtgagcggtcagaagcatacgggcttgtggctggatgtcggcacggtatgccgtctgaaagaggctcaagcccttgcaggggcttggaagtaa

SEQ ID NO: 5898 - DNA, 501 bp, Neisseria meningitidis
atggcggatttgcagaaaaattttcaaacttcgttccgtgatgcgatggcatcttgcgcggcaggcgttcatgtcatcacgacagacggtgcggcagggcgttacggcattacaatgacggcggtcgcgccggttaccgacgagccgccgaccgtgatgctgtgcatcaaccggagtgcgcgaatcattccgatcctgtcggaaaacggcagcctctgcatcaatacgctggcggacgaacatcaggatgttgccgaacattttgccgggctgaccggcctgtcgcccgaagagcggtttgcctaccacatctggcatcgcggcaaaacgggacaacttgaaatagagggcgcgttggcgcacctgcacgggcatattgtcggcaaacatgaaatcggcacgcattttgtgttttacgtcaggctcgacgaaatcaaaaactgcgggtgcaaacgccccgcgctgctgtatttcagacggcagtttagatttttagactga

SEQ ID NO: 5899 - DNA, 441 bp, Neisseria meningitidis
atgcctacccaatcaaaacatgcgtctatcaatatcggtctgatacaggcaagggaagccctgatgacccaattcaggcctattctgaatcaggcgaatattaccgatcagcaatggcggattatccgtcttttggcggaaaacggcacgctggactttcaagatttggcgaatcaggcgtgcattttgcgccccagcctgaccggtatcctgacccgccttgaaaaagcgggtttggttgtccgcctgaaaccttccaacgaccaacgacgtgtttttctgaagctgactgccgagggcgagaagctgtatgaggaaatcggcgaagaagtggacgaacgctacgacgctatcgaggaagtgctgggccgcgagaaaatgctgctgcttaaagacctgttggcagaacttgccaaaatcgaggatgcgttgaactcgtaa

SEQ ID NO: 5900 - DNA, 123 bp, Neisseria meningitidis
atgcggtttatagcgtattgttgctatatgttcgttttgttatataacggttgcatcaaaatttacgcccacaggctttcccgacggtttgaaagtttgattttcgataacttggagacttaa

SEQ ID NO: 5901 - DNA, 510 bp, Neisseria meningitidis
atgaaaaagaaactgctttcgggcatcaaatttgccgttcagacggcattggtgtttttattggtgtcgctgtttttggattggatacgcaagcccgaagagccggccggtgcggcagggcggcctttgaccctgctgtcggggcagcggctgactttgggacagtttagccgagataaggcggttttggtgtatttttgggggagctggtgcggcgtgtgccgttatcagtcgccgataatcgatgatttggcggcggacggcgtgccggtcgtcggcgtggcggtacgttccggcagttcggcggaagtggcggcgtatatggcaaaacgcggcttgggctttccgactgtcaacgatgaggacgggggtttggcaaggtcttggcggattgtcgcaacgcctgccgtcgttttggtcaaaaatgggaaaatggttcactatacgacgggaatcagcagttattggggcttgcgcgcacgaatttttcaggcggatgttttcggttaa

SEQ ID NO: 5902 - DNA, 1080 bp, Neisseria meningitidis
atgaacatacaaaacatccgcaccctcctcgacaccgtcgccgttccgaatacggcacgcacgctcggcggcgaaaaggccgtccgttcggtcgaacagcgttcagacggcatccatatcgccctgcatttcggcttccccgtcgcgcacattgcctcagaaacagccgaccgcatacaggaaatcctgatgcccgaaacaggcgacacacacatccatctgtccatggacactgaaatcggcacacacaaagtccagcccggcgttaccaccatcaaaggcgtgaaaaacatcatcgccgtcgcatcgggaaaaggcggcgtgggcaaatcgacaaccaccgccaaccttgccgccgcaatggcgcgcatgggcgcgcgcgtcggcgtgctcgatgccgacctttacggcccgagccaaccgaccatgttgggtgtggacgaccgcaaacccgatcagaaaaaccaaaaactcattcccgtcgaatcttcagacggcatacaggtcatgtctatcggctttctcgtcgataccgaccaagccgtcgtctggcgcgggccgatggtcagccaagccttgcagcagctgatgttccaaagcgagtgggacgaagtggactacctgtttatcgacctgccccccggcacgggcgacatccagctcacgctgtcccagcgcatccccgtaaccggttccgtcatcgtaaccacgccgcaggacatcgccctgatagacgcgcgcaaagccgtggatatgttccgcaaagtcaacattcccattttgggcgtattggaaaatatgtccgtccacatctgcaccaactgcggacacagcgaagcactgttcggcacggacggcggcaaagatttcgccgcacgcctcaacgtccccctgctcggacagcttcccctaagcctgcccgtgcgcgaagccatggacggcggcacaccggcgcaactgttcgacgaacaccccgccatcgcccgaatctacaccgatgccgcattccaaatcgccctgagcattgccgacaaaggcaaagacttcagcagccgcttccccaaaatcgtcgtcgaataa

SEQ ID NO: 5903 - DNA, 3091 bp, Neisseria meningitidis
atgaataaaactttaaaaaggcgggttttccgccataccgcgctttatgccgccatcttgatgttttcccataccggcggggggggggggggcgatggcgcaaacccataaatacgctattatcatgaacgagcaaaaccagcccaaggtaaaggggaatgggcaatattcaacaataaaggacaaagacagggaacgcaaatttatctataataaaagcggccggggtggaggctctgtctttttcgacaataccgatacccttgtttcccgacaaagcggtactgccgtttttggcacagccacctacctgccgccctacggcaaggtttccggttttgatgccgacgggctgaaagagcgcggcaatgccgttaattggattcatacgacccacccagggttgataggctacagctacaccagtgtcgtatgcagagacagcacaggctgtcccaaacttgtctataaaacccgattttccttcgacaacaccggtttggcaaaaaatgcgggcagcctggataggcacccggacccaagccgcgaaaattcgcccatttacaaattgaaggatcatccatggttgggcgtgtctttcaatttgggcagcgagaataccgtcaaaaatggcaactcattcaacaaattgatatcttcttttagtgaagacaataataatcaaaccatcgtctctacgacagaaggctcccctatttcccttggcgaccagcagcgcgaacataccgccgtggtctattatctgaacgccaaactgcacctgctggacaaaaaagggattaaagatatcaccggcaaaacagtgcggttgggtgtcttgaagccgagcatcgatgtgaagacacaaaatacggggcttggcggcattctagcttattgggctaggtgggacattaaagataccgggcagattccagtcaagctcggcctgcagcaagtcaaagcaggccgctgcatcaataaaccgaaccccaatcccaacaaaaaagacctttcgccggccctgactgcccccgcgctgtggttcggacctgtgaaagatggtaaggcggagatgtattccgcttcggtttctacctaccccgacagttcgagcagccaaattttcctgcaaaacctttcccgcaaggatgacacaagcaaaccgggccgctattccctcaaacccttgagtacgtcggagattaaaagtaaagagccgagtttcacggggcggcaaaccgtcatccgattggatggcggcgtacggcatatccaactggatagaaacaatgaggccaccggtttaaatggaaatgacggcaaaaacgacactttcggcattattagagaagggagcttcatgcctgatgccagcgagtggaaaaaagtattgctgccttggacggttcggggttttgctgatgacagtaaatttaaagcattcaacaaagaagaaaacaacgacaacaagccaaaatacagccaaagataccgcatccgcgaaaacggcaagcgcgatttgggcgacatcgtcaacagcccgattgtcgcggtcggcgagtatttggctacttccgccaacgacgggatggtgcatatcttcaaaaaaggcaacggggacgcgcgcgactatagtctgaagctcagttatatcccgggcacgatgccgcgcaaggatattcaaaacaccgaatccacccttgccaaagagctgcgcacctttgccgaaaaaggctatgtgggcgaccgctatggcgtggacggcggctttgtcttgcgccgcattacagatgaccaagacaagcaaaaacacttctttatgttcggcgcaatgggctttggcggcagaggcgcatacgccttggatttaagcaaaatcgacaacagcaacccggccggcgtttccatgtttgatgtcaaaaacgacaatggcgtgaaattaggctacaccgtcggtacgccgcaaatcggcaaaacccacaacggcaaatacgccgccttcctcgcctccggttatgcgactaaagacattaacaacggcgagaataaaaccgcgctgtatgtgtatgatttggaaaacaacaacggtacgccgattgcaacaatcaacgtacccgacggcaagggcgggctttcgtcccccacgttggtggataaagatttggacggcacggtcgatatcgcctatgccggcgaccgcggcgggaatatgtaccgctttgatttgagcaacaacgatccgaccaaatggtctgtacgtactatttttaaaggcacgctggataagccgattacctccgcgcccgccgtttccaaactgaaagacaaacgcgtggttatcttcggtacgggcagtgatttgagtgaggatgatgttgataaaaaggatatacaatctatttacggtatttttgacaatgacacaggcacggatgtggcagaagaaggacagggcaaagggttgctcgagcaacaccttactcaggaagataaaaccttattcctgaccgattacaagcgatccgacggctcgggcgacaagggctgggtagtgaaattggaagccggacagcgcgttaccgtcaaaccgaccgtggtattgcgtaccgcctttgtaaccatccgcaaatataacgacggcggctgcggcgcggaaaccgccattttgggcatcaatactgccgacggcggcaagctgaccaagaaaagcgcgcgcccgattgtgccggaagccaatacggctgtcgcgcaatattccggtcataagcaaaccgccaaaggcaaatccatccctataggttgtatgtggaaaaacaatgaaaccgtctgcccgaacggatatgtttacgacaaaccggttaatgtgcgttatctggatgaaaagaaaacagacggattttcaacaacggcagacggcgatgcgggcggcagcggaacattcaaagagggtaaaaaacccgcccgcaataaccggtgcttctccggaaaaggtgtgcgcaccctgctgatgaacgatttggacagcttggatattaccggcccgatgtgcggtatgaaacgaatcagctggcgtgaagtcttcttctga

SEQ ID NO: 5904 - DNA, 345 bp, Neisseria meningitidis
atgggaatacccgaatcgtcaggaatacctgaatcgtcaggaatacctgaatcgtcaggaatacctgaatcgtcaggaatacctgaatcgtcaggaatacctgaatcgtcaggaatacctgaatcgtcaggaatacctgaatcgtcaggaatacctgaatcgtcaggaatacctgaatcgtcaggaatacctgaatcgtcaggaatacctgaatcgtcaggaatacccgaatcgtcaggaatacccgaatcgtcaggaatacccgaatcgtcaggaatacccgaaccatcattcccgcgcaggcgggaatccagacctgtcggtgcagaaacttatcgggtataa

SEQ ID NO: 5905 - DNA, 1134 bp, Neisseria meningitidis
atgagcacccccgccctcctcgtcctcgctgacggcagcgtatttcacggcacatcaatcggttacgaaggttcgacttccggcgaagtcgtgttcaatacttcgatgaccggctatcaggaaatcctgaccgacccgtcctactgcaaacaaatcgttaccctcacctacccacacatcggcaacaccggcaccaacgccgaagatgaagaaagccgcagcgtttatgccgccggcctgattatccgcgacctgccgctcttgcacagcaacttccgcgcctccgaaagcctgcacgactatctggtacgcaacaaaaccgtcgccatcgccgacatcgacacccgccgcctgaccacgctgttgcgcgaaaaaggcgcgcaaggcggtgcgattctgaccggtgcggatgccacaatcgaaaaagcgcaagaactcatcgccgcgttcggcagcatggtcggaaaagatttggcaaaagaagtttcctgcacggaaacttacgaatggacggaaggcgaatgggcattgggcaagggtttcgttacccctgacgaacagccttaccacgtcgtcgcctacgatttcggcgtgaaaaccaacatcctgcgtatgctcgcctcgcgcggctgccgcctgaccgtcgtccccgcccaaacgagcgcggaagacgtgttggcactcaaccctgacggcgtattcctatccaacggccccggcgaccccgagccttgcacctacgccatcaaagccgtacaaaaactgatagaaagcggcaaaccgatttttggcatttgcttgggacaccagctcatcagcctcgccatcggcgcgaaaaccctgaaaatgcgcttcagccaccacggtgcgaaccaccctgtgcaagatttggacagcggcaaagtcgtcatcaccagccaaaaccacggttttgccgttgatgccgacaccctgcccgctaacgcacgcattacccacaaatccttgtttgacaacactttgcaaggcatcgagctgaccgacaaacctgtgttctgcttccaaggccaccccgaagccagccccggtccgcaagatgtcggctatttgtttgacaaattcattggcaatatgaaagcggcaaaacgggcataa

SEQ ID NO: 5906 - DNA, 276 bp, Neisseria meningitidis
atgcctgctgaccgatacgccactggaaacggttttacaggaattatccgcacacggcatcaaacctttaagcggcatcgtagcgcgcacaggcgcaatgggcaaaatccaatcggtttacctgcgcgatcccgatggcaacctgctggaaatcagcagttattgattttcagacggcttatgcaaaataaaaaacagcctgcacaagctgttttccttgcagcctctttaaccccaacagccgccccgtcctctctccctgtgggaaagcgttag

SEQ ID NO: 5907 - DNA, 261 bp, Neisseria meningitidis
atgccctctccccggccctcccccacgggggagggagaaggttgcagcagattttgcggttgcaggcggtttgaaaggcaacttagatttgcagctgttgtttcaggtcatctgaaaaataaaaagcagcctgcacaacctgttttccttgcaaaacccttaatcccaaccgccaccacgtcctctctcccatgggagagagtcagagagagggcaacaaactgtaaggcttacacaaacagtaacccgacaacagaatga

SEQ ID NO: 5908 - DNA, 390 bp, Neisseria meningitidis
atgagcacgcacgagaaacttttaaccgccgacaaccccgtcctgcatcaacgcgccaaagccatgcgccaagaaatgagcgaggcggaagcaaaattgtggcagcacctgcgggcaggccgtctgaacggctataaattccgccgccagcagccgatggggaattatattgttgattttatgtgcgtaacgcccaagctgattgtcgaagcagacggcgggcagcacgcggaacaagccgtatacgaccacgcgcggacggcatatctcaacagcctgggctttaccgtgctgcgtttttggaatcacgaaattttgcagcagacaaacgatgtactggcggaaatcctgcgcgtattgcaggaattggaaaagcagtatgcgcaataa

SEQ ID NO: 5909 - DNA, 273 bp, Neisseria meningitidis
atgcccgaaatatcaacagcgggaatttttcaggcagcctttatcgcaaggcaggtggaacaaacgccgcgaacgttttttcagacgacctttgaactcatcggcagagagtgtgccgcaaggcacgcacgcggtgggttggggttgcagggaaaatggagaacgcgtgcatacgtaccgcacataccctacatacgggctacggcttgctacgatacgggggtttcgatatacaagttaggttttagcaaacccaacattttagacaattaa

SEQ ID NO: 5910 - DNA, 642 bp, Neisseria meningitidis
atgtcaatacctattaatttcaataatttaaagtatttgcttaatgatatgagaaacaaaaatagaataattgaagcatttccttttaattataatcaaaggcaatacgccgttattttgactaggtataaacctgatgaacctagaccagatgattatgcacaagcaaaattagagttttttaatttgaatagtgaaaattcaatatttgcgtatgctgatttttatgaagttcattttaaaagtgctactgattttattaatttttttaaaattaatgttcaggctggtgctgcgaaaatcagagaaatttttcagagttttagtaatctttttgcagatttcattccaacacaaactaaaaaagatttagacataatttataaaaagattgtagctactcgtttagaacctaattctcctaacactatttattgctatgatgtccgtagaaatgggaaagataaggctggcaagcctaatcgcaggagcgtggaaaatagtgaaaaagcaaaaattttgcgcccagagctatacgaaaaatttaaagccgatagtaattacagttttttcttttcagataatccaagcgatgaaaaaacagatgcagaaataattagagaagttaccaatcgtcaataa

SEQ ID NO: 5911 - DNA, 3216 bp, Neisseria meningitidis
atgcccaaacgtaccgacctaaaatccatccttatcatcggcgccggccctatcgttatcggtcaggcctgcgaatttgactattcgggcgcacaggcctgcaaagccttgcgtgaagaaggctataaagtcattttggtgaattccaaccccgccacgattatgaccgaccccgaaatggcggatgttacctacatcgagccgattatgtggcagacggtggaaaaaattattgccaaagagcgtcctgacgcgattctgcctaccatgggtggtcagactgcgctgaactgtgcgctggatttggcgcgcaacggcgtgctggcgaaatacaatgtcgagctgatcggcgcgaccgaagacgccatcgacaaagcagaagaccgtggccgctttaaggaggcgatggagaaaatcggcctctcctgcccgaaatcttttgtctgccacacgatgaacgaagctttggcggcgcaagaacaggtcggcttccctaccctgattcgtccttctttcaccatgggcggttcgggcggcggcattgcctacaataaagacgagtttttggcgatttgcgaacgcggtttcgatgcgtcgcccacgcacgagctgttgattgagcagtccgttctcggctggaaagagtacgagatggaagtggtgcgcgataagaacgacaactgcatcatcatctgctcgattgaaaacttcgacccgatgggcgtgcatacaggcgactcgattacggttgcgccggcgcaaacgctgacggacaaggaatatcaaattatgcgtaatgcttcgctggcggtattgcgcgaaatcggcgtggacacgggcggctcgaacgtgcagtttgcggtgaaccctgcaaacggcgagatgattgtgattgagatgaacccgcgcgtgagccgttcttccgcgttggcttccaaagcaacgggtttcccgattgcgaaggtggcggcgaagctggcggtcggctttacgctggacgagttgcgcaacgacatcaccggcggcaaaacccccgcgtcgttcgagccttccatcgactatgtggttaccaaaatcccgcgtttcgcgtttgaaaaattccctgccgcagacgaccgcctgaccacgcagatgaaatcggtgggcgaagtgatggcgatgggccgcacgattcaagaaagtttccaaaaagccctgcgcggcttggaaacaggcttgtgcggcttcaatccgcgcagtgaagacaaagcggaaatccgccgcgaactggcgaaccccggccccgaacgtatgctgtttgtggcagacgcgttccgcgcgggcttcacgctggaagaaatccacgaaatctgcgccatcgacccttggttcttggcgcaaatcgaagacttgatgaaggaagaaaaagcggtttcagacggcattttgagtgatttggatttcgccgccctacgtcgtctgaaacgcaaaggcttctccgacaaacgtttggcacaattgttgaacgtaagcgaaaaagaagttcgcgaacaccgctacgcgctgaagctgcatccggtttacaaacgcgtcgatacctgcgccgccgagttcgccaccgaaaccgcctatctttactccacttacgaagaagaatgcgaatctcgtccttccgaccgcaaaaaagtgatgattctcggtggcggcccgaaccgcatcggtcagggcatcgagtttgactactgctgcgttcacgccgcgctcgccctgcgcgaatcgggctttgaaaccatcatggtcaactgcaaccccgaaactgtgtccaccgacttcgacaccagcgaccgcctgtatttcgagccgctgacgctggaagacgtgttggaaatcgtccgcaccgaaaacccgtggggcgtgattgtgcattacggcggccaaaccccgctcaaactcgccaacgcgctggttgaaaacggcgtgaacatcatcggcacgtccgccgacagcatcgacgccgccgaagaccgcgaacgcttccaaaaagtgttgaacgacttaggcctgcgccaaccgcccaaccgcatcgcccacaacgaagaagaagcgctcgtcaaagccgaagaaatcggctatccgctggtcgtgcgcccgtcttacgtcctcggcggccgcgccatgcaggtcgtccattccgccgaagagctgcaaaaatacatgcgcgaagccgtgcaggtttccgaagacagccccgtgttgctcgacttcttcctgaacaacgcgattgaagtggatgtggactgcgtttcagacggcaaagacgtggttatcggcggcatcatgcagcacgtcgaacaggcgggcatccactccggcgactccggctgctcgctgccgccctactccttaagcgaagaaatccaagacgaaatccgccgccaaaccaaagcgatggcgtacgcgctgggcgtggtcggactgatgaacgtgcagtttgccgtacaagacggcgtagtgttcgtattggaagtgaacccgcgcgccagccgcaccgtgcccttcgtctccaaagccaccggcgtgccgctcgccaaagtcggcgcgcgctgcatggcaggcatttccctgaaagaacaaggcgtggaaaaagaagttgtccccgatttctatgccgttaaagaagccgtgttcccattcatcaaattcccgggcgtggatacgattttgggaccggaaatgcgctccaccggcgaagtcatgggcgtgggcgcaagctttggcgaagcctactacaaagcccaactcggcgcgggcgaacgcctcaacccgaccggcaaaatcttcctctccgtgcgcgaagaagacaaagaacgcgtcattaaaaccgctaaaaacttccaagttttaggctacggcatctgcgccacgcgcggcacggcgcaatacctgaccgaacacgggctgattgtgcagaccatcaacaaagtacccgaaggccgcccgcacatcggcgacgcgctgaaaaacggcgaaatcgcactggtcgtgaacaccgtttccagcgatccgcaatccgtgtccgacagccacatcatccgccaaagcgcattgcagcaacgtgtgccgcaatacaccaccaccgccggcggcgaagcgatgagcgaaggcgcgaaaagccgagaccatctgggcgtgtacagcgttcaagaactgcacgggcgtttgaaaaaccgcaactga

SEQ ID NO: 5912 - DNA, 900 bp, Neisseria meningitidis; identical to SEQ ID NO: 1639

SEQ ID NO: 5913 - DNA, 579 bp, Neisseria meningitidis
atgaatattttattattagacggcggcaaggcgttcggacattctcacggcgggttaaaccgtacgcttcacaaaaaagcgaaagaagttttgaccgcgctcggacacaatgttcaagaaaccgtgattgatgccggctatgatgttgaggcagaaatcgaaaagttcgtttggatggatgctgtgatttggcagatgccgggctggtggatgcacgagccttggacagtgaaaaaatacatagacgaagtattaaccgctggacacggcaaactctaccaaagcgacggcagacacagcgtcaatccgactgagggctacggcacaggcggcttgttgcaaggcaaaaaacatatgatttcactgacttggaatgcgccgattgaagcctttacccgcgaaggcgatttctttgaaggcaaaggcgttgatgttttgtatatgcacttccacaaagccaacgagtttttgggtatgacccgcctgccgacattcttatgtaacgatgtggttaaaaatccgcaagtggaaaaatacttggcagattatcaggcacacttggaaaaagtgttcggctaa

SEQ ID NO: 5914 - DNA, 387 bp, Neisseria meningitidis
atgacatatagtggattaaatttaaatcaggacaaggcaacgaagccgcagacagtacaaatagtacggcaaggcgaggcaacgctgtactggtttttgttaatccactatagattcaggcgcgagaggcgagaaactcagtcattgttgatgacgcgcaatacgttaaaattcattccgttttggtcgtataaacatattacatacgccatttttttgtattcaaggctgcctgaaaacagtgggcaagaatatctaacccaacgaaaagctgaaaaagcaacaaaaaataatctgcaccttagtcggttggttagtccaaccttaggggtgcagaccattcaatctttcaggctgcctttgtttgtttataagataaatttttag

SEQ ID NO: 5915 - DNA, 1041 bp, Neisseria meningitidis
atggatatttcagattttgattttaccctgcccgaaaagctgattgcccagcatccgcccgaagtgcgcggcagcagccgccttttggttgcgttgcccgatatgccgctgcaagaccgggtgttcggcgatttgccggattatgtcgaggcgggcgacgttttggtgttcaacaacaccaaagtcatgaaggcgcggctgtttgggcagaaagacagcggcggcaggatcgaagccctgattgagcgcgtgttggacaaccataccgcactggcgcacatccgttcgtccaaatcgcccaagcccggtatggggctggtgtttgaaggcggcatccgcgccgtgacggtcgggcgtgagggcgaactgttctgcctgcgttttgaaggcggagagaccgtttacgaacttttggaacagaacggacacctgcccctgccgccttatatcgaacgcgccgccgatgcggatgacgacagccgttatcaaaccgtttatgccaaatatcagggcgcggtcgccgcgccgacggcgggcctgcattttacggaagaacttttgcaccgtctgaaagacaaaggcgcggtaaccgcagaagtaaccctgcacgtcggtgccggaacgttccaacccgtgcgtgtggacaaaatcgaagagcacaaaatgcacagcgaatggtttgaagtgccgtctgaaaccgccgccgccgttgaggcggcaaaagcccgggggaacaaagtctgggcggtcggcacgacttccatgcgcgccctcgaatctgccgcgcgtgcgacgggtcgtctgaaagcggggcagggcgacaccgatattttcatcacgccgggctaccgttttaatgttgtcgacagactggttaccaattttcatttgccgaaatcgacgctgctgatgttggtcagcgcgttttcgggtatgggtcatatccgcgccgcgtatcgtcatgcggtcgaacgcgaataccgtttcttcagctacggcgatgcgatggttttggggcggaacgaaggggtggtacgttag

SEQ ID NO: 5916 - DNA, 456 bp, Neisseria meningitidis
atggatttgcgcaaattaaaaaaactgattgatttggttgaagaatcgggtatcgccgaaatcgaagtaaccgaaggcgaggaaaaagtccgcatcacccgaaccatcgccgccgcacccgtttacgccgcgcccgtacctgccgccgcgccggccgtaacgcctgccgccgcacccgttgcggcatccgcgcccgccgccgcacctgccgcccgcgatttgtccgacgcgcaaaaatcgcctatggtcggcacgttctaccgcgcacccggcccgaatgccgcgccttttgtcgaagtcggccaacaagttaaagccggcgacacgctgtgcatcatcgaagcgatgaagctgatgaacgaaatcgaagccgaaaaatccggcacggtcaaagaaattttggtcgaaaacggtacgcccgtcgaattcggcgaaccgctcttcattatcggataa

SEQ ID NO: 5917 - DNA, 1362 bp, Neisseria meningitidis
atgctgaaaaaagttttaatcgccaaccgaggcgaaatcgcattacgcgtactccgtgcctgccgcgaaatgggcattgccaccgtcgccgtgcattccgaggccgacaaagacagcctgcacgtcaaactcgccgacgaatccgtgtgcatcggccctgccgcttccgcgcaaagctaccttaacgtccccgccattatcgccgccgccgaagtaagctgcgcggacgctgtccatccgggttacggtttccttgccgaaaacgccgatttcgccgaacaggtcgagcagtccggctttacctttatcggcccgaaacccgacaccatccgcctgatgggcgacaaagtctccgccaaacacgcgatgatagcggcaggcgtaccctgcgtccccggttctgacggcgcattgcccgacgacggcgaagaaatcctcaaaatcgccgataaagtcggttatcccgtcattatcaaagcctctggcggcggcggcggccgcggtatgcgcgtggtcgagaaaaaagaagacctcctccaatctgtcgaaatgaccaaagccgaagcaggcgcggcattcggcaacccgatggtttacatggaacgctatttgcaacgtccgcgccacgtcgaaatccaagtgattgccgacgaacacggcaacgccatctaccttgccgagcgcgactgttcgctgcaacgccgccaccaaaaagtcatcgaggaagcaccggctccgttcatcactgaaaaagaacgcgccaaaatcggcaacgcctgtgccgatgcctgcaaacgcatcggctaccggggcgcgggtacgtttgagtttttatacgaagacggcgaatttttctttatcgagatgaacacgcgcgttcaggtcgagcatccggttaccgagctcatcaccggcgtggacatcgtgcaggagcaactccgcatcgccgccggcctgcctttgcaatacaaacaaaaggatattcaagtcgaaggccacgcgtttgagtgccgtatcaacgccgaagacccgtacaacttcattccaagcccgggcctgattgaaagctgccacctgcccggcggcttcggtatccgcgtggacagccacatttaccaaggctaccgcatcccaccgtactacgacagcctgatcggcaaaatctgcgtacacggcaaaacgcgtgaacaggcaatggcgaaaatgcgcgtcgcactcgccgagctggcggtaaccggcatcaaaaccaatacgccgcttcaccgcgacctgttcgccgatgcgggtttccaaaaaggcggcgtcagcatccactatttggaacactggctggaagatcgcaaagccaaacaggacaagtaa

SEQ ID NO: 5918 - DNA, 888 bp, Neisseria meningitidis
atgccctaccaacaaatcaccgtcaacgtcaacgatgccgtcgccgaacgcctcgccgacgcgctgatggaacacggcgcactctccgccgccatcgaagatgcctacgccggcacgcaaaacgaacaggcgattttcggcgaacccggtatgcccgccgaacaaatctggcagcagagcaaagtcatcgccctgttcggcgaacacgacgaagccgccgccatcatccaaaccgccacacaagaatgcgggttaaaagacttggcatacaccggcgaaaccatcgaagaccaagactgggtgcgtctcacgcaatcgcaattcgaccccatccggatttccgaccgcctgtggattaccccctcttggcacgaagtccccgaaggcagtgccgtcaacctccgcctcgaccccggactcgccttcggcaccggcagccacccgaccacgcgcctctgcctcaaatggttggatacgcaactcaaaaacggcgaaagcgtcctcgactacggctgcggttcgggcatcctgaccatcgccgccctcaaactcggtgcaggtttcgccgtcggcgtggatattgacgaacaggccgtccgcgccggcaaggacaacgccgcgcaaaacaacgtcgatgcacaattcttcctgcccgacggtctgcctcaagggcaattcgacgtagttgtcgccaacatcctcgccaaccctttgcgtatgcttggcgaaatgctcgccgcccgcaccaaacagggcggacgcatcgtgttgtccggtttgttggacgaacaggccgaagaactcggcggcatttacagccaatggttcgacctcgacccggcggaaaccgaggaaggatgggcgcgattgagcggcgtaaaacgctga

SEQ ID NO: 5919 - DNA, 564 bp, Neisseria meningitidis
gtgcaggataaaaacaacctctgctggctcgatatggaaatgacggggctgaatcccgaaaccgaccgcattatcgaagtcgcgatgattattaccgactcggatttgaatgtgttggcgcaatccgaagtttacgccgtccaccaaagcgacgacgtgctgaacaaaatggacgaatggaacaccgccacacacggcaggacggggctgacacagcgcgtacgcgaatcgtcgcataccgaagccgaagtcgaacagaaactgctggactttatgtcggaatgggtacccggacgcgccacgccgatgtgcggcaactccatccaccaagaccggcgttttatggtcaaatatatgccgaaactggaaaactacttccactaccgcaacctcgacgtttccacgctgaaagaactcgccaaacgctggaatccgcccgttgccaaaagcgtcgtcaaacgcggttcgcacaaggcattggacgacattttggagagcatcgaagaaatgcgccactaccgcgaacactttctgatttccgccccgagagccgaagcgcaataa

SEQ ID NO: 5920 - DNA, 1284 bp, Neisseria meningitidis
atgaaccgtaacgaaattttattcgaccgcgccaaagccatcatccccggcggcgtgaattcccccgtccgcgcattcggcagcgtcggcggcgtaccgcgctttatcaaaaaagccgaaggcgcgtatgtttgggacgaaaacggcacgcgctataccgattacgtcggctcgtggggacctgcgattgtcggacacgcgcaccccgaagtcgtcgaaaccgtatgcgaagccgcattgggcggtttgtcgttcggcgcgcctaccgaaggcgaaatcgtcattgccgaagaaatcgccaaaatcatgccgtccgtcgaacggctgcgcctcgtcagctccggtaccgaagcgaccatgaccgccatccgtctggcacgcggttttaccgggcgtgacaaaatcatcaagtttgaaggctgctaccacgggcattccgacagcctgctggtgaaagccggcagcggtctgctgacgtttggcaacccgtcttccgccggtgtgcctgccgactttaccaaacacactttggtactcgagtacaacaatatcgcccaactcgaagaagcctttgctcaaagcggcaatgaaatcgcctgcgtgattgtcgaacccttcgtcggcaatatgaacctcgtccgcccgaccgaagcctttgtcaaagccttgcgcggattgaccgaaaaatacggcgcggtgttgatttacgacgaagtgatgaccggcttccgcgtcgcgctcggcggcgcgcaatctttgcacggcatcacgcccgacctgaccacgatgggcaaagtcatcggcggcggtatgccgcttgccgcgtttggcgggcgcaaagacattatggaatgtatttccccgctgggcggcgtgtatcaggcaggcaccttgtcgggcaacccgattgctgtcgccgcaggcttgaaaacgctggaaatcatccagcgcgaaggcttctatgaaaacctgacggcgcgtaccgaacagttggttcaaggttttcggacggcagcggatgcggcgggcatcgagttcaccgccgacagcgtgggcggtatgttcggtctgtatttcgccgcacacgcgccgcgaaactatgccgatatggcgcgttccaatattgaaggcttcaaacagtttttccacgggatgctcgaccgcaatgtcgccttcggcccgtccgcttatgaagcaggtttcgtttccgccgcgcatacgcccgagctgattgacgaaacggttgcggttgcggttgaagtgttcaaggcgatggctgaatga

SEQ ID NO: 5921 - DNA, 219 bp, Neisseria meningitidis
atgccgtctgaacggcaggtttcgggcttggaagcagaaagccccattttatcatttttcaggttgcgacaaggatttgcccgcttctttgcggatcacgccaaccgcatcccggatgacggaacgctcgtctttttccactttatgtgtaaagcggtagtctcggacgactccctccccgtcgtaatccacacaccactcccaatgtcggcgttctga

SEQ ID NO: 5922 - DNA, 1329 bp, Neisseria meningitidis
atgaaaaaagtatttatccgcaccttcggctgccagatgaacgaatacgacagcgacaaaatgctcgccgtcctcgccgaagaacacggcggcatcgaacaggttacccaagccgacgaagccgacatcatcttgttcaacacctgctccgtgcgcgaaaaagcgcaagaaaaagtcttctccgatttggggcgcgtgcgtccgctcaaagaaaaaaaccccggcctcatcatcggcgttgccggctgcgtcgcctcgcaagaaggcgaaaacatcatcaaacgcgcgccttatgtggacgtggttttcggcccgcaaacgctgcaccgcctgccaaaaatgattgtggacaaagaaaccagcgggctgtcgcaagtcgatatttccttccccgaaatcgaaaaattcgaccacctgccgcccgcccgcgtcgaaggcggcgcggcatttgtatcgattatggaaggctgttccaaatactgctccttctgcgtcgtcccctacacgcgcggcgaagaattctcccgcccgctcaacgacgtattgaccgaaatcgccaaccttgcccagcaaggcgtgaaagaaatcaacctcttgggacaaaacgtcaacgcctatcgcggcgaaatggacgacggcgaaatctgcgacttcgccaccctgctgcgcatcgtccacgaaatccccggcatcgaacgtatgcgcttcaccaccagccacccgcgcgagtttaccgactcgattatcgagtgctaccgcgacctgcccaaactggtttcccacctgcacctgccgattcaaagcggttccgaccgcgtattgagcgcaatgaaacgcggctacaccgctttggaatacaaatccatcatccgcaaactgcgcgccatccgtcctgatttgtgcctgagcagcgatttcatcgtcggcttccccggcgagaccgaacgcgagttcgagcaaaccttgaaactggtgaaagacatcgccttcgacttgagcttcgtgtttatttacagtccgcgccccggcacgcctgccgccaacctgccggacgacacgccgcacgaagaaaaagtgcgccgcctcgaagccttgaacgaagtcatcgaagccgaaaccgcgcgcatcaaccaaaccatggtcggcacggtacaacgctgcctggtcgaaggcatctccaaaaaagaccccgaccaactgcaagcccgtaccgccaacaaccgcgtcgtcaacttcaccggcacgcccgacatgattaaccaaatgatcgatttggaaatcaccgaggcctacaccttctccctgcgcggcaaagttgtcgaagcctaa

SEQ ID NO: 5923 - DNA, 1914 bp, Neisseria meningitidis
atgaacccaagccccctactcgacctgattgacagcccgcaagatttgcgccgtctggacaaaaaacagctgccgcgccttgccggcgagttgcgcacctttctgctggaatctgtcgggcagaccggcgggcatttcgccagcaatttgggcgcggtcgaactgaccatcgccctgcactatgtgtacgacacgcccgaagacaagctggtgtgggatgtcggacaccaaagctatccgcacaaaatcctgacaggcaggaaaaaccagatgcacaccatgcgccaatatggcggtttggcgggttttccgaaacgttgcgagtccgagtacgacgcgttcggcgtggggcattcctccacctccatcggcgcggcgttgggcatggcggcggcagacaaactcttgggcagcgaccgccgcagcgtcgccatcatcggcgacggcgcgatgacggcggggcaggcgtttgaagccttgaattgcgcaggcgatatggatgtggatttgctggtcgtcctcaacgacaacgaaatgtcgatttcccccaacgtcggcgcgctgccgaaataccttgccagcaacgtcgtgcgcgatatgcacggcctgttgagtaccgtcaaagcgcaaacgggcaaggtattagacaaaatacccggcgcgatggagtttgcccaaaaagtcgaacacaaaatcaaaacccttgccgaagaagccgaacacgccaaacagtcgctgtctttgtttgaaaacttcggcttccgctacaccggccccgtggacggacacaacgtcgaaaatctggtggacgtattgaaagacttgcgcagccgcaaaggccctcagttgctgcacgtcatcaccaaaaagggcaacggctacaaactcgccgaaaacgaccccgtcaaataccacgccgtcgccaacctgcctaaagaaagcgcggcgcaaatgccgtctgaaaaagaacccaagcccgccgccaaaccgacctatacccaagtgttcggcaaatggctgtgcgaccgggcggcggcagattcccgactggttgcgattacccccgccatgcgcgagggcagcggcttggttgagtttgaacaacgattccccgaccgctatttcgatgtcggcatcgccgagcagcacgccgttacctttgccggcggtttggcttgcgaagggatgaagcccgtcgtggcgatttattccacctttttacaacgcgcctacgaccaactggtgcacgacatcgccctgcaaaacctacccgttttgtttgccgtcgaccgcgcgggcatcgtcggcgcggacggcccgacccatgccggtctgtacgatttgagctttttgcgctgcgtgccgaacatgattgtcgccgcgccgagcgatgaaaacgaatgccgcctgttgctttcgacctgctatcaggcagacgcgcccgccgccgtccgctatccgcgcggcacgggtacgggcgcgccggtttcagacggcatggaaaccgtggaaatcggcaagggcattatccgccgcgaaggtgagaaaaccgcattcattgccttcggcagtatggtcgcccccgcattggcggttgccgaaaaactgaacgccaccgtcgccgatatgcgcttcgtcaaaccgatagacgaagagttgattgtccgccttgcccgaagccacgaccgcatcgttacccttgaagaaaacgccgaacagggcggcgcaggcggcgcggtgctggaagtattggcgaaacacggcatctgcaaacccgttttgcttttgggcgttgccgataccgtaaccggacacggcgatccgaaaaaacttttagacgatttgggcttgagtgccgaagcggtggaacggcgtgtgcgcgcgtggctgtcggatcgggatgcggcaaattaa

SEQ ID NO: 5924 - DNA, 906 bp, Neisseria meningitidis
atgggtttggacggacttgcggcatacttggacgcttatttggaaaatatcgtgcgcgagggtaaatcggagcacacggttgccgcataccggcgcgacttgcaggaactgcttgcccttctggaagaaatgccgtctgcaaacccttcaaattgcactcgcggcgacttcgtacaggcattacgccggctgtccggccgcggtttgggggaacggacgctggctcgcaagctttcgtcttggcggcagtattgcgtttggctggtaaagcgcggcctgatgcacgccgacccgaccgccgacatcaaaccgccgaagcagcccgagcgcgtacccaaagccctgccgcaggaatggctgaaccggatgctggatttgcccgtggacggcggcgacccgctggcggtgcgcgaccacgccctgttcgaactgatgtacggcagcggtttgcgcgtgagcgagatacacggcttgaatgcagatgatgtctatttggacgaggcgtgggtacacgttatcggcaaagggcgcaagcagcggcaggtgccgctggtcggcaaaagcgtggaagccctgaaaaactatctgccgctgcgtcagacggcatcggacggcaaagccctgtttaccggcaggaacggcacgcgcctgagccaacgccaaatccaaaaacgtttggcgcaatgggcggcgcaaaacggcgacggcaggcacgtttcgccgcatatgatgcgccacagctacgccggacacctattgcaggcttcgcgcgacatcagggcggtgcaggagctgctcgggcacagcagcctttcgaccacgcagatttataccaagctcgatttcgaccacatcgcccgcctgtatgacgaagcccacccgcgcgccaagcggcaggacgaatga

SEQ ID NO: 5925 - DNA, 1065 bp, Neisseria meningitidis
atggcactcgtatccatgcgccaactgcttgatcatgctgccgaaaacagctacggcctgccggcgttcaacgtcaacaacctcgaacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagaatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgaagcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacttgcgccttgcttctaccggcgcggtacgccgctaccttgccgaaaatccgtccgactttgacccgcgcaaatacctgagcaaaaccattgaggccatgaagcaaatctgcctcgaccgttatcttgcgtttggctgcgaaggtcaggcaggcaaaatcaaacctgtttcgttggaaaaaatggcaagccgttatgccaagggcgaattgaaccaaatcgtcaaataa

SEQ ID NO: 5926 - DNA, 963 bp, Neisseria meningitidis
atgccgtctgaaccgccgttcggacgacatttgatttttgcttctttgacctgcctcattgatgcggtatgcaaaaaaagataccataaccaaaatgtttatatattatctattctgcgtatgactaggagtaaacctgtgaatcgaactgccttctgctgcctttctctgaccactgccctgattctgaccgcctgcagcagcggagggggtggtgtcgccgccgacatcggtgcggggcttgccgatgcactaaccgcaccgctcgaccataaagacaaaggtttgcagtctttgacgctggatcagtccgtcaggaaaaacgagaaactgaagctggcggcacaaggtgcggaaaaaacttatggaaacggtgacagcctcaatacgggcaaattgaagaacgacaaggtcagccgtttcgactttatccgccaaatcgaagtggacgggcagctcattaccttggagagtggagagttccaagtatacaaacaaagccattccgccttaaccgcctttcagaccgagcaaatacaagattcggagcattccgggaagatggttgcgaaacgccagttcagaatcggcgacatagcgggcgaacatacatcttttgacaagcttcccgaaggcggcagggcgacatatcgcgggacggcgttcggttcagacgatgccggcggaaaactgacctacaccatagatttcgccgccaagcagggaaacggcaaaatcgaacatttgaaatcgccagaactcaatgtcgacctggccgccgccgatatcaagccggatggaaaacgccatgccgtcatcagcggttccgtcctttacaaccaagccgagaaaggcagttactccctcggtatctttggcggaaaagcccaggaagttgccggcagcgcggaagtgaaaaccgtaaacggcatacgccatatcggccttgccgccaagcaataa

SEQ ID NO: 5927 - DNA, 678 bp, Neisseria meningitidis
atgcaagctgattttaaccgtcccgtcctggccgtcgataccggtacttcccgtttgtcgctcgcgctgcgtgccgacggcgaaacccgtctgttccatcaggaagtcggcagccgccagtccgaactgattctgccggaaatccgcaccctattccgcgatgcaggcattaccgccgccgatttgggtgcggtcgtgtacgcacagggtcccggcgcgtttaccggactgcgtatcggcatcggtgtagctcagggtttggcaacgccgtttgatacccccttaatcggcgtaccctcgctcgatgccgccgcctcgctgccgccgccgcaaagctgcatccttgccgctacggacgctcgtatgggcgaagtgttttatgcatggttcgatacgctgaactgccaccgtttgagcgattatcaggtcgggcgggcggcagacatccggctgccggagggatgcgccttttcagacggcataggcagcgcgttcgcgctggaagaagctccgccgttctcaggcagaccggatatgccgactgccgccgactttctcgcattggcagccaagggcggttatcctgccgtccatgccgcacacgccggtttgctctacgtccgcaacaaaatcgccctgactgccaaagaacaggccgaacggagagcgcgcccgtga

SEQ ID NO: 5928 - DNA, 441 bp, Neisseria meningitidis
gtgaacatccgccgtgccgtttgtgccgattgtgaggagctggccgcactcgatgccgtctgcaacccgtccgcatggacgcaacgccaatttgagtccgcactggtttcgccgtccgaacaggttttccttgcggaaaaagacggcgggattgccgcctttatcgtttggcagaacctgcccgacgaatccgaactgcacctgattgccaccgcgcccgaatgccgccgccaaggaattgcgtccgccctgctcgaatattggttcacacatctgcccgaagacacgcaacgcctgctgctcgaagtccgtgcaggcaacaccgccgcacaggcactgtacacggcgcacggcttcagcattacgggcaggcggaaaaactattaccgtacagccgacggtaaaaccgaagatgccgtcttaatggagaaaatatgttaa

SEQ ID NO: 5929 - DNA, 738 bp, Neisseria meningitidis
atgttaagcgcgcgctacctccacctgcacgaagctttgggtttgggtccgatgtggctgaaacaggccgccgccgtcctgccgcccaaaaacacacccgcaccctcggcacaggcacgtccccaaaccgtccgcgccgccccgatccgcccttcccaaccccataacggtcaggcgcggctcgaaacgatgaaagcgttggaaaccgccgccgtacctacgcgcaaacccgcgcctgaaaccgaaacgcctctgcccggcctttcagacggcatcgcccccgttcccgccgcttcgggcatcaccaagcttgccgtcgtcagcctttgcccaccgatcgaggatgcggtttacgggcaactgttccacggcaaagcaggcatcctgctcgacaacatactcaaagccgtaggactggatgccgcctatgtccacaaaacctgttgggtgaaaaccgccgccgtcggcaacccgatgccgtctgaacaggccgtcgcgaatgcgctgggtcaaatcgcccgcgaactcgacggctgccgcgccccggctgtccttttcctcgggcaggcttttgtccagcctgaacggcaaacgatgattgaaactttgtgcggcagccgtcccttcttcatcatcgaccatcccgcccggcttttacgccaacccgaactcaaagcccgcgcctggcaggtgttgaaacagttgaaacgcgccttgcggcaaggcggcggcagttga

SEQ ID NO: 5930 - DNA, 642 bp, Neisseria meningitidis
atgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaaaaacaatacggtctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 5931 - DNA, 435 bp, Neisseria meningitidis
atgcccgcctgtttctgcccccactgcaaaacccgtctctgggtcaaagaaacccaactcaatgtcgcccaaggcttcgtcgtctgccaaaaatgcgaaggactgtttaaagccaaagaccatctggcaagcacgaaagaacccatattcaacgatttgcccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 5932 - DNA, 1311 bp, Neisseria meningitidis
atgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctga

SEQ ID NO: 5933 - DNA, 2016 bp, Neisseria meningitidis; identical to SEQ ID NO: 1143

SEQ ID NO: 5934 - DNA, 588 bp, Neisseria meningitidis
atgtgcgcgctgcatttggatttttcgctggaaaaactgcgccgctggcacgacgaaggcttgctggacgaacgcctgttttcgccgcaaacaataggccgattcgccctgcaacggctggcgcaaaacgcagcggcactgacggcggcggcctgcccactgctgcaacgcccgttcgaatcggacggcttcggcctgcttgccgacgaagccgccgcgctggaactctccgcccgattattgcgcttcaccttccgccgccacgacaacggttaccgccgtcggcgcatagacgaagccgccgacatcctgcaacacgaattcgcccgtccgctgaccatcgccgaaatcgcccgccgcgtcggactgaacgaatgctacctgaaacgctatttcaaagcgcaaaccggcgaaaccgtcgccggatgcctgcgccgcctgcggctggaacacgcgctcgccctcatcgaatccggcagcaccgtccaagccgccatgcacttttgcggctaccgccacgcgggacggttcaacgaagcgttcagacggcattacggatttttgccttcggatgtgaagaagtgctga

SEQ ID NO: 5935 - DNA, 312 bp, Neisseria meningitidis
atgaacaccgccgccatctaccgccagtaccaaacctatgtccgctccgataaatccggctgggcgttggacggctgttccgacagcgcgctcattgcgcaggcaaaacagcccggtttgcatctggaaatgtgcatcaaccgcttcgattcgggcatcaccttgtcgcggatgcgcggcggcggaacgggcgcgtttcccaccgaaatccacaatttcagccacaactgcgccttgttcgtcatggtgtcggggcagaaccggttacaaatgggcggcagggaataccgcccatctgccggcgaaatctga

SEQ ID NO: 5936 - DNA, 966 bp, Neisseria meningitidis; identical to SEQ ID NO: 3557

SEQ ID NO: 5937 - DNA, 324 bp, Neisseria meningitidis
atgcaaaacgaaaccatcaacctgaaacagcaccttgccgccatcaaagaatactggcagcccgaaatcatcaaccgccacgggttccaattccacttggtcaaacttttgggcgattacggctggcatacgcacggatacagcgacaaagtgctgtttgccgtggagggcgacatggcggtggacttcgccgacggcggcagcatgacgatacgcgagggcgagatggcggtcgtgccgaagtcggtgtcgcaccgcccgcgttcggaaaacggctgctcgttggtgctgattgagttgtccgacccgtccgaggccgtctga

SEQ ID NO: 5938 - DNA, 2178 bp, Neisseria meningitidis; identical to SEQ ID NO: 665

SEQ ID NO: 5939 - DNA, 291 bp, Neisseria meningitidis
ttgaggcaggcatttcagacggcattccttaaatgcgtgtacctgtggtgttccaaaaggtcgtctgaaagtgcagcttctgcgaagctaaagcgcggtatcaacgaagttaaaatttgcctgaaccttaaaggcagcctgcaccccaatcccctctcccgtgggagagggctaggacgaggcgggcaaactgaaagtttgcttgggcggcattttcaatgtgcaggctgcttttatagtggattaacaaaaatcaggacaaggcgacgaagccgcagacagtacaaatag

SEQ ID NO: 5940 - DNA, 324 bp, Neisseria meningitidis
atggatattgtgcaacttgggcccgcggaattgaaagcgtggatggacgaagggcggatgttttgtttgttggacgtgcgtacggatgaagaaacggcggtttgttcgctgccaaatgcgctgcatatcccgatgaatctgattccgctgcggcagaacgagctgccggatgatgtgccgcttgtggtgtattgccaccacggtatccgcagcctgcatacggcgatgtatttggcggacgcgggttttgaaaacctgtacaaccttcagggcggcatcgatgcatgggcggccgagattgacggcaacatgatgcgttattga

SEQ ID NO: 5941 - DNA, 657 bp, Neisseria meningitidis
atggattttgaaaaagcgcggttcaatatggtcgaacagcaaatccgtccgtgggatgtattggattttgatgtgttggacgctttggcggagattccgcgcgagctttttgtcgatgaggacttgcagggtttggcgtatgcggatatggcgctgccgcttgccaacggtcataagatgctcgagccgaaagtcgtggcgcggctggcgcagggcttgaagctgacgaaaaacgatacggttttggaaatcggcacgggttcgggctatgcgaccgcgctgttggcaaaattggctggtcgtgtggtgtcggacgacatcgatgtcgaacagcaaaaccgcgccaaagcggtgttggacggcttgggtttggacaatatcgattatgtgcaaaacaacgggttgaccgaactttccgcaggtgcgccgtttgatgcggtttatgtcggcggtgcggtaaaccttgtgcctgaagtgttgaaagaacagttgaaagatggcggacgcatggtggttatcgtaggtcgcaagcctgttcaacgcgcgcttttgattacgcgcaggggcgatgtgtttgaagagaaggtgctgttcgataccttggtggcgcatttggatgataaggatgccgatccgtttggcggtttcgatttttaa

SEQ ID NO: 5942 - DNA, 504 bp, Neisseria meningitidis
atgcacgcgcttcatttttcggcttcggacaaggccgcgctttatcgggaggtgttgccgcagattgagtctgtggtggctgacgaggcggattgggtggcgaatttggcgaacacggcggcggttttgaaggaggcgttcggttggttttgggtgggtttttatttggtcgatacgcgttcggacgaattggttttggcaccgtttcaggggcctttggcgtgtacgcggattccgttcggtcgcggggtgtgcggtcaggcttgggcgaagggtgaaacggtggttgttaaggatgtcaacgcgcatcccgaccatattgcctgttcgtctttgtcacgttcggagattgtcgtgccgctgttttcagacggccgctgtatcggcgtgttggacgcggacagcgaacatttggcgcagtttgatgagacggatgctttgtatttgggcgaactggcgaagattttggagaagcggtttgaggcttcgcgtcaggcggtttga

SEQ ID NO: 5943 - DNA, 774 bp, Neisseria meningitidis
atgtatcgccaaatcggaatgtgggatcaaaaatgggtcatcggcaactggaaaatgaacggccggctccaaaacaacaacgcactgatgcaccgcttccgcatccaccccaccgccgaacgcgtcctcatcggactcgccgccccgaccgtttacctgctgcaactgcacaacgccatgcaaatcgttttaaacaaccgcatcctcacctgcgcccaagacgtgagccgcttccccaataacggcgcgtacaccggcgaagtgtccgccgaaatgctcgccgacaccggcacagacatcgtcctcatcggacactccgaacgcagcctttatttcggcgaaaaaaacgaaatccaacgccgcaaaatggaaaacgtcctcaacgtcggactcatcccgttattgtgcgtcggcgaaagcctcgaagagcgcgaagccggcaaagaacacgaagtcatcgcccatcagctttccatcctgcaagggctggataccaaaaacatcgccgtcgcctacgaacccgtctgggcgatcggcaccggcaaagtcgccaccgtcgaacagattgccgatatgcacgcattcatctacaaagaaatcttgtctttgtgcggaagcgatgttaaaatccgcgtcctttacggcggaagtgtgaaagcggacaacgcggccgacatcttcgcagtaccttatgtggacggcgcactcgtcggcggcgcgtcattgtcgtacgactcctttaccgccatcatcagtgccgcacaaaatgcgtag

SEQ ID NO: 5944 - DNA, 351 bp, Neisseria meningitidis
atggaagccttcaaaaccctaatttggattgttaatataatttccgctttggccgtcatcgtgttagtattgctccaacacggcaaaggcgcggatgccggcgcgactttcggatcgggaagcggcagcgcgcaaggcgtattcggctctgccggcaacgctaacttcctcagccgctcgaccgccgttgcagcaacatttttctttgcaacctgcatggctatggtgtatattcacacccacacgacaaaacacggtttggacttcagcaacgtacaacaaactcagcaagcacccaaacccgtaagcaataccgaaccttctgcccctgttcctcagcagcagaaataa

SEQ ID NO: 5945 - DNA, 93 bp, Neisseria meningitidis
atggcggttaaaccgcttggttatatacggggaataggaagacagcgaaacgcgctaaaaacgcaatttgagccattaaaagcgattgattaa

SEQ ID NO: 5946 - DNA, 369 bp, Neisseria meningitidis
atgcggatattcaaaaaccaatggatagtgaaatttgccaagaagcacaaaatcaacgattccgagctgctggaagcggtagagcgggcggataacgggctgatagacgcagatttaggcggcggtgtgattaagcagcgcatagcaaggcaaggacaaggcagaagcggcggttatcgcagtctgatactgttcaaacaggcagacaaggcattttttgtttacgcctttgccaagaacgacagggaaaacatttcggataaagaacttgacgtttaccgaaaagccgccgcatattatctgaaatacacgcgggcagagctggcggctttgaaagaagacggcattatcacggagatagaatcatga

SEQ ID NO: 5947 - DNA, 312 bp, Neisseria meningitidis
atgaaatacaaaaacgaggcattagccgccattcatgaaatgatggaaggggcttacaacatcggcgcaatcgacaaaaagaccatgcgcgactttgacaagtcctgcctgaccgaaatcaaaccgttgagcggcggagacatcaaggcaatcagggagaaggaggcactatcgcaagccgctttcgccatctatctcaacgtgggaaaaaatcacgtttcggcttgggagcggggcgttaaaaagccgagcggcgcggcgttgaagctgctgaccatcgtcaaaaacaagggcatcgaagccattgcgtag

SEQ ID NO: 5948 - DNA, 213 bp, Neisseria meningitidis
atgcccgaccgcatcaaaccaagccgaaacggcggcggtgcagacgacatagcccgacagcaaggcacggcgcagacgggcgcgaaacccgaaacatcaccgaccgcgaggtacggggattttttgcgcccgttgcagggggggattggatttaagcggcgcgggcttgaaggcaaaacgggtggggcacagaactgtttaaatgcagtctga

SEQ ID NO: 5949 - DNA, 848 bp, Neisseria meningitidis
atgaaatttccttccttccttcctttaaacggatactctgcctgtcggcagtaatctcggtattgggggcttgtgcggtcgttgctgatgtttacggtcatgattccgccacaatgaacgctgcggctgccaaagattatatgaaaacggttgagttaaacaagtctgccggcaatgtcgataccacatccagaacagcccgcagggtgcaggcagtatttcgacgtatgctgccttatgccgatgcggcaaataataccagccataagtttgactggaaaatgacggttttcaaaaacgatgagctgaacgcgtgggcaatgcccggtggaaaaatggcgttttatacggggatagtcgacaaactcaagctgaccgatgacgaaattgccgccattatggggcatgaaatgacgcacgccctgcatgaacacggtaaaaataaggtcgggcagcaaatcttgaccaatacggcggcgcagataggcacgcagattatattagacaaaaaaccggatactaatccggaattggtcggattgggtatggatattttggggacgtacggtcttaccttgccttatagccgcagcttggaagaagaagccgatgaggggggaatgatgttgatggcgcaggcaggctatcatccggcggccgctgtcagggtttgggaaaaaatgaatcaggaaaacgaccaaaacggctttatttatgctattacctctactcatccgacaaacaatgcccgtatagaaaatctaaaacggttgttgccgaccgttatgccggtttatgagcaaagtgtcagaaataaggggcgcgttaataaaaaacgtcggcgttaa

SEQ ID NO: 5950 - DNA, 132 bp, Neisseria meningitidis
atgcgtgatttcgacaaaccggctgaagaagctgccgaatacgccgctgaaggcgcggtgaaattcatagaaggcaagcctgccaagaaaatcatcgccgtaccgggcagactggagaacatcgtggtgtaa

SEQ ID NO: 5951 - DNA, 144 bp, Neisseria meningitidis
ttgatttcaaatcatgatactgaattcacaagggatatttattcttctgccattttgaaaacagttgaagttcagcgcaatattgccgcaaaaggcagcagcagccgtaaaaaagttggagaattattggcaatttatgcgtga

SEQ ID NO: 5952 - DNA, 804 bp, Neisseria meningitidis
atgaatttatttttcgataccgaattgggaaagcaacaaaataaagcaacccataaaatccgtgtaatgagcgaggcttggttggaaaaaaacggctactgcccctgttgcggaagcaagccgatgcagagatttgccaataacaaacctgttgcagacctcttttgcccaaattgccacgagcaatatgaattaaagagtaaaaatcaaaaaaccataggcaacagcgtgcctgacggtgcatatcacaccatgttggagcgcatccggtcagataccaaccccaactttttctttcttgcatataaaaaagcggattactccatacggcaattggtgcttgtacccaaacatttcatcacgccggatatgattattcccagaaataaaggcattaaaaaccggccgaaccacattatgtgttctatcaatctcgcccctttgcctgaaagcggcaaaatattcttaatagacaattcccgcattatcgaacccgaaaccgttctgaaaaaatggcaatccaatttgtttttacgcaaccaaaatgcggagcgcaaaggctggcttctggctgttatgaaatgtatcgaccaactccccgaagaattcacattgtcgcaaatgtatgaatttgaaaacaaactatccatccaatttccccaaaacaaccatatcagagacaaaatccgccaacagttgcaaattctgcgcgaccaaaatacgatcgaattcattggtcgcggactttacaaaaaatcaataaattgcgcccaactcccaaggtattttgatttcaaatcatga

SEQ ID NO: 5953 - DNA, 2631 bp, Neisseria meningitidis
atgcaagaacaataccggcccgccgccattgagcctgcggcgcagaaaaaatgggacgacgcccgtattttcaacgtctccgaagacgcttccaaacccaaatattattgcctctccatgttcccctatcccagcggcaagctgcacatggggcatgtgcgcaactacaccatcggcgatgtattgagccgcttcaaacttttaaacggcttcaacgtcatgcagcctatgggttgggacgcgttcggcatgccggcggaaaacgcggcgatgaaaaacaacgtcgcccctgccgcttggacgtacgataacatcgaatacatgaaaacccagctcaaaagcctaggttttgcgattgactgggcgcgcgaaaccgcaacctgcaaacccgaatactaccgctgggaacaatggctgtttaccaagctgtttgaaaaaggcatcgtttatcgcaaaaacggcacggtaaactgggaccctgtcgaccaaaccgtccttgccaacgagcaagtcatcgacggacgcggctggcgttccggcgcattgatcgaaaaacgcgaaatcccgatgtattacttcaaaatcacggattacgccgaagagctgctcaacgacttggacaagctggaacactggccggaacaagtcaaaaccatgcagcgcaactggatcggcaaatcgcgcggtatgaccgtgcgcttcgccgtttcagacgacagcaaacaaggcttggaaggcgattacgcgaaattcctgcaagtttataccacccgccccgacacgctgatgggtgcgacttatgttgccgttgccgccgagcatccgctggcagccgccgcagccgccgacaaacccgaattgcaggcatttattgccgaatgcaaagccggttcggttgccgaagccgatatggcgacgatggagaaaaaaggcgtgccgaccggccgctacgtcgtcaacccgctcaacggcgacaagctggaagtgtggattgccaactatgtattgtggggctacggcgacggcgcggtgatggcggttccggcgcacgacgaacgcgattttgagttcgccaccaaatacaatctgccgaaaaaacaagtcattgccgtcggcgacaacgcatttgacgaaaaccaatggcaagaatggtacggcgacaaagaaaacggcgtattggtcaacagcggcgacttggacggcttggattttcagacggcattcgacgccgtcgccgccaagctgcaaagccaaggcgcgggcgaaccgaaaacccaataccgcctgcgcgactggggcatttcgcgccaacgctactggggctgcccgattcccatcgtccattgcgaacaatgcggcgacgtacccgtccctgccgaccaattgccggtcgttttgcctgaaaacgtcgtacccgacggcatgggttcgccgctggcaaaaatgcccgagttttacgaaactgcctgcccatgctgcggcggcgcggcgaaacgcgaaaccgacaccatggacaccttcatggaatcgagctggtatttcttccgctacatgtcgccaaaattttcagacggcatggtcgatcctgccgccgcgaaatactggggcgcggtcgaccaatacatcggcggcatcgaacacgcgattttgcacctcttgtacgcgcgtttcttcaccaaactgatgcgcgacgaaggtctagtcaatgttgacgaaccgtttgaacgcctgctgacgcaaggcatggtcgtttgcgaaacctactaccgcgaaaacgacaaaggcggcaaagattggatcaaccccgccgatgtcgagctgacgttcgacgacaaaggccgccccatttccgccgtcctcaaagccgacgggctgcccgtcgtcatcagcggcacggaaaaaatgtccaagtccaaaaacaacggcgtcgatccgcaagaactgattaacgcctacggcgcggacaccgcccgcctgtttatgatgttcgccgcaccgcccgaacagtccctcgaatggagcgacagcggcgtcgaaggcgcacaccgcttcctgcgccgcctgtggcgtaccgtttacgaatacttgaagcaaggcgaagcggtcaaagcgttcgcaggcagccaagacggtttgtctaaagaactcaaagacctgcgccacaaactgcacgcgaccactgccaaagtcagcgacgactacggccgccgccagcagttcaacaccgccatcgccgccgtgatggaattgctcaaccaatacgacaaaaccgacaccggcggcgaacaaggacgcgccgtcgcccaagaagtattggaaaccgccgtacgcctgttgtggcccatcgtgccgcacatctgcgaaaccctgtggagcgaattgaacggcgcgaaactgtgggaagcaggctggccgacagtcgacgaagccgccttggtcaaatccgaaatcgaagtgatggttcaagtcaacggcaaactgcgcggcaaaatcactgttgccgccgacgcatccaaagccgacctcgaagccgccgcactcgccaccgaaggcgcggtgaaattcatggaaggcaaaccggcgaagaaaatcatcgtcgtaccgggcagactggtgaacatcgtcgtctaa

SEQ ID NO: 5954 - DNA, 516 bp, Neisseria meningitidis
atgaaaatcaaacaaatcgtcaaaccgggcttggcagtattggcggcgggcgttctgtctgcctgcgcaaccaaaagcaacgtcaaagccgacggcacgaccgacaatccggttttcccgaaaccctattccgtaacgctcgacaacaagcgcggcacattcccgacttatgacgaactggatcagatgcgccccggcctgaccaaagacgacatctacaaaatcctgggccgcccgcattacgacgaaagtatgtacggcgtgcgcgaatgggattacctgttccacttccataccccgggcgtaggtatcgaccctgaaaacacttccggcgtagaagatgttactacctgccaatacaaagtgattttcgataaagacaaatttgcccgcagcttctactggaaccccgtcttcccgaaagatgccgcctgtccgccgcccgcacccaaagccgagccgcaagtcatcatccgcgaaatcgtgccggcaaaaccgaaacgtatccgccaataa

SEQ ID NO: 5955 - DNA, 444 bp, Neisseria meningitidis
atgccgttccgcctgtttttagggatattatgcggcctgtcaatggttgcccccgtatatgcacaggggcagccggatacggtcggcgactttatccaaaagaaaaaagtcatcgtcgatacatccaaagcggaactctgtttcgctgacgaccgtcagtgccaccccgtcctcatcggtgttgccacgcccaaggggacgttcgggctgacgctgaacagtaccgacaagcccggatacggcggcgaagtcatcggtttcaagcaggagggtgattttcttttcgccctgcaccgcgtttggaatcagataccgtcggaaaggcggaacgaacgcatcgcctccccgtccgtgtccgacaggattatgaccaacggctgcatcaacgtcagcgatgcggtgtacgaaaaactgcgtcattattttgtgttggaagtgatttga

SEQ ID NO: 5956 - DNA, 2151 bp, Neisseria meningitidis
atgccgtctgaaaccggcgcagatgccgccaagccttcagacggcattgcctgcccgctccgaccgaacaacaaccatctttgggagaaccttatgcccgaacaaaaccgcatcctctgccgcgaactgagcttgctggcattcaaccgccgcgtgttggcgcaggcggaagaccaaaacgtcccccttttggaacgcctgcgcttcctgtgcatcgtttcatccaacctcgacgagtttttcgaagtccgtatggcgtggctgaagcgcgaacacaaacgctgcccgcagcgcaggctggacaacggcaaaatgccgtctgaaaccatcgccgacgttaccgaagcggcgcgctccctgatacggcaccagtacgacctgttcaacaacgtccttcagcccgagctggcacaagaaggcatccatttttaccgccgccgaaattggacagacacacagaaaaaatggattgaagactatttcgaccgcgaattgctgccgatcctgacccccatcggactcgacccttcccaccccttcccgcgcccgctgaacaaatcgctcaacttcgccgtcgaactcgacggcacagacgcgttcggcaggccttcggggatggcgattgtgcaggcaccacgcatcctgccgcgcgttgttcccctgccgtccgaactgtgtggcggcggacacggcttcgtcttcctctcctccatcctgcacgcccacgtcggaaaactcttcccgggcatgaacgtcaaaggctgccaccagttccgcctgacgcgcgacagcgacttgaccgttgacgaagaagacctgcaaaacctccgcgccgccattcaaaacgagttgcacgaccgcgaatacggcgacggcgtgcggctcgaagtcgccgacacctgtcccgcctacatccgcgactttctgctcgcgcaattcaaactgaccgccgccgaactctatcaggtcaaaggcccggtcaacctcgtgcgcctcaacgccgtccccgacctagtcaaccgccccgatttgaaatttcccacacacacgccgggcagactgaaagccttgggcaaaaccgcgtccatattcgatttggtgcgccaatcgcccatcctgctgcaccacccctaccaatcgttcgaccccgttgtcgaaatgatgcgcgaagccgccgccgaccccgccgtgcttgccgtcaaaatgacgatttaccgcaccggcacgcgttccgaactcgtccgcgccctgatgaaggcggcactcgccggcaaacaagtaaccgtcgtcgtcgaactgatggcgcgttttgacgaagccaacaacgtcaactgggcgaagcagctcgaagaggcgggcgcgcacgtcgtgtacggcgtgttcggctacaaagtccacgccaaaatggcactggtcatccgccgcgaagacggcgtgctcaaacgttacgcccatctcggcacgggcaactaccaccaaggcacatcgcgcatctacaccgacttcggcctcattaccgccgacgaacaaatcaccgccgatgtgaacatattgtttatggaaatcacaggtttgggcaaacccgggcggctgaacaaactctaccaaagtccgtttaccctgcacaaaatggttatcgaccgcatcgcacgcgaaaccgaacacgcaaaagccggcaaaccggcgcggattaccgccaagatgaattcgctcatcgaaccgaccgtcatcgaagccctgtatcgggcaagcgcggcaggcgtacaaatcgatttgattgtgcgcggtatgtgcaccttgcgcccgggtgtaaaaggcttgtccgaaaacatccgcgtccgctccatcgtcggcaggcagctcgaacacgcgcgcgtgtattacttccataacaacggcacggacgatacctttatctccagcgcggattggatggggcgcaacttcttccgccgcatcgaaaccgccacgccgattaccgcgcccgaactcaaaaagcgcgttatacatgaaggactgaccatggcactggacgacaacacccacgcgtggctgatgcagcccgacggcggctatatccgcgccgcacctgccgagggcgaatccgaagccgacctgcaaaacgatttgtggacactgctcggaggctga

SEQ ID NO: 5957 - DNA, 542 bp, Neisseria meningitidis
atgaagataacgcactgcaaattaaagaaaaaagtacagaaagaactgctccgttttttgtgctggaagttaccgcccgttctgccgccgatattttgggtatccatcccaattcggcagcactgttctaccgtaaaatccgcacggttatcaaccatcatttagccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaagaagaaaatcatgccggacagcattgtttataccgatagtctgagcagctgcgacaagttggacgtgagcggttttatccattaccgcatcaaccattccaaggagtttgcagaccgtcagaaccacattaacggcattgagaatttttggaatcaggcaaaacgcgtcttgcgaaaattatag

SEQ ID NO: 5958 - DNA, 1104 bp, Neisseria meningitidis
atgttgattttacaagccgagcgcgacagcctgctcaagccgttgcaagccgttaccggcatcgtcgaacgccgccacaccctgcccatcctgtccaacgtcctgattgagggaaaaggcggtcagaccaaactcttggcaaccgatttggaaatccaaatcgacactgcgggtcccgagggcggcgcgggcgacttccgcatcaccaccaatgccaagaaatttcaggatattttgcgcgcgctgcctgccggtgcgctggtgtcgctggattgggacgacagccgtctgacgctgaaggcgggcaaatcgcgttttgccctgcagaccctgcctgccgccgattttccgatgatgaatgtcggcgaggacatcagcgcgactttctcgctggagcaggagcgtttcaaaaccatgctgtcgcaagtgcagtacagcatggcggtgcaggacatccgctattatctcaacggtctgctgatgcaggttgagggcagccagttgcgccttgtggcgaccgacggacaccgccttgcctatgcagcctgcgcgattgatgcggatttgccgcgcgccgaagtgattttgccgcgcaaaacggtgctggaactgttcaaactgttgaacaaccccgacgatccgattcaaatcgagctgctggacaaacaggtgcgtttccaatgcaacggcacgaccatcgtcagcaaggtcatcgacggcaaattccccgatttcaaccgcgtgattcctttggacaacgacaagattttcgtgttgtcgagggcagaattgttgggcgcgttggaacgtgcatcgattcttgccaatgaaaaattccgcggtgcgcgattgtttttgcaacccggcctgttgagcgttgtgtgcagcaacaacgagcaggaagaagcgcgcgaagaaatcgaaatcgcctatcagggcggcgaactcgaagtcggtttcaatatcggctatctgatggacgtgttgcgcaacatccattccgacgatatgcagcttgccttcggcgatgccaaccgctcgacgctgtttaccgtgccgaacaatccgaatttcaaatatattgtgatgccgatgcggatttga

SEQ ID NO: 5959 - DNA, 1557 bp, Neisseria meningitidis
atgacattagcagagttttggccgctgtgcctccgccgtcttcacgatatgttgcctcaagggcagtttgcgcaatggattgcgccccttaccgttggtgaggagggtggcgtatgggtggtgtacggcaagaaccagtttgcctgcaatatgctcaagagccagtttgccggaaaaatagaagcggtgagggaagagttggctgccggccgttccgccttcgtattcaaaccgggagaaggcgtgcgttatgagatggcggcggttgaaggtgctgtcgaacctgccgagccgtccttgcatgcggtgtcggagggaatgcccgtgcaggaggttctgttggacgagctgccgtctgaagagcctgtcaaacccgctgcgtcgaaaacggcggcggatattttggcggaacgtatgaaaaacctgccgcacgagccgcgtcaggctgccgggtctgcttcccggccggaatcggtggcagttgccaaagcacggacggacgtgcagcgcgatgcggaagaggcgcgttacgagcagaccaacctgtctccggattacacgtttgatacgttggtagaaggtaagggcaaccgccttgcggcggctgcggcgcaggcgattgcggaaagcccggggcagagttacaacccgttcttcctctatggcagcacgggtttgggcaaaacccaccttgtgcaggcggtcggcaacgagctgctgaaaaaccgtcccgatgccaaagtgcgctatatgcattcggatgactatatccgcagctttatgaaggcggttcgcaacaacacttacgacgtgttcaagcagcaatacaagcaatacgacctgctgattatcgacgacatccagttcatcaaaggcaaagaccgtacgatggaagagtttttctatctgtacaaccatttccacaacgagaaaaaacagctcatcctcacttgcgatgtgttgcctgcgaaaatcgaaggcatggacgaccgcctcaaatcccgtttttcatggggactgactttggaactcgagccgcccgaattggaaatgcgcatcgccattttgcagaaaaaggcggaagcggcgggcatcagtatcgaagacgaagccgcgctgttcattgccaatctgatccgttccaacgtgcgcgagcttgaaggcgcgtttaatcgtgtcggagcgagcagccgctttatgaaccgtcccgtcatcgacatcgatttggcgcgtaccgctttgcaggacattattgccgagaagcacaaagtcatcaccgccgacatcatcatcgatgcggtggcgaaatattaccgcatcaaaatcagcgatgtgctcggtaagaaacggacacgaaacattgcccgtccgcgccaggtggcgatgagcctgaccaaagaactgactactttgagcctgccgtctatcggcgattcgtttggtgggcgcgaccatacgaccgttatgcacggcatcagggcagtggcgaaactgcgcgaagaagatccggaattggctcaggattatgaaaagctgctgattctgattcaaaactga

SEQ ID NO: 5960 - DNA, 135 bp, Neisseria meningitidis
atgaaacgcacttatcaaccttccgttaccaaacgcaaacgcacccacggcttcctggtgcgctccaaaacgcgcggcggccgcgcagtattggccgcacgccgtgccaaaggccgcaaacgcctggcggtataa

SEQ ID NO: 5961 - DNA, 366 bp, Neisseria meningitidis
ttggactaccgcttcggaaggcagtaccgcttgttgaaaacggatgatttttcatccgtttttgcattcagaaaccgccgcagccgcgacctgctgcaagtttcgcgctcaaacggcaacgggctgggccatccccgcatcggtctggtggtcggcaaaaaaaccgccaaacgcgccaacgaacgaaattatatgaagcgcgttatccgcgactggtttagattgaacaaaaaccggctgccgccgcaggatttcgtcgtgcgcgtccaccgtaaattcgacagggctaccgcaaaacaggcaagggcggaactggcacaactcatgttcggcaaccccgcaaccggatgcaggaaacaggcatga

SEQ ID NO: 5962 - DNA, 222 bp, Neisseria meningitidis
atgaacttcctattgtccaaactcctgctgggactgatacggttctaccaatattgcatcagcccgctgattccgccgcgctgccgttatacgccgacctgttcgcaatacgcggtcgaagcggtcaaaaaatacggcgcattcaaaggcggccggctcgccatcaagcgcattgcacgctgccaccctttcggcggacacggacacgaccccgttccctga

SEQ ID NO: 5963 - DNA, 1638 bp, Neisseria meningitidis
atggattttaaaagactcacggcgtttttcgccatcgcgctggtgattatgatcggctgggaaaagatgttccccactccgaagcccgtccccgcgccccaacaggcagcacaacaacaggccgtaaccgcttccgccgaagccgcgctcgcgcccgcaacgccgattaccgtaacgaccgacacggttcaagccgtcattgatgaaaaaagcggcgacctgcgccggctgaccctgctcaaatacaaagcaaccggcgacgaaaataaaccgttcatcctgtttggcgacggcaaagaatacacctacgtcgcccaatccgaacttttggacgcgcagggcaacaacattctaaaaggcatcggctttagcgcaccgaaaaaacagtacagcttggaaggcgacaaagttgaagtccgcctgagcgcgcctgaaacacgcggtctgaaaatcgacaaagtttatactttcaccaaaggcagctatctggtcaacgtccgcttcgacatcgccaacggcagcggtcaaaccgccaacctgagcgcggactaccgcatcgtccgcgaccacagcgaacccgagggtcaaggttactttacccactcttacgtcggccctgttgtttatacccctgaaggcaacttccaaaaagtcagcttttccgacttggacgacgatgccaaatccggcaaatccgaggccgaatacatccgcaaaaccccgaccggctggctcggcatgattgaacaccacttcatgtccacctggattctccaacctaaaggcagacaaagcgtttgcgccgcaggcgagtgcaacatcgacatcaaacgccgcaacgacaagctgtacagcaccagcgtcagcgtgcctttagccgccatccaaaacggcgcgaaagccgaagcctccatcaacctctacgccggcccgcagaccacatccgtcatcgcaaacatcgccgacaacctgcaactggccaaagactacggcaaagtacactggttcgcctccccgctcttctggctcctgaaccaactgcacaacatcatcggcaactggggctgggcgattatcgttttaaccatcatcgtcaaagccgtactgtatccattgaccaacgcctcttaccgctctatggcgaaaatgcgtgccgccgcacccaaactgcaagccatcaaagagaaatacggcgacgaccgtatggcgcaacaacaggcgatgatgcagctttacacagacgagaaaatcaacccgctgggcggctgcctgcctatgctgttgcaaatccccgtcttcatcggattgtattgggcattgttcgcctccgtagaattgcgccaggcaccttggctgggttggattaccgacctcagccgcgccgacccctactacatcctgcccatcattatggcggcaacgatgttcgcccaaacttatctgaacccgccgccgaccgacccgatgcaggcgaaaatgatgaaaatcatgccgttggttttctccgtcatgttcttcttcttccctgccggtctggtattgtactgggtagtcaacaacctcctgaccatcgcccagcaatggcacatcaaccgcagcatcgaaaaacaacgcgcccaaggcgaagtcgtttcctaa

SEQ ID NO: 5964 - DNA, 726 bp, Neisseria meningitidis
atgagtgagggaatgatgtctcctgttttgtatttgattcctacgcctttgggtacgcctgacacgccgtgcctgttgccgcatgaacaacaggcgattgtcgggctgacggattttgtcgtggaggcggaaaaaacggcgcgtgcgcatttgaaacatttgggcgtgactacgcctatccgcgagctgaatctgcaaacgttgaatgaacatacggatttgaagactttgccggaattgctgaaacctttgcaagaagggcgcagtatgggcattgtcagtgaggcgggttgcccggctgtggccgatccgggtgcgaatttggtggcattggcgcataaacacggttttgaagtgcgtccgctggtcgggccttccagcctgctgctggctttgatggcttcgggtgcgaacgggcagagttttgcgtttaaaggctatctgccgtctgaaaaaaacgagcggattcaggcttttcgggctttggaacagcgttcgcgccagtgcggcgagacgcagatttttattgaaacgccttaccgcaatgatgcgctgcttgccgatgcggtggaaaacctgcatcctgaaacgcgtttatgcacggctacggatttgaccttgccgacacaggaaatcatcagtcaaacaatcgtgcagtggcgaaaaagaaaagaaatgcccaatctgaaaaaacgcccgacgatttttgtgatgtatgcgggttga

SEQ ID NO: 5965 - DNA, 591 bp, Neisseria meningitidis
atgggtttggaactgcctttgattttgggtacgagttcggttttccgccgcgaacagatggaaaggctcggcattgcctttcaggcggcgtcccccgattttgacgaaacgccgatgttgggggaatccgcccctcagacggcattgcgccttgccgagggtaaggcgcggtcgttgaccgggcgtttcccagaggcgttgattgtcggtgcggaccaggtggcgtggtgcgacggcaggcagtggggcaagccgatgaaccttgccaatgcgcaaaagatgctgatgcacttgagcggcagggagattgagttttacagcgcgatcgtgctgttgaatacggttacgggcaggatgcggcggcatatcgataagacggtggtcgtgatgaggcagttggacgagttgcatatcctccgctatttggagcgcgagcctgatgcggtttattgttcgtgtgcgctgaagagtgaggatttgggtgcattgctgattgaaaggattgagagtaccgatccgaatgctttaatcggtttgccggttttccgtctggtcgatttcttgaaaaatgagggcgtggaggttctgtaa

SEQ ID NO: 5966 - DNA, 504 bp, Neisseria meningitidis
atgtcagaccctaatttgattgacttggaaatttttgccgccgaagggcagaacctgcaaggcagttttctgctggaagaattggatgaacgcgtcagttcgcacgattatcccgccgacaggcagaccaaaatatcgtttacactgaccggcggtcgcgaccggctgcaacgcctgttcctcgacctgaacgtcaaagccgatatgcccctgatttgccagagatgtatcaaacccatgccgttcatgcttgatgaaagcagccgtatcgtcctgttttccaacgaagagtccttggacgaatccatgcttgccgacgaagaactcgaaggcatactgattgaaaaagaactcgacgtgcgcacattggtagaagaccaaatcctgatgtccctgcccttttcgccgcgacacgaagactgcggcgacaatgggacactggaagaagtcaatcgggacaaacccaacccctttgctgttttggcaggtttgaaaagcaattga

SEQ ID NO: 5967 - DNA, 180 bp, Neisseria meningitidis
atggccgttcaacaaaacaaaaaatccccttccaaacgcggtatgcaccgttcgcacgacgcgctgaccgcgcctgcactgtctgtcgacagcacaaccggcgaagtacaccgcccgcaccacatctcccccaacggtatgtaccgcggccgcaaagtggtcaaagccaaaggcgaataa

SEQ ID NO: 5968 - DNA, 528 bp, Neisseria meningitidis
atgaaacagaaaatctggtacacctacgatgacatccaccgcgtcatcaaagcattggcagaaaaaatccggaacgccgacatcaaatacgatgccatgattgccatcggcggcggcggctttattccggcacgtatgctgcgctgttttctggaaattccgatttatgccgtaaccaccgcctattacgacagcgacaacgaaggacaggttaccgaagaagtcaaaaaagtccaatggctcgaccccgttcccgaagccctgcggggcaaaaacgtactcgtcgtcgatgaagtggacgacagccgcgtaaccatggagttctgcctgaaagaactgctcaaggaagacttcggtacgatcggagtcgccgtactgcacgaaaaaatcaaagccaaagcaggcaaaatccccgaaggcattccctatttcagcggcatcaccgtagaagactggtggatcaactatccgtgggacgcactcgacatcgacgaacacaaccgccttgccgaggccggccgaggctga

SEQ ID NO: 5969 - DNA, 1056 bp, Neisseria meningitidis
atgattacattggccgtagatgccatgggcggcgaccaaggacttgccgttaccgtacccggcgcaaccgcattcctccaagcacaccccgatgtccgcctgattatgaccggcgacgaaacgcaactgcgccaagccctgaccgcggcaggcgcaccgatggaacgcatcgacatctgccataccacccaagtcgtcggcatggacgaagccccgcaatccgccctgaaaaacaaaaaagactcctccatgcgcgtcgccatcaaccaggttaaagaaggcaaagcccaagccgccgtatccgcaggcaacacgggtgcgctcatggcaaccgcacgtttcgtcctcaaaaccattcccggcatcgaacgccccgccatcgccaaattccttccttccgacaccgaccacgttacccttgcactcgaccttggcgcgaacgtcgactgcacgtccgaacagctcgcccaatttgccgttatcggcagcgaactcgtccacgcactccatcctcaaaaaggacagccgcgcgtcgggctggtcaacgtcggcacggaagacatcaaaggtacggacaccgtcaaacaaacctacaaactgctgcaaaacagcaaactcaactttatcggcaacatcgaaagcaacggcatcctctacggcgaagcagatgtcgtcgtcgccgacggctttgtcggcaacgtcatgctcaaaaccatcgaaggcgcggtcaaattcatgagcggagccatccgccgcgaattccaaagcaacctgttcaacaaacttgccgccgttgccgccctacccgccctcaaagggctgaaaaacaaactcgacccgcgcaaattcaacggggccatcctgctcgggctgcgcggcatcgtgattaaaagccacggcggcacagacgaaaccggtttccgctatgccctcgaagaagcctaccacgaagccaagtccgccggcctttccaaaatcgaacagggcgtagccgaacaactcgccgcactcgaaactgccaaagccgtccaaaacgaaaatgtcggcggtctgtaa

SEQ ID NO: 5970 - DNA, 252 bp, Neisseria meningitidis
atgaagacattagaaaaacggatgaaagctctagacaaacggattatgaagttcggaaaatcccttgaaggcaggcttgatgcccgtctgattgaatccgcattggattatattcattattcggaacgttttttggcttttgaaatcctgtgtacttatatcgaagatttcgatgtccggctgacggaacaagaatcccgggaaatttcttttatcaacaaggaatttgagatagaaagcacgtccgattaa

SEQ ID NO: 5971 - DNA, 390 bp, Neisseria meningitidis
atgaaaacatcgacggtcgtttttggcggattttttatggcagacaacggagagcgaatccaaatccccgttttggaaaatcctgacattagggaaatcaatcactttttttccgtatcaaattttgagaaaaaaaccggcgtccttgttttcagaatcatccccgagccggaatttggcaataccgaattaactgtctattttaaaaaaggatattatagtggattaacaaaaaccagtacggcgttgcctcgccttgccgtactggtttttgttaatccactatatcagacgaaaacaaacacccgcgccaatagcctgacggcaacccggcaatcaaaatgccgtctgaagcagcttgggctttcagacggcatttccttcgcttaa

SEQ ID NO: 5972 - DNA, 963 bp, Neisseria meningitidis
atgcagtatgcaaaaatttccggcacaggcagctatcttcccgccaaccgcgtcagcaatgacgaccttgcccaaaaggtagatacctctgacgagtggattaccgcgcgcacgggcatcaaattccgccatattgcagccgaaaacgaaaaaaccagcgatcttgccgccgaagcggcgcaccgcgcgctggatgcagccggattagacagcggcgaaatcgatttgattatcgtggcaacggcaacgccggatatgcagtttccgtctactgcgaccatcgtgcaacaaaaattgggcatcaccaacggctgccccgcgtttgacgtacaggcggtgtgcgccggctttatgtacgcgctgaccacggcaaacgcctacattaaaagcggtatggcgaaaaacgcgctggtcatcggcgcggaaaccttcagccgcattgtagactggaacgaccgcacaacctgcgtattgttcggcgacggcgcgggcgcggtggttttaagcgcgtcggacacgccgggcatcatccacagcaaactcaaggccgacggcaattatctgaaactcttaaacgtccccgggcaaatcgcctgcggcaaagtttccggttcgccgtacatttcgatggacggtcccggcgtgttcaagtttgccgtcaaaatgctgtccaaaatcgccgatgacgttatcgaagaagcaggttacaccgccgctcaaatcgactggattgttccccatcaggcaaaccgccgcattatcgaatcgaccgcgaaacatttaggtttgagtatggacaaagtcgtcctgaccgtccaagaccacggcaacacatccgccgcatcgattccgctggctttggatacgggcatccgcagcggacaaatcaaacgcggtcaaaacctgctgctcgaaggcatcggcggcggtttcgcgtggggcgcggtgctgttgcaatattga

SEQ ID NO: 5973 - DNA, 408 bp, Neisseria meningitidis
atgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggtgcgccatacgggggcaacgccgcattcccgaacaccgcctgctgctgcctgcattgctcggcggctgggtgggcgcgtatttcggcagcatgacattcaaacataagacagcgaaaaagcgttttgttgtgctgttccgtctgactgtttcaggtaatgtcttggcgaccctcatcctgatttatagtggattaaatttaaaccagtacggcgttgcctcgccttgccgtactatttgtactgtctgcggcttcgtcgccttgtcctga

SEQ ID NO: 5974 - DNA, 927 bp, Neisseria meningitidis
atgtcttttgccttcttttttcccggacaaggttcccaaagcctcggtatgatgaacggctttgccgaacacgccatcgtcaaaaacacctttgccgaagcctccgccatattggggcaggacttgtgggcgatgataaacggcagcgatgccgaaatcatcggtcaaaccgtcaacacccagcccattatgctcgccgccggcgttgccgtttaccgcgcctatttagaagcgggcggcaaaacgcctgccgccgttgccggacacagcctcggcgaatacaccgcactcgttgccgccggcgcattgaattttgccgacgcggtcaaactcgtgcgcctgcgcgccgaactgatgcagtccgccgtaccgcaaggcgtgggcgcaatggcggcgattctcggcttggaagatgagcaggttaaagccatttgtgccgaagccgcccaaagcgaagtggtcgaagccgtcaacttcaactcacccggacaaatcgtgattgcaggcaacgccgccgccgtcggacgcgccatggctgccgccaaagaagccggtgccaaacgcgccctgccgctgcccgtgtccgtaccttcccattgcagcctgatgaaacccgccgccgacaaacttgccgaagccctgaaaaccgttgaaatcaagcagccgcaaatccgcgttatccacaacgccgacgttgccgcctacgatgatgccgacaaaatcaaagacgcgctcgtccgccagctttacagccccgtacgctggacggaaaccgtcaacgccctcgtttcagacggcattgccgaatccgccgaatgcggcccgggcaaagtgttggcgggcttggcaaaacgcatcaacaaagccgccgcgtgcagcgcactgaccgatgccggacaggttgccgcctttatcgaagcgcactga

SEQ ID NO: 5975 - DNA, 1866 bp, Neisseria meningitidis
atgatagaaaaactgactttcggactgtttaaaaaagaagacgcgcgcagctttatgcgcctgatggcgtacgtccgcccctacaaaatccgcatcgttgccgccctgattgccattttcggcgttgccgccaccgaaagctaccttgccgccttcatcgcccccctgattaaccacggcttttccgcacctgccgcgccgcccgagctgtctgccgccgccggcatcatttccaccctgcaaaactggcgcgaacagtttacctatatggtttgggggacggaaaacaaaatctggaccgtcccgctcttcctcatcatcctcgtcgtcatccgtggcatctgccgctttaccagcacctatctgatgacttgggtctccgtgatgaccatcagcaaaatccgcaaagatatgtttgccaaaatgctgaccctttcctcccgctaccatcaggaaacgccgtccggcaccgtactgatgaatatgctcaacctgaccgaacagtcggtcagcaacgccagcgacatcttcaccgtcctcacgcgcgacacgatgatcgttaccggcctgaccatcgtcctgctttacctcaactggcagctcagcctcatcgtcgtcctgatgttccccctgctctccctgctctcgcgctactaccgcgaccgtctgaaacacgtcatttccgactcgcaaaaaagcataggcacgatgaacaacgtgattgccgaaacccatcagggacaccgcgtcgtcaagctgttcaacgggcaggcgcaggcggcaaaccggttcgacgcggtcaaccgcaccatcgtccgcctcagcaaaaaaatcacgcaggcaacggcggcacattccccgttcagcgaactgatcgcctcgatcgccctcgccgtcgtcatcttcatcgccctgtggcaaagccaaaacggctacaccaccatcggcgaatttatggcattcatcgtcgcgatgctgcaaatgtacgcccccatcaaaagccttgccaacatcagcatccctatgcagacgatgttcctcgccgccgacggtgtatgtgcatttctcgacaccccgcccgaacaggacaagggcacgctcgcaccgcagcgtgtcgaagggcgcatcagcttccgcaacgtcgatgtcgaataccgttcagacggcatcaaagccctcgacaacttcaacctcgacatcagacaaggcgaacgcgtcgccctggtcggacgttccggcagcggcaaatccaccgtcgtcaacctgctgccccgctttgtcgaaccgtctgccggcaacatctgcatagacggtatcgacatcgccgacatcaaactcgactgcctgcgcgcccaattcgccctcgtctcccaagacgtattcctgtttgacgacaccctgtttgaaaacgtccgatacagccgtcccgacgcgggcgaagccgaagtcctgttcgccctccaaaccgccaacctgcaaagcctgattgacagctccccgctcggactgcaccagcccatcggatcgaacggcagcaacttatccggcggacagcggcaacgcgtcgccattgcccgcgccattttgaaagacgcgccgatattattattggacgaagccaccagcgcattagacaacgaatccgaacgcctcgtccaacaggcgctcgaacgcctgatggaaaaccgcaccggcatcatcgtcgcccaccgcctgaccaccatcgaaggggccgaccgcatcatcgtgatggacgacggcaaaatcatcgaacaaggcacacacgaacaactgatgtcccaaaacggttactacacgatgttacgcaatatctcaaacaaagatgccgccgtccggacggcataa

SEQ ID NO: 5976 - DNA, 1566 bp, Neisseria meningitidis
atgacccaagacaaaatcctcatccttgacttcggttcgcaagttacccagctcatcgcccgccgcgtgcgcgaagcccacgtttactgcgagctgcattctttcgatatgcctttggacgaaatcaaagccttcaaccccaaaggcatcatcctctccggcggccccaattccgtttacgaatccgactatcaagccgataccggtatttttgatttgggcattccggttttgggcatctgttacggcatgcagtttatggcgcaccacttgggcggcgaagtgcagcccggcaaccagcgcgaattcggttatgcgcaagttaaaaccatagacagcgagctgacacgcggcattcaagatggtgagccaaacacactcgacgtatggatgagccacggcgacaaagtgtccaaactgcccgacggtttcgccgtcatcggcaacaccccgtcctgcccgattgccatgatggaaaacgccgaaaaacaattctacggcatccagttccaccccgaagttacccacaccaaacaaggccgcgccctgttgaaccgctttgtcttggatatttgcggcgcacaaccgggctggacgatgccgaactacatcgaagaagccgttgccaaaatccgcgaacaggtcggcagcgacgaagtgattttaggtctgtccggcggcgtggactcttccgtagccgccgcgctgattcaccgcgccatcggcgaccaactgacctgcgtgttcgtcgatcacggtttgttgcgcctgaacgaaagcaaaatggtgatggatatgttcgcccgcaacttgggtgtgaaagtgatacacgtcgatgccgaagggcagtttatggcgaaactcgccggcgtaaccgaccccgagaaaaaacgcaaaatcatcggtgcggaatttatcgaagtatttgatgccgaagaaaaaaaacttaccaacgccaaatggttggcacaaggcacgatttaccctgacgtaatcgaatccgcaggtgcaaaaaccaaaaaagcccacgccatcaaatcgcaccacaacgtcggcggcctgcctgaaaacatgaagctcaaattgcttgagcctttgcgcgatttgttcaaagacgaagtacgcgaattgggtgtggctttgggcctgccgcgcgaaatggtgtaccgtcatccgttcccgggtccgggtttgggcgtgcgtattttgggcgaagtgaaaaaagaatatgccgacctgcttcgtcaggcagacgatattttcattcaagaattgcgcaatactaccgatgaaaacggtacatcttggtacgacctgaccagccaggcattcgccgtgttcctgcccgtcaaatctgtcggcgtaatgggcgacggccgcacatacgattacgtcattgccttgcgtgccgtgattaccagcgactttatgaccgcgcattgggcggaactgccgtattccttgttgggcaaagtgtccaaccgcatcatcaacgaagtcaaaggcatcaaccgcgtggtttatgatgtgagcggcaaaccgcctgccaccatcgagtgggaataa

SEQ ID NO: 5977 - DNA, 747 bp, Neisseria meningitidis
atgagcacacaagatttaaacggcaaaatcgctttggtaacaggcgcatcgcgcggtatcggtgcagcaattgccgacacgctggcggcagccggtgccaaagtcatcggtacggcgaccagtgagagcggtgcggcggcgattagcgagcggttggcgcaatggggcggcgaaggccgcgtattaaattccgccgaacctgaaaccatcgaaagcctgattgccgacatcgaaaaagcgttcggcaaactcgatattctggtcaacaacgccggcatcacccgcgacaacctcctgatgcgcatgaaagaagaagagtgggacgacatcatgcaggtcaacctcaaatccgtgttccgcgcttctaaagccgttttgcgcggtatgatgaaacaacgttccggccgcatcatcaacatcacatccgtcgtcggcgtgatgggcaatgccggtcaaaccaactatgccgcggcaaaagcaggcttaatcggtttctccaaatccatggcgcgcgaagtcggcagccggggcattaccgtcaactgcgtcgcccctggctttatcgataccgacatgacacgcgccctgccggaagaaacccgccaaacctttaccgcccaaaccgccttgggcagattcggcgacgcgcaagacatcgccgatgcggttctgttcctcgcttccgaccaagcaaaatacatcaccggccaaacgctgcacgtcaacggcggtatgctgatgccttaa

SEQ ID NO: 5978 - DNA, 159 bp, Neisseria meningitidis
gtggtcgaacagagcttcggtacgctgcaccataaattccgctacgcccgggcagcctatttcggactgattaaagtgagtgcgcaaagccatctgaaggcgatgtgtttgaaccttttgaaagccgccaacaggctaagtgcgcccgctgccgcctaa

SEQ ID NO: 5979 - DNA, 384 bp, Neisseria meningitidis
ttgtactgtcttcggcttcgtcgccttgtcctgatttttgttaatccactatacatcatcgctactaccgttccggcgcaacaggcattcctcgatgccgccgaactgatgcaatggagtatagaaaccgaagggctgggcttgaacgtcatctcgcacaagatactcggcaaagaccacgcccaagtcgaatttgaagcctacttccgagacggacaacaccgatccgcgcatcacgaactgtccggcttcgtcaacatcggcggacaatggtattttatcgatcccaccgttccgcatcctgcgatgaaacaaccctgcatttgcggatcaggcaaaaaattcaaagcctgctgcggcaaatatctgaaacctgtcgcataa

SEQ ID NO: 5980 - DNA, 696 bp, Neisseria meningitidis
atgttgagcgaggcggacattgccgcgcagacggcttttgccgccgcgttgccgcttttaatcgacagtccgatgttgggtgaggaaatgtcgcggcaggaacagtcggctttgtgggaacaatattcgggggaaaaggggctgtggattgtcgatccgatagacgggacgaacaattttgtcaacgggctgccgcattttgcggtatcggtggcgtttgtccgcaacgggcgcgccgagttgggcgtaatctacaacccagtcagcggcgaatgtttttatgccgaacgcgggcagggggcgtttttaaacgggacgcgtctgcccctgcgcctcgtggataaaaaactcaatgaggcgattgcgggcgtggaaatcaaatatctgcgttcgggcaaactttccagccgtatgagtacgctcgcgccttttggaacgatacggagtatgggcagcagtacgttggattggtgttatctggcgtgcgggcgttatgatgtttatgttcacggcgggcagaagctgtgggattatgccgccggcgcgttgattttcgaggaggcgggcggcaggctgacgactttggaaggcgacgggttttggagtggtgaacacgtgttcaaacgctcggtcgttgccgcgctcgaaccgaagctgtttgaacgctgggtcgggtggatacgggaaaaccaatag

SEQ ID NO: 5981 - DNA, 726 bp, Neisseria meningitidis
atgccccgattccacctgcccgaaaacctttccgtcggacaaaccgtcgccctgcccgacaacatcgtccgccacctcaacgtcctgcgcgtccgccccaacgaaaacatcaccctcttcgacggcaaaggcaaggcacacgccgcacggctgaccgttttggaaaaacgccgcgccgaagccgaaatcctgcacgaagacacaaccgacaacgagtccccgctcaacatcacactgatacaatccatctcctccggcgatcgcatggatttcaccctgcaaaaaagcgtcgaactcggcgtaaccgccatacagcccgtcatcagcgaacgctgcatcgtccgcctcgatggggaacgcgccgccaaacgcctcgcacgctggcaggaaatcgtcatctccgcgtgcgaacaaagcggcaggaacaccgttccccccgtactgcccatcatcggctaccgtgaagcactcgacaaaatgccgtctgaaagcaccaagctgattatgagcatcaaccgcgcccgcaaactcggcgacatacgccaaccgtccggcgcaatcgtctttatggtcgggcccgaaggcggctggacagaacaggaagaacaacaggcatttgaagctggctttcaggcggttacactcggcaaacggattttacgcacagaaaccgccccactcgccgccctcgccgccatgcagacgctttggggcgatttcgcataa

SEQ ID NO: 5982 - DNA, 843 bp, Neisseria meningitidis
atgcaaaaccatgttatcagcttagcttccgccgcagaacgcagggcgcacattgccgcaaccttcggcgtgcgcggcatcccgtttcagtttttcgacgcactgatgccgtctgaagaactgaatcggatgatggcggaattggtgccgggattggcaaaacagcacctgttgagcgaagtggaaaaagcctgctttatgagccacgccgtattgtggaaacaggcattggatgaaggtctgccctatgttgccgtatttgaggatgatgtcctgcttggcaaagacgcagaaaagttccttgccgaagatacttggttggaagagcgttttgataaggattctgcctttatcgttcgtttggaaacgatgtttgcgaaagttattgtcagaccggataaagtcctgaattatgagaatcggtcatttcctttgctggagagcgaacattgggggacggctggctatatcatttcgcgtgaggcgatgcggtttttcttggaaaggtttgccgttttgccggcagagtggattaaagcggtagattggatgatgtttacttatttctttgataaggaggggatgcctgtttatcaggttaatcccgccttatgtacccaagaattgcattatgccaagttcctcagtaaaaacagtatgttgggtagcgatttggaaaaagatagggaacaagaaagaagacaccgccgttcgttgaaggtgatgtttgacttgaagcgtgctttgggtaaattcggtagggaaaagaagaaaagaatggagcgtcaaaggcaggcggagcttgagaaagcttacggcaggcgggtcatatcgttcaaatag

SEQ ID NO: 5983 - DNA, 96 bp, Neisseria meningitidis
atggacatcgtatttgcagcagacggcaggatgcggcggctgtttaccttgaggcaatacttcggcattttgcgccgattgctgaaaaaccgttga

SEQ ID NO: 5984 - DNA, 828 bp, Neisseria meningitidis
atgcaaaaccacgttatcagcttagcttccgccgcagaacgcagggcgcacattgccgataccttcggcaggcacggcatcccgtttcagtttttcgacgcactgatgccgtctgaaaggctggaacaggcaatggcggaactcgtccccggcttgtcggcgcacccctatttgagcggagtggaaaaagcctgctttatgagccacgccgtattgtggaagcaggcattggacgaaggtctgccgtatatcaccgtatttgaggacgacgttttactcggcgaaggtgcggaaaaattccttgccgaagacgcttggctgcaagaacgctttgacccggataccgcctttatcgtccgcttggaaacgatgtttatgcacgtcctgacctcgccctccggcgtggcggattactgcgggcgcgcctttccgctgttggaaagcgaacactgggggacggcgggctatatcatttcccgaaaagcgatgcggtttttcctggacaggtttgccgccctgccgcccgaagggctgcaccccgtcgatctgatgatgttcagcgattttttcgacagggaaggaatgccggtttgccagctcaatcccgccttgtgcgcccaagagctgcattatgccaagtttcacgaccaaaacagcgcattgggcagcctgatcgaacacgaccgcctcctgaaccgcaaacagcaaaggcgcgattcccccgccaacacattcaaacaccgcctgatccgcgccttgaccaaaatcagcagggaaagggaaaaacgccggcaaaggcgcgaacagttcattgtgcctttccaataa

SEQ ID NO: 5985 - DNA, 1050 bp, Neisseria meningitidis
atgccgtctgaagccttcagacggcatcgtgcctatcgggagaataaattgcagcctttagtcagcgtattgatttgcgcctacaacgtagaaaaatatttcgcccaatcattagccgccgtcgtgaatcaaacttggcgcaacttggatattttgattgtcgatgacggctcgacggacggtacgcttgccattgcccagcgtttccaagaacaggacggccgcatccgcatcctcgcgcagccgcgcaattccggtctgattccctctttaaacatcgggctggatgaattggcaaagtcggggggggggggggaatatattgcgcgcaccgatgcagacgatattgccgcccccgactggattgagaaaatcgtgggtgagatggaaaaagaccgcagcatcatcgcgatgggtgcgtggctggaagttttgtcggaagaaaaggacggcaaccggctggcgcggcaccacgaacacggcaaaatttggaaaaaaccgacccgacacgaagacattgccgactttttccctttcggcaaccccatacacaacaacacgatgattatgaggcgcagcgtcattgacggcggtttgcgttacaacaccgagcgggattgggcggaagattaccaattttggtacgatgtcagcaaattgggcaggctggcttattatcccgaagccttggtcaaataccgccttcacgccaatcaggtttcatccaaatacagcatccgccaacacgaaatcgcgcaaggcatccaaaaaaccgccagaaacgattttttgcagtctatgggttttaaaacccggttcgacagccttgaataccgccaaataaaagcagtagcgtatgaattgctggagaaacatttgccggaagaagattttgaacgcgcccgccggtttttgtaccaatgcttcaaacggacggacacgctgcccgccggcgcgtggctggattttgcggcagacggcaggatgcggcggctgtttaccttgaggcaatacttcggcattttgcaccgattgctgaaaaaccgttga

SEQ ID NO: 5986 - DNA, 2064 bp, Neisseria meningitidis
atgatgacccaaacccttttaatcgaactccttaccgaagaactcccgcccaaagccctgaataatctgggcaaccatttcgccgcttccgttgccgaaggcttggaaaaagcgcaactggttgacggcgcagccgaatttacggcttatgcctcgccgcgccgtttggcggttcaagtcaaaaacgtcaaagccgttcaggctgatcaaaaaattgtgaaaaaaggccctgccgtagcgaatgccatgaaagacggtgcgccaaccaaggctttggaaggtttcgcacgcggtgcgggcgcgaaaatcgaagacttgaccatcgtccacgacggcaagcaggacgtgtacgcctacgaatacgtccaaatcggcaaaccgttgggcggacttttggaagacattatcaatcaagcggttaagaagctgccgattcccaaagtaatgcgttggggcagcagcacgtttacctttgtgcgccccgttcacgggctagttgtactgcacggcggcgacattgtgaacgtcagcgttttgggtctgcaaagcggcaacaaaaccttgggacaccgcttcctctccgacggcgaaattaccattgaaaacgccgacagctacgccgcacaaatgcgcgagcaaggcaaagtcgtcgcttcgtttgccgagcgcaaagccgcgattcagacggtattggaagggcaggcacgccgtctgaacgcgaccgccgccgccgatgaagccttgttggacgaagtaaccgcgctggtcgaatggcctgtggtattggaagccggttttgaagaacacttcctcgccgtaccgcaagaatgcctgattctgacgatgcagcaaaaccaaaaatacttcccgctgctcgaccaaaacggcaagctgatgaaccgcttcctgctggtgtccaatctgcaaaccgaagatccgtcacacatcatccaaggcaatgaacgtgtcttgcgcgcgcgcctgtctgatgccgagttcttctacaaacaagaccaaaaagcgactttggaaagccgcctgcccaaactgacgaacgtggtttatcacaacaaaatcggttcgcaagccgaacgcatcgaacgcctgcaaagcatcgccgcccatatcgccaaggctttgggcgcggatgccgccgcagccgaacgcgccgcgcgtttggcaaaagccgacttagtaaccgaaatggtcggcgagttccccgaactgcaaggcacgatgggcaaatactacgcccgcttggacggcgaaaccgaagaaattaccgaagccgtcgagcaacactaccaaccgcgttttgccggcgacaacctgcctgagggcaaaattgccgccgccgttgcgcttgccgacaaactggaaaccttggtcggcatttggggtatcggcctgattccgaccggcgacaaagacccatacgccctgcgccgcgccgcattgggtattttgcgtatgctgatgcagtacggtttggacgtaaacgaactgattcagacggccttcaacagcttcccgcaaggtttgctcaacgaaaaaacgccgtctgaaaccgccgacttcatgcaggcgcgccttgccgtattgctgcaaaacgattatccgcaagacatcgttgccgccgtacttgccaagcagccgcgccgtttggacgatttgaccgccaaactgcaggctgtcgccgcgttcaaacaactgcccgaagccgccgcgctcgccgctgccaacaaacgcgtgcaaaacctgctgaaaaaagccgatgccgagttgggcgcggttaacgaaagcttgctgcaacaggacgaagaaaaagccctctttgccgccgcacaaggcttgcagccgaaaattgccgccgccgttgccgaaggcaatttccagaccgccttgtccgaactggcttccgtcaaaccgcaagtcgatgccttcttcgacggcgtgatggtgatggcggaagatgccgccgtgaaacaaaaccgcctgaacctgctgaaccgcttggcagaacaaatgaacgcggtagcggatatcgcgcttttgggcgagtaa

SEQ ID NO: 5987 - DNA, 348 bp, Neisseria meningitidis
atgcctgtctatttccgcaccccaagcaggaaacgcctgcacaaaatgaaccgccgccagcataaaaagctgcatttgggcgagtttcaaacattgattttcggcgttcaaggcagtttgcaccaagctgaggacgatgccgaagcgttcgaccgctttatggacgagctgattgcgtatcttgcggcaaacggctttgaaatggcgggggggcgattgcggcgatttttcgtgcctgtttcaaaaatccggtgcccgaagcttgggagaaaccgagaaaaaagccattatctcttggctggcagaccgcgaagatgttgccactttgtacgccaccccgctggttga

SEQ ID NO: 5988 - DNA, 906 bp, Neisseria meningitidis
atgcttaccttccaacaaatcatcttcaaactgcaaacattctgggcagacaaaggctgcaccgtcatccaacccttcgacatggaagtcggtgccggcacatcccatcccgccacctgcctgcgcgcactcggccccgagccttggtttgccgcctacgtccaacccagccgccgccccaaagacggccgctacggcgacaaccccaaccgcctgcaacactattaccaattccaagtcgccctcaagcccgctcccgccaatatccaagacctctatctcgactctctgcgcgaattgggcatcgatcccaaagtccacgacatccgctttgtcgaagacgactgggaaaaccccaccctcggcgcgtggggtttgggctgggaagtctggctcaacggcatggaagtaacccagtttacctatttccaacaagtcggcggcatcgactgcacgcccgtactcggcgaaatcacctacggcatcgaacgcttggcgatgtacttgcaaggtgtagaaaacgtctacgacctcgtttgggcaaaaacgctcgacggcaacaccgtcacctacggcgacgtgtaccaccaaaacgaagtcgagcaatccacctacaacttcgaatacagcgatgccgactggctgctgcgccagttcaacgactacgaagcgcaagccaaacgcctgcttgccgaagaaaacgccgccctcgccctgcctgcctacgagcttgtcctcaaagcggggcatacgttcaaccttttagacgcacgcggcgcgatttccgtaactgagcgggcaacttatattggacgtattcgtgcattgagccgcgccgtggcgcaaaaatatgttgaaagccgcgaaaaactgggcttccctttaatgaaggcaaacgccgcctaa

SEQ ID NO: 5989 - DNA, 423 bp, Neisseria meningitidis
atgagcatcatgcaagttgaggtggtaagtagcgagcagaaaatctattcaggcgaggcaacatttatcgttgttccgactgtacagggcgaactcggtatttatccgcgacacgagccgattatgagtttggtgcggccgggggctttgcgtttgaccgttccgggcgaggataaagaggttttggttgctgtttccggcggtgttttggaagtacagcctgataaagtaactgtcttggcggatgttgccgtccgcagtgcggagatggatcgggcacgtgcggaagaggcgaaaaaagccgcagaagcgggcatttcccaagctaaagacgataaggctttggcggaagcgcataaagtattggctgctgcgattgcacagctcaaaactttggactatatccgttcgcacaagaaataa

SEQ ID NO: 5990 - DNA, 1398 bp, Neisseria meningitidis
atgagccaaggcaaaatcgtacaaattatcggtgcggttgttgacgtggaatttccacgcgacatgattccgcgcgtttacgacgctttgaaattagacgaaaacggtctgactttggaagtccaacagcttttgggcgacggcgtagtccgtgccattgcgatgggcagctcggacggtttgaaacgcggcatgactgtgagcaataccggtgcgcccattactgtgccggtaggtaaaggtacgttgggacgcattgtcgatgtattgggaacgcctgttgacgaagcaggtccgatcgataccgacaagagccgtgccatccaccaagctgcccctaagtttgacgaactgtcttccacaaccgaattgctcgaaacgggcattaaagtgattgacttgctgtgtccgtttgccaaaggcggtaaagtaggtctgttcggcggtgccggtgtgggtaaaaccgtgaacatgatggaattgatcaacaacatcgccaaagcgcacagcggcttgtccgtgttcgcaggcgtgggtgagcgtacccgcgaaggtaacgacttctaccacgagatgaaagattccaacgtattggataaagtggcaatggtttacggtcagatgaacgaacctccgggcaaccgtttgcgcgtcgcattgaccggtttgaccatggcggaatacttccgtgacgaaaaagacgaaaacggcaaaggccgcgacgtattgttcttcgtggacaacatctaccgttacaccctggctggtaccgaagtatccgcattgttgggtcgtatgccgtctgcagtgggctaccaaccgacattggcagaagaaatgggtcgtttgcaggagcgtattacctctacccaaaccggttctattacttccatccaagccgtatatgtacctgcggacgacttgaccgacccgtctccggcaacaacgttcgcccacttggacgcaaccgtcgtattgagccgcgatattgcctctttgggtatttacccggcagtcgatccgcttgattctacttcgcgccaactggatccgatggtattgggtcaagagcactacgacgtggcgcgcggtgtgcagtccaccctgcaaaaatacaaagaattgcgcgacatcatcgccatcttgggtatggacgaattgtctgatgaagacaaactgaccgtaatgcgtgcgcgtaaaatccaacgcttcctgtcccaaccgttccacgttgccgaagtgtttacaggttctccgggtaaatatgtcgccctgcgcgataccattgccggcttcaaagccatcttgaacggcgaatacgatcatctgcccgagcaggcattctatatggtcggcagcattgaagaagcagtagagaaagcgaaaaccttaaactaa

SEQ ID NO: 5991 - DNA, 876 bp, Neisseria meningitidis
atggcagtaggaaaagagattctcaccaaaatccgcagtgttcagaatacccaaaagatcactaaagcgatgcagatggtgtcaacctctaaaatgcggaagactcaggaacggatgcgtttggcgcgtccgtatgccgaaaaagtgcgtatggtgatgagccatcttgcgcaaaccaataccgatcatggtattccgttactggaatctcatcgggaaatcagacgtgtcggttttattttgattacgtctgataagggtttgtgtggcggtttgaacgccaacgtgctgaaaaagtttttggcacaagttcaagagtatcggaatcaaggtattgaagaggaaatcgtatgctttggcagtaaaggtctgatggcgtgtcagagcattggtctgaatgtggttgccagtgccgtaaatttgggcgataccccaaaaatggaaatgctgctcggacctttgacagaactcttccaacggtatgagaaacatgaaattgacagaatccatctggtgtattcgggttttgtcaataccatgcgtcaagaaccgagaatggaagtattgctgcctatcggtgagaacgtgattggcgattcagctcccaaatcaccgttcagctgggaataccgctacgaaccgactgcacttgcagtgttggaatatctggttcgccgctatttagagtctgtggtttatcaggcgttgagcgacaatatggcatccgaacaggcagcccgcatggttgccatgaaagctgcaacagacaatgcaggcaatgccatcaaagagttgcgtttggtatataacaaatcgcgtcaagctgcgattaccacggaattgtcagaaattgtagcaggtgcggcggctgtctga

SEQ ID NO: 5992 - DNA, 1548 bp, Neisseria meningitidis
atgcagcttaatcctgctgaaattagcgatttgattaaagccaagatcgaaaatctgtctgtaaatgccgaagtgcgtacctgtggtacggtaatttcggtaactgacggtatcgttcgcatccatggtttgtcagatgcaatgcaaggtgagatgctcgaattcccgggtaacactttcggcttggcgatgaacctggagcgcgactccgtcggcgccgtagtgttgggcgagtacgaacacattaaagaaggcgacacggttacctgtaccggtcgtatcttggaagtgccggtcggacgcgaactggtcggacgcgtcgttgatgcattgggtcggcctatcgacggcaaaggcccgattaatacaactttgaccgcccctatcgaaaaaatcgcaccgggcgtgattgcgcgcaaatcggttgaccagccgatgcaaaccggtctgaaggcgattgactctatggttcctgtcggtcgcggtcagcgtgagttgattattggcgaccgtcagacaggtaaaacggccgtagcattggatgccatcgtcaaccaaaaaggtacgggtgttatctgtatctatgtcgctatcggtcaaaaagcatcttctattgccaacgtggtccgcaaattggaagagcatggcgcgatggagcataccatcgtggttgctgcaactgcatctgaagcggcggcattgcaatatatcgcaccttactccggttgtacgatgggtgaattcttccgcgatcgtggcgaagatgccttgattgtttatgacgatttgtccaaacaggctgtggcttaccgtcaaatttccctgcttttgcgccgtccgcccggccgcgaagcctatcccggcgatgtgttctacctgcactcccgtctgttggaacgtgcggcacgtgtcaatgaacacgaagtggagaaattgaccaacggcgaagtaaaaggcaaaaccggttctctgaccgcgttgccgattatcgaaacccaagcgggcgacgtatctgctttcgttccgactaacgtcatttcgattaccgacggtcagattttcttggaaaccgacctcttcaacgccggtatccgtcctgcaatcaatgccggtatttccgtatcccgcgtaggcggtgctgcacaaaccaaagtgattaaaaagctgggtggcggtatccgtttggcgttggcacaatatcgtgaattggcggcgttctcgcaatttgcatccgatttggatgaagctacgcgcaaacaattggagcatggcgaagtcgtaaccgaactgatgaaacagaaacagttcagtacgttgaatacggctgaaatggctttgaccctttgggcaatcaacaacggttcgtattctgatgttccggttgccaaagctctggcttttgaatctgaatttttgagctttgtccgtacccaacatccggaagttttggaagccgtcaatgcttcaggtgcaatgtccgacgagagcgagaaaacgcttgaagcagccatgaaatccttcaaatcttcttacgcctatcaggcataa

SEQ ID NO: 5993 - DNA, 534 bp, Neisseria meningitidis
atggcagagttcgcaacgattgccagaccttatgcaaaggcattgttcggtctggctcaggaaaaaaaccaaattgagtcttggttgggcggactggaaaaacttgcggcggttgttcaggaagggaaggtggcttcattgattgaccgtcctgaaacgaatgcttcagaaaaagcagatatcctcatcgatttggtcggtttgaaagacaaggagttgaaaaactttgttatcgtcttggccgggcagaaacgtttgtcgatattgccggaagtatatgctcaatatcaagacttgaccttatcattcaaccatatcaaatctgccgtcatttacagtgcctatccgttgaccgacaaacaggtcggcgagttggtgcaaatgctgaataagcgtttcgacagcgagctgaaaatctctgtcgaaatcgaaccggagctgattggcggcataaaagttgaagtgggtgatcaggttttggatttgtctgtacaaggcaaattgagtgccttgtacacgactatgacgaattag

SEQ ID NO: 5994 - DNA, 471 bp, Neisseria meningitidis
gtgaatatcaatgcaacattattcgctcaaatcatcgtctttttcggtttggtatggtttaccatgaaattcgtgtggccgccgattgcaaaagctttggatgagcgtgccgcaaaagtcgccgaaggcttggctgccgccgagcgtggtaaaagcgattttgagcaggctgaaaaaaaggttgcagaactcttggcagaagggcgtaatcaggtttccgaaatggttgccaacgccgaaaaacgtgccgccaaaattgtcgaagaagccaaagaacaggcttcttccgaggcggcgcgcattgcagctcaggcaaaggccgatgtggagcaggaattgttccgcgcacgcgaatccctgcgcgagcaggttgccgtgttggctgtcaaaggtgccgaatctattttgcgcagcgaagtcgatgcttccaaacacgcaaaactgctcgataccctgaaacaggagctgtaa

SEQ ID NO: 5995 - DNA, 237 bp, Neisseria meningitidis
atgggtttgattgctatcgcatgtggtttgatcgttgcattgggtgcattgggtgcctctatcggtatcgcaatggtcggttctaaatatttggagtcttctgcccgtcagcccgaactgatcggtccgctgcaaaccaaactgttcctgattgccggtttgattgatgccgcattcttgattggtgtcgccattgcactgctgttcgccttcgttaacccgtttgcaggtgcataa

SEQ ID NO: 5996 - DNA, 867 bp, Neisseria meningitidis
atggcaggtgaaaccattaccgctgccgactacatcaagcaccacttgcagagcttgaccagtttgtcggatgttactcagggtcagggactgaaaaacattgctgatttttcgtttattaaccttgatgccgtcttttttgccgtcctgttgggcgtaatcggcagctttctgttgtggcgcggtgcaaaaaaagcgacggcaggcgttcccggacgtttccaggccgcagtggaaatcttgtttgagtttgtggacgatatgtgtaagagcatcattcacaacgaaaagtctagaaaagccgtcgcgccgttgggtctgacgctgtttgtctggatttttctgatgaacgcgatggatatgctgccggtcgatttgctgccgatggtatggcagggcattaccggcaaccatcacgccctgctgcgcgtcgtaccgactgccgatttgaacaccactttggcactcgctgtcggcgtgttgctgatttgtatctattacaacatcaaaatcaaaggattgggtggctggtttcacgagttgttcagcgcgccgttcggtgcaaaactcgcacctgcgaactttctgttgaatttggtcgagtttctttctaaaaccgtatcccacggtatgcggttgttcggcaatatgtatgcgggcgaattggtattcttgttgatagccttgcttggcggtgcttgggcggcttccggcagcgtcgaagtcatggatccgattctgtttgtattccacattattgccggtttggcatgggcgattttccatattttggtgattaccctgcaggcgtttattttcatggcgttggcgttcgtctatatcggacaggcacatgatgcgcactga

SEQ ID NO: 5997 - DNA, 354 bp, Neisseria meningitidis
atgaagcagattatcatcctacaatccgccgtattgtccatatgcgccgcagttgcctttgctgtatggggttttgccggattcctttcggcggtcggtggcggtttgtcctacctgcttcccacgtttgttgcagttttacttttaaaacttttcaggggaaaccccttcctgcaaagcaggatgttcgtcttcggagagattttaaaagtagtgctgtcgctgttgtccatgcttgccgtatttgcaatatggcatcaatcgctggtgttcgccccgtttctgatggggctgctcggtgtcagccatttggtttttttagtattgttgagagtgaaagattatggcaggtga

SEQ ID NO: 5998 - DNA, 294 bp, Neisseria meningitidis
atgcaatttgtttgggaggcggaacgcacaaaggcaaaagtcaatgcaatgctttgcttaaagcggcaggcagttgctaatcctttattcggaaaaggtcgtctgaaaatattttcagacgaccttttatttattgagcaaattccccaaactgccgacaatccgaccgataaactgctacaatttcgcgttgattttttattatttccacgtaaagcaaacaaatcacgtaagaacattaaaaatgtaaagaaattgcggacaaactccttaatatcctgtaattatatgtaa

SEQ ID NO: 5999 - DNA, 174 bp, Neisseria meningitidis
gtgggaaatataattctattgacattttttctgcttcacgtaagaatcgttttcctgttttcatttttaattttcgaggaaattatgaacacacgcatcatcgtttcggctgcgttcgttgcgttggcattagcaggttgcggctcaatcaataatgtaaccgtttccgactag

SEQ ID NO: 6000 - DNA, 861 bp, Neisseria meningitidis
atggcaaaagtaaaaggcggattggggcgcggcttggattcgctgctcgccaacggcgcggacaacagcagcggcgaccgattgaccacggttgcggttaaagatatccggcccggccgctatcaggcgcgtgttcaaatcgatgacgaagccttgcaggaactggcagattcgattaaggcgcaaggcgtgatacagcccgtcatcgtgcgcgaacacggactgtcccgatacgaactgattgcaggcgaacgccgttggcgcgccgcacagattgccggcctgaccgaaatccccgccgttatcaaaaccatcagcgacgaaaccgcattggcaatgggtttgatcgaaaacctccagcgcgaaaacctcaaccccatcgaagaagcacaaggcttgaaacgccttgccgacgagttcgggctgacccacgaaaccatcgcccaagccgtcggtaaaagccgaagcgcgatttccaacagcctgcgccttttaagcctgcccgaacccgtgcaggaaatgctttaccaacgccgcctcgaaatggggcacgcccgcgcattgctgaccctgcccgtcgtcgaacagctcgaattggcgcaaaaggccgtcaaaaacggctggtcggtgcgcgaagtcgaacgccgcagccaggccgcccttcaaaacaaacgtcccgagcccaaaaagactgccgccgccgacatcggccgcctgaatgatttgctgactgaaaaactgggtgtcaacgctgaagtcaaaaccgccaaccacaaaaaaggcaggattgtcctgtatttcgatacgcctgaaacgttcggccacctgctggagcagttgggcatagattaccggccttaa

SEQ ID NO: 6001 - DNA, 573 bp, Neisseria meningitidis
atgatggtacggcgtttgataatcggcatcagcggggcgagcggtttccaatacggcgtgaaggctttggaacttttgcgcgcgcaagatgtcgaaacgcaccttgtggtatcgaaaggtgcggagatggcgcgcgcttcggaaacggcttatgcgagagacgaggtatatgccttggcggacttcgtgcatccgatcggcaatatcggggcgtgcattgccagcggtacgtttaaaacggatgggatgctggtcgccccctgttcgatgcggacgcttgcctctgtcgcgcacggcttcggcgacaatctgctgacgcgtgcggcggatgtggttttgaaggaaaggcggcggctggtgctgatggtgcgcgaaacgccgctgaaccttgcccatttggacaatatgaagcgggtaacggaaatgggcggcgtggtgtttccccctgttcctgcgatgtaccgcaaaccgcagacggcggacgacatagtggcgcacagtgttgcacacgctttgtcgctgttcggaatcgatacgccggattcggcggaatggcagggaatggcggattaa

SEQ ID NO: 6002 - DNA, 864 bp, Neisseria meningitidis; identical to SEQ ID NO: 217

SEQ ID NO: 6003 - DNA, 687 bp, Neisseria meningitidis
atggcagacttaacattccaacaagccgtttccaccatcgtcggcatgaaagacgaaatcttccgcgccttgggcgaaaccttcgtgatggtcggcttgtccaccacattcgccgtcatcttcggcacgctgctgggcgtgctgctcttcgtaacctccagccgccaactgcattacaacaagctggtgaacttcctgctcgacaacctcgtcaacctcatgcgcgccttccccttcgtcatcctgatgattgcgatgatacccgccacacgcgccatcgtcggcagcaccatcggtccggttgccgcctcgctggtgttgagcgtgtcgggattgttttattttgcccgactggtggaacaaaacctgcgcgaagtccccaaaggcgtaattgaagccgccgccgcgatgggtgcgccgccgattgccatcgtctgcaaagtcctcttgaacgaagcgcgcgcgggcatggtttccagcattaccgtgcttgccatcgggcttttgtcatacagcgcggcggcagggatgataggcggcggcggcttgggcgacctcgccatccgctacggctactaccgctaccaaaccgaagtcatcatcttcatcgtcgccctcctcgtgctgctggtcatcctgattcaaagcaccggcaacgcgttggcgcggaaactcgacaaacgttga

SEQ ID NO: 6004 - DNA, 738 bp, Neisseria meningitidis
atgattattttggacaaggtttccaagcattaccaaacgcgcgacaagacccgttttgccgccgtcgagccgaccagcctcgaaatccgcgacggcgaaatcttcgggctgatgggttattcgggtgcaggcaaatccaccctgttgcgcctgattaacctgttggaacgccccgacagcggcaaggtcaacgtctgcggacaagagctgaccgcgctcgatgccgccgcattgcgtcaggctcggcagaatatcggcatggtgtttcagcagtttaatcttttgagcaaccgcaccgttgccgacaatgttgcctttcctttggaaatcgccggatggccgtctgaaaaaatcaaagcgcgcgttaaagaatgccttgaaatcgtcggcttgaccgaacgcgccggccactatcccgcccagctttccggcgggcagaaacaacgtgtcggcatcgcccgcgcactcgcgcccaaaccccaagtcatcctcgcagacgaacccacttccgccctcgaccccgccaccacgcgcagcgtcttggaatgtttggaagacatcaacaaacgcttcaacgtaaccatcgtcatcgtaacccacgaaatgagcgtcatccgccgcctgtgcgaccgcgccgccctcttggataaaggcaaagtcgtcgaaatcgtcgaagtacgcggcaaccaaatccacgcccaatccgacatcgggcgcgaactgattcgggaggactga

SEQ ID NO: 6005 - DNA, 1851 bp, Neisseria meningitidis
atgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaacccgaaagaaaaacgctggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcacgcagacagtggacgctgtttgcacaggaatacgccaaactcgaaccggcagggcgcgcccaagaagtcgaatgctacgccgattcgagccgcaacgactatacgcgtgccgctgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattacggcaaggttgccgaccgccgccaactgaccgacgaccaaatcgagtggtacgcccgcgccgccttgcgcgcccgacgttgggacgagctggcctccgttatctcgcatatgcccgaaaaactgcaaaaaagcccgacctggctctactggctggcacgcagccgcgccgcaacgggcaacacgcaagaggcggaaaaactttacaaacaggcggcagcgacgggcaggaatttttatgcggtgctggcaggggaagaattgggtcggaaaatcgatacgcgcaacaatgtgcccgatgccggcaaaaacagcgtccgccgcatggcggaagacggtgcagtcaaacgcgcactggtactgttccaaaacagccaatctgccggtgatgcaaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttatgggctgattcgtcaggaaagccgcttcgttataggcgcgcaatcccgcgtaggcgcgcaggggctgatgcaggttatgcctgccaccgcgcgcgaaatcgccggcaaaatcggtatggatgccgcacaactttacaccgccgacggcaatatccgtatggggacgtggtatatggcggacaccaaacgccgcctgcaaaacaacgaagtcctcgccaccgcaggctataacgccggtcccggcagggcgcgccgatggcaggcggacacgcccctcgaaggcgcggtatatgccgaaaccatcccgttttccgaaacgcgcgactatgtcaaaaaagtgatggccaatgccgcctactacgccgccctcttcggcgcgccgcacatcccgctcaaacagcgtatgggcattgttcctgcacgctga

SEQ ID NO: 6006 - DNA, 213 bp, Neisseria meningitidis
atgcctgcaatccgcgtaaaagagaatgaaccatttgaagtcgctatgcgccgtttcaaacgcgccgtagaaaaaaccggcctgctgaccgagctgcgcgcccgcgaagcctacgaaaaaccgactaccgaacgcaaacgcaaaaaagcggcagccgtaaaacgcctgcaaaaacgcctgcgcagccaacaactgccgcccaaaatgtactaa

SEQ ID NO: 6007 - DNA, 543 bp, Neisseria meningitidis
atgaggacacaccgcaagacctgctctgcggtgtgttttgcttttcagacggcatcgaaacccgccgtttccatccgacatcccagcgaggacatcatgagcctgaaaatccgccttaccgaagacatgaaaaccgcgatgcgcgccaaagaccaagtttccctcggcaccatccgcctcatcaacgccgccgtcaaacagtttgaagtggacgaacgcaccgaagccgacgatgccaaaatcaccgccatcctgaccaaaatggtcaaacagcgaaaagacagcgcgaaaatctacactgaagccggccgtcaggatttggcagacaaagaaaacgccgaaatcgaggtactgcaccgctaccttccccaaatgctttccgccggcgaaatccgtaccgaggtcgaagctgccgttgccgaaaccggcgcggcaggtatggcggatatgggtaaagtcatggggctgctgaaaacccgcctcgcaggtaaagccgacatgggcgaagtcaacaaaatcctgaaagccgtgctgaccgcctga

SEQ ID NO: 6008 - DNA, 393 bp, Neisseria meningitidis
atgcccacttccaccaaaccctacatcctccgcgccctctgcgaatggtgcagcgacaacagcctcacaccgcacatccttgtctgggtcaacgaacacacgcgcgtccccatgcagtacgtccgcgacaacgaaattatgctcaacatcggcgcgaccgccacgcaaaaccttcaaatcgacaacgattggatcagcttttccgcccgcttcggcggacaggcgcacgatatatggatacctgtcggacacgtcctcagccttttcgcacgggagaccggagaaggtatggggtttgagttggaagcgtaccgccccgatacgccgcctgaaaacacctctgccgaaaccgcgccccgacccgccaaaaaaggcttgaaattggtcaaataa

SEQ ID NO: 6009 - DNA, 606 bp, Neisseria meningitidis
atgatgaccctctattccggcattacctgccccttcagccaccgctgccgcttcgttttgtacgaaaaaggtatggattttgaaatcaaagacgtcgatatttacaacaaacccgaagacctcgccgtcatgaatccgtataaccaagttcccgtgctggtcgagcgcgatttggtgctgcacgagtccaatatcatcaacgaatacattgacgaacgcttcccccatccgcagctgatgcccggcgatcccgttatgcgcggtcggggccggctggtgctgtaccgtatggaaaaagaattgttcaaccacgtccaagtgttagaaaaccccgccgccaccaacaaggaacaggcaaaagcgcgcgaagccatcggcaacggtctgaccatgcttgccccttcgttcagcaaaagcaaatacatcctcggcgaagatttttctatgattgatgtcgcccttgctccgctgctgtggcggctcgaccactacgatgtcaaactgggcaaaagtgccgcgccgctgctcaaatacgccgagcgcatcttccagcgcgaagcctttatcgaagcactgacacccgccgaaaaagccatgcgcaaataa

SEQ ID NO: 6010 - DNA, 1662 bp, Neisseria meningitidis; identical to SEQ ID NO: 595

SEQ ID NO: 6011 - DNA, 627 bp, Neisseria meningitidis
atgagatgttttatgattcaaaatgtcgttacttcaataatcctgtattctgggacagccgtagacttacttattatcctaatgttattttttgccaaaagaaaaagtagaaaagacatcattaacatctatttaggacaatttctaggctctgttagtctgatattgctaagtttactttttgcatttgtcttagattatattcctagtaaagagattttaggtttgctcggcttgattccaattctcctaggcatcaaagttttgcttttaggagattctgatggagaggctattgccaaagagggtttgcgcaaagataataaaaacctgatttttctagtcgctatgattacttttgcaagttgtggtgctgacaatattggtgtctttgtcccatattttactaccttaaatttagcgaatttgatagtggctttacttacctttctagtcatgatttatctcttggttttttctgcccaaaaattagcacaagtcccttctgttggagaaactttggaaaaatatagcagatggtttgttgctgttgtttatttaggattggggatatatatcctggttgaaaacaacagttttgatatgctatggactgtgttgggctag

SEQ ID NO: 6012 - DNA, 216 bp, Neisseria meningitidis
atgaaacaaggtattcacccgaactaccacgaagtcaacgttacctgctcttgcggcaacaaattcgcaaccaaatccgcgatggaaaaagaaaacttcaatatcgaggtttgctccctgtgccacccgttctataccggcacccaaaaaatcgttgataccaccggccgcgtggacaaattcaacaacaaattcggcaacctgttcaaacgctga

SEQ ID NO: 6013 - DNA, 384 bp, Neisseria meningitidis
ttgatgggatcaaaattctttttcctgctgctgcgttttgccggttcggggttgccgccgtcacatatgcgcggcatcggcatcgtcggcagacgggtgcgcggttttttggcgcggcgggtttctccgcatatcggacgcggggtcaatatcgaacgcggggcgtatgtgtttccggatacggttttgggcgacggctcgggcatcggggcaaactgtgaaatctgccgtgggctggtggtcggcaaaaatgtgatgatggagccggaatgtctgttttattcaaataaccacaagtttgaccgttcaaaaaacgctttgagggctacacggaaatccgtccgattacgttggaggacgatgtctggccggggcacagggtga

SEQ ID NO: 6014 - DNA, 501 bp, Neisseria meningitidis
atgaaaaaaatactcaccgccgccgtcgtcgcactgatcggcatcctccttgccatcgtcctcatccccgacagcaaaaccgcgcccgccttctccctgcccgacctgcacggaaaaaccgtttccaacgccgacctgcaaggcaaagtaaccctgattaatttttggtttccctcctgtccgggttgtgtgagcgaaatgcccaaaatcattaaaacggcaaatgactataaaaacaaaaacttccaagtacttgccgtcgcccagcccatcgatccgatagaaagcgtccgccaatatgtcaaagactacggtttgccgtttaccgtcatgtatgatgcggacaaagctgtcggacaggcgttcggcacacaggtttatccgacttccgtccttatcggcaaaaaaggcgaaatcctcaaaacctacgtcggcgaacccgatttcggcaaactctaccaagaaatcgataccgcgtggcgcaatagcgatgccgtctga

SEQ ID NO: 6015 - DNA, 384 bp, Neisseria meningitidis
atgaagctgaccgtccgcaactaccatctcgacggctacggccatgtcaacaatgcgcgctacctcgaatttttcgaagaagcgcgctgggcgttttttgaagaacgcggactgctgcacgagttggcaggcctcatactgattgtcgcccgcatcgacatccgatacagccgccccgccgtcgaaggcgacgtattgcagttttcatgccgcctgaaaacccccggcacgcgccgtattgtgctgacccagacgattacactgccaaacggcaaaaccgccgcagaagccgacatcaccctgatgcccgtccacgccgccacacaacgcaccgtcagcctgcccgccacccttgcccgcgcattggaagccttgtccgaatga

SEQ ID NO: 6016 - DNA, 483 bp, Neisseria meningitidis
atgccgtctgaaaatccgtgttcggacggcattcccttctgtcggaacggacagtccgaaaccacagattgggctataatctcttttttgcgcataccgcgcgacagcaaaggaaaaaccatgtacgaagtcaaccgcagcgtattcgtcctcatccctttagaacctttttggaactggctgcaaaccctgccgggcaaccacctcgacggactgactcttgaagacatccaagccgacgccaattcctaccttgtccgcccgtgcgaaaccgccgacgaagtatgggacgaaatcgaagcccgttttgaagacattttcgccgccgaacttgccgactggtgcgaagacgaacgcgagtggcctgcgctcgatgccgacattttcaacgaatggttcgacatccagctttctaccgtcatcaccgacctcgaacacgaaccgcttgcccgcgaagccttccaacccatcaacctgaactga

SEQ ID NO: 6017 - DNA, 828 bp, Neisseria meningitidis; identical to SEQ ID NO: 3749

SEQ ID NO: 6018 - DNA, 279 bp, Neisseria meningitidis
atgcatacagaactcaaaaacggaatattgcacatcggcggcgacatcaccgtcaaaaccctgaccgccgccgcttttacccgcttcagacagcaatgtcgtctgaaagacacctgcgcggttgatttgagcggcgtcggacgcgccgattccgcctgcgtgtcgctgctgctcgaagtgctgcgcggttgcaaaggcagcgtcaggctgaccggcattcccgaatccgtgcgcgcgctgtccgaactgtacgaaatcaaagactggctgaaatcatga

SEQ ID NO: 6019 - DNA, 591 bp, Neisseria meningitidis; identical to SEQ ID NO: 347

SEQ ID NO: 6020 - DNA, 495 bp, Neisseria meningitidis; identical to SEQ ID NO: 3739

SEQ ID NO: 6021 - DNA, 777 bp, Neisseria meningitidis
atgaactttatccgttccgtcggggcgaaaaccctcggccttattcaatccctcggcagtatcacgctgtttctgctgaacattctggcgaagtccggtacggctttcgtccgtccgcgcctgagcgtgcgccaagtgtatttcgccggtgtgctgtcggtgttgattgttgccgtttcggggctgtttgtcggcatggtcttgggtttacagggctatacgcagttgtcgaaattcaaatccgccgatattttgggctatatggtcgcggcttcgctattgcgcgagctgggtccggtattggcagcgattttgtttgccagcagcgcgggcggtgcgatgaccagcgaaatcggtctgatgaaaacgaccgaacagctcgaagcgatgaatgtgatggcggtaaaccctgtcgcccgcgtggttgcgccgcgcttttgggcgggcgtgttttccatgccgcttttggcttcgattttcaacgtggcgggcattttcggtgcgtatttggttggtgtaacctggctgggcttggacagcggtattttctggtcgcaaatgcagaacaacatcacgatacattacgatgtaatcaacggtctgatcaaatccgccgcgttcggcgtggcggtaacgctgattgccgtgcatcagggcttccattgcgtcccgacttcggaaggcattttgcgcgccagcacgcgcacggtggtttcgtccgccctgacgattttggcggtcgattttatattgaccgcgtggatgtttacagattga

SEQ ID NO: 6022 - DNA, 801 bp, Neisseria meningitidis
atgagcccatccccctttatcgaaatgaaagacgtcgccttcgcgtatggcgaccgcccgattctgaagaacatcaatttcagcattccgcaaggcaattttgctgccgtaatgggcggttcgggcagcggcaaaaccacgctgatgcgactgattacaggacagattcgtccgcagtccgggcaggttttgattgaaggacgggatttggcgggcttttcggctgacgagttgtatgaacaccgccgccgtatgggcgtattgttccaacacggcgcgctgtttactgatttgtcggtattcgacaatatcgcttttccgatgcgcgaactgacgcgcctgccggaagcggtgattcgggatttggttttgttgaaattgaacgcggtcggtctgcgcggtgtggaaaacctgatgccgtccgagttgtccggcgggatgtcgcgccgcgtcgcgcttgcccgcacgattgcgctcgaccctgaaattatgttgtacgacgagccgtttaccggcctcgatccgatttccttgggcgtgattgcccacttgatcagccgcgtcaacaaggctttgcgttcgaccagtattatggtaacgcacgacattgaaaaatctttggaaatcgtcgatcaggtgattttcttggcgcacggcgaaattatgttctccggctcgccgcaggaaatgcgcgaactggattcgccttgggtgcgccagtttgtcggcgggctggcagacggccccgtagcataccgttatccggcgcaaacgtcgttgcagcaggacctgttgggataa

SEQ ID NO: 6023 - DNA, 918 bp, Neisseria meningitidis
atggaaaaagcagaacatttgaacagcagccggttcgtcaatctagtcaaaagcggcggcggcagctatgtggagggcagctaccgtttcgatactttgtccaacggcatttccatccacggcggcacagtaacggcacggtgtgatttttgcagcagccgcctcgccgaaccttatgtgtcgttcgtgctcttgctggaaggcagtttggacttcggcatcaaccgctgccgcttccaaatcgatgcggacggcggcaagattgtcctaattgctgtcggggaagaagtcctgttcagccgctatctttaccgaggcggcaaaacggtcaaaatgaccattaaaggtatggaacaatggctgctgcgtccggaatacgcgcgtttcgcacccctgctttaccgcgaaccggtcaggatatgggatttgcccccgaacctgcgcggcttggcggcatcctgcctgaaagccgtcccaaaggggcatttgggcgaaacattgcgccgcgaggcggacgtgttgcggctgctgtcggacttgtgggacacggtttcagacggcatcgggccggcggcggggcaaacggcggaagcagacgctatgccgtctgaagacttcagccgcaccctaaatgccgcgtttgccgacggcgcacaccaagtcaaccggctgacagacgcgctgaacatcagtgaaaggacgctgcaacgccgtatgcgcgaccatttcggcattacggcaagcgaatggctgcaccacaaacaaatgcagcacgcgctctatctgttgcaaaacgggggaaaaagcataggcgaaaccgcatatttatgcggctaccgccacgtttccagctttactcaggcattcaggcaatatttcggcagcacgcctgcggaaaccaaaaaagaaaaccggtaa

SEQ ID NO: 6024 - DNA, 1443 bp, Neisseria meningitidis
atgaaacaattggccatgtacatcaacggacgctttgaaaacgatttcaacggcgaatggcgcgacgtattgaacccgtccaccgaagaggccatcgcccgcgaacccaaaggcggcaaggcggacgttgaccgcgccgtcgcggcggcgcgtgcggcgcaaccggcttgggagcgtctgcctgcggtcgaacgcggcgcgtatttgcgtaaaatcgcccaaggcatacgcgaacgtgccgacgagctgaccgacaccatcgttgccgaaggcggcaaaaccaaagacttggcacgcgtggaagtcatgttcaccgccgactatctcgattatcaggccgaatgggcgcgccgctacgaaggcgaaatcatccaaagcgaccgcccgcgcgaaaatattttattgttcaaacgtccgctgggcgtaattgccggcattttgccgtggaacttccccttcttcctgattgcccgcaaaatgggccccgctttggtaacgggcaacaccatcgtcgtcaaacccagcagcgtaaccccgatcaactgccacatcttcgccgaaatcgtcgatgcggtcggactgcccgcaggcgtgttcaacgtggtgaacggtcccggcgcggaaatcggcaatgccttgtccgcccatccgcaagtcgatatggtcagcctgaccggctccgtcgaagcaggccgccaagtgatggaagccgcctccgccaacatcaccaaagtttcgctggaactcggcggcaaagcgcctgccatcgttttgaaagatgcggatttggacttggcggtgaaatccatcttggcttcgcgcgtcggcaacaccggtcaaatctgcaactgcgccgagcgcgtctatgtccacagcagtctgaaagacgcattcattgaaaaaatgaccgccgcgatgaaaggcgtgcgctacggcaaccctgccgaagccgaagcaggcgcgctggaaatgggcccgctgattgaagaacgcgccgtcaaagccgttgccgaaaaagtggaacgggcagtcaaacaaggtgcgaaattggtttgcggcggcaaacgcgccgaaggacgcggttatttcttcgagccgaccctgctgaccgacaccgacaacagtatggacattatgaaagaagaaaccttcggccccgtgctgcccgtttccgctttcgacacgctcgaccaagtcatcgccttggcaaacgattgcgagtttggtctgaccagttctgtttatacgactaatttaaacgaagccttctacgttacccgccgcctgcaattcggcgaaacctacatcaaccgcgaaaactttgaagcgatgcagggtttccacgccggttggaaaaaatccggtatcggcggcgcggacggcaaacacggtttggaagaatatctgcaaacccaagtcgtttatttggaaaccgacatttaa

SEQ ID NO: 6025 - DNA, 3249 bp, Neisseria meningitidis
atgcgaacgaccccaaccttccctacaaaaactttcaaaccgactgccatggcgttagctgttgcaacaacactttctgcctgcttaggcggcggcggaggcggcacttctgcgcccgacttcaatgcaggcggtaccggtatcggcagcaacagcagagcaacaacagcgaaatcagcagcagtatcttacgccggtatcaagaacgaaatgtgcaaagacagaagcatgctctgtgccggtcgggatgacgttgcggttacagacagggatgccaaaatcaatgccccccccccgaatctgcataccggagactttccaaacccaaatgacgcatacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacaaaaactatacggcgtatatgcggaaggaagcgcctgaagacggaggcggtaaagacattgaagcttctttcgacgatgaggccgttatagagactgaagcaaagccgacggatatccgccacgtaaaagaaatcggacacatcgatttggtctcccatattattggcgggcgttccgtggacggcagacctgcaggcggtattgcgcccgatgcgacgctacacataatgaatacgaatgatgaaaccaagaacgaaatgatggttgcagccatccgcaatgcatgggtcaagctgggcgaacgtggcgtgcgcatcgtcaataacagttttggaacaacatcgagggcaggcactgccgaccttttccaaatagccaattcggaggagcagtaccgccaagcgttgctcgactattccggcggtgataaaacagacgagggtatccgcctgatgcaacagagcgattacggcaacctgtcctaccacatccgtaataaaaacatgcttttcatcttttcgacaggcaatgacgcacaagctcagcccaacacatatgccctattgccattttatgaaaaagacgctcaaaaaggcattatcacagtcgcaggcgtagaccgcagtggagaaaagttcaaacgggaaatgtatggagaaccgggtacagaaccgcttgagtatggctccaaccattgcggaattactgccatgtggtgcctgtcggcaccctatgaagcaagcgtccgtttcacccgtacaaacccgattcaaattgccggaacatccttttccgcacccatcgtaaccggcacggcggctctgctgctgcagaaatacccgtggatgagcaacgacaacctgcgtaccacgttgctgacgacggctcaggacatcggtgcagtcggcgtggacagcaagttcggctggggactgctggatgcgggtaaggccatgaacggacccgcgtcctttccgttcggcgactttaccgccgatacgaaaggtacatccgatattgcctactccttccgtaacgacatttcaggcacgggcggcctgatcaaaaaaggcggcagccaactgcaactgcacggcaacaacacctatacgggcaaaaccattatcgaaggcggttcgctggtgttgtacggcaacaacaaatcggatatgcgcgtcgaaaccaaaggtgcgctgatttataacggggcggcatccggcggcagcctgaacagcgacggcattgtctatctggcagataccgaccaatccggcgcaaacgaaaccgtacacatcaaaggcagtctgcagctggacggcaaaggtacgctgtacacacgtttgggcaaactgctgaaagtggacggtacggcgattatcggcggcaagctgtacatgtcggcacgcggcaagggggcaggctatctcaacagtaccggacgacgtgttcccttcctgagtgccgccaaaatcgggcaggattattctttcttcacaaacatcgaaaccgacggcggcctgctggcttccctcgacagcgtcgaaaaaacagcgggcagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggcagccgaccgcacagatatgccgggcatccgcccctacggcgcaactttccgcgcagcggcagccgtacagcatgcgaatgccgccgacggtgtacgcatcttcaacagtctcgccgctaccgtctatgccgacagtaccgccgcccatgccgatatgcagggacgccgcctgaaagccgtatcggacgggttggaccacaacggcacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacgcagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcctcactgaaggcacgctggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgtctggttgccggcctgggcgcggatgtcgaattcggcaacggctggaacggcttggcacgttacagctacgccggttccaaacagtacggcaaccacagcggacgagtcggcgtaggctaccggttctga

SEQ ID NO: 6026 - DNA, 1782 bp, Neisseria meningitidis
atgccttatttcgccctgtttgacgatgccgtaagcggccgcgcaaaacgctatcaaaatcatgtggaaagccgttttttccgtcccgaagaactcgatgctttggacggcgcgctgcaatcgggctggcaaaaagggctgcattcggtgttgtttgcagactacggattcggtttgccgctgacgggggttgagtccgaacgcggcggcaatcttgccctgcactggtttgccaactgcgccgacatcgatgccgaaagctggcttgcccgacactcagacggcctccccgccggcatttccacgccgcaaccctccgtatccgaaaccgattacctcgaccgcatccgccaaatccacgaagccatccggcgcggcgacacctatcaaatcaactacaccacccgcctgcacctgcaagcctacggcaatcccgtcagcctctaccgccgcctgcgccagcccgtcccctatgccgtcttgtcccacctgcccgatgcggaggggcaatccgcgtggacgctgtgtttctcgcccgaactcttcctcaaaatcggttcggacggcaccatcagcaccgaaccgatgaaaggcaccgcgccgattttgggcgacggacaagacgaacgccgcgccgccgagttgcaagcagacccgaaaaaccgcgccgaaaacgtgatgattgtcgatttgctgcgtaacgatctcggcaaaatcgcccaaaccggcacagtatgcgtacccgaaccgtttaaagtatcgcgtttcggcagcgtttggcagatgaccagcaccatccaagcccaagccttgccgcacacctcgttcgccgacatcctccgcgccgccttcccctgcggcagcatcaccggcgcgcccaaaaaaatgagtatgcagattatcgaatcgctcgaagccgaagcgcgcggactttatacgggcagcatcggctatttgaacccgtgttccggcggcttggggtttgaaggcacgttcaacgtcgttatccgcaccttgtcgctcacgccgctttcagacggcatttatcaaggcgtgtacggtgtcggttccggcatcgtcatcgacagcgaccccgccgccgaatatcgcgaatgcggctggaaagcccgtttcctcaacgaattgcgccccgacttcggcatttttgaaaccctgcgcgcggaaaacggacgctgcaccctgctcgaccgccacctatgccgtctgaaaacctccgcccaagccctcaacctgcccctgcccgacggctgcgaaaatcaaatcaaacaatacattgccgacttgcccgatggcgcgttccgcgtcaaagccctgctcgcttcagacggcatcagcctgtcccgcgccgttttaaaccgtctgaccgacaaacaacgcgtcatcatttcgcccgccgtcctgcccgcacaaaactacctgcgccgcttcaaaaccacctgccgcgccctcttcgaccaagcgtggcaaaccgccgaaacacaaggcgcgttcgacagcctgtttttcaattcagacggcatcctgctcgaaggcggcagaagcaacgtcttcatcaaacatcgcggacaatggctcacaccctctttagatttagacattttaaacggcataatgcgccaagccgtattggacgaaccgcaaaaatatttgcaaacaaatcaagtaatcgaaacacacatcacacaaaaaacactgcaagaagccgaagaaatccgcctctccaacgccttgcgcggcgtatttgccgccgcccttgcctga

SEQ ID NO: 6027 - DNA, 1518 bp, Neisseria meningitidis; identical to SEQ ID NO: 3853

SEQ ID NO: 6028 - DNA, 1635 bp, Neisseria meningitidis; identical to SEQ ID NO: 3945

SEQ ID NO: 6029 - DNA, 291 bp, Neisseria meningitidis
atgaccatccgtcctttacacgaccgcgttgtcgtcaaacgcttggaagctgaagaaaaaaccgcatcgggcatcgttttgccgggtgcggccgccgaaaaacccgatatgggcgaagtcatcgccgtgggcgcgggcaaaatcggtaaagacggcagccgccgtccgctggatgtcaaagtcggcgacaaaatcatcttcggcaaatacagcggccaaaccgtaaaagccgacggcgaagagctgttggtaatgcgcgaagaagatattttcggcatcgttgaaaaataa

SEQ ID NO: 6030 - DNA, 653 bp, Neisseria meningitidis
atgaagataacgcactgcaaattaaagaaaaaagtacagaaagaactgctccgttttttgtactggaagttaccgcccgttctgccgccgatattttgggtatccatcccaattcggcagcactgttctaccgtaaaatccgcacggttatcaaccatcatttagccttggctgccgatgaggtttttgagggccctgtcgagccggacgaaagcgatttcggcggacggcgtaaaggtagacgtggtcgcggtgcagcaggaaaagtggttgtcttcggcattctgaaacgcaacggacgggtctataccgttgtggtggataatgccaagtctgaaacgttactccctgtcatcaagaagaaaatcatgccggacagtattgtttataccgatagtctgagcagctgcgacaagttggacgtgagcggtttcatttattaccgcatcaaccattccaaggaatttgcagaccgtcagaaccacattaacggcattgagaatttttggaatcaggcaaaacgtgtcttgcgaaaatacaatggaatcgatcgtaaatctttcccgctgttcttgaaagaatgcgaatttcgatttaacttcggcacaccgtctcaacagcttaaaatcctgcgggattggtgtgggatttag

SEQ ID NO: 6031 - DNA, 1536 bp, Neisseria meningitidis
gtgtctgattccaagacgaaagaacgcgccacattcggcacgcgccgcgcgtttatgattgccgccatcgggtccgccgtcggcttgggcaatatttggcgtttcccctatattgcttttgaaaacggcggcggcgcgttcatcctgccctatctggtcgcgcttctgacggcgggcatcccgctgctgctgctcgattatgccatcggccaccgttaccgtggttctgcgcccttggctttccgccgcctcggacgatggtttgagccggtcggctggtggaacgtgatgaccaatatcgtcatctgcatctattacgcggtaattatcggttgggcggcaagctatacctattattcggtcaacgccgcctggggtgcggatccgcagggttttttctttaaggacttcctgcaaatggcgggcccggaagccttgggtttggattttgtcggcaaagtcgccggtcctttggcgggcgtgtgggtttttaccgccgccattatggcgttgggcgtgcaaaagggcgtggcgcgcgcctcgtcgttctttatgccgctgcttttggtgatgtttttgattatggtcggcatttcactaaccctgccgggtgcggcaaagggcttggacgcattgtttacgcccgactggtcgaaactcgccgattccaaggtctgggtggcggcatacgggcagattttcttttcgctttccatctgcttcggcattatggttacctattcttcttatttgaagaaaaaaaccgacttgggcggaacggggctggtggtcggttttgccaacagcagctttgaactgctcgcgggcatcggcgtgtttgccgcattgggctttatggcgcaggcgggcggtaaggcggtcaacgaggttgcctcaggcggcatcggtttggcgtttatcgcctttccgaccattatcaaccaggcaccgatgggctggctgatcggcatattgtttttcggttcgctggtgttcgccggcgttacgtcgatgatttccatccttgaagtgattgtggcggcgattcaggacaagctgaacatcgggcgcgtcaacgccacgctgctggtctgcattccgatgggcattgtttccacgctgctgttcggtacggcgacggggctgccggttttggacgtgatggacaaattcgtcaacacctacggcattgttgccgccggctttgtttatgttgccgccatcatcatcagcggcaggctgccggaattacgcaagcacctgaacgctttgtcctccatccgcatcggcggcttgtggacggtctgcgtcgtggttaccgtcgtgatgctcggctatatgctgtttaaagataccagcggcctgatggagaaaaattacgaaggttatccggatggtttcctcagtattttcggctgggggatgtcggcggcgttggtcgtgttcgggctgctgctgtcgttgctgccttggaaacacggtcaggatttcaacgtcaaagacgaacacgaacatgaacaaggagaagaaaaatga

SEQ ID NO: 6032 - DNA, 1245 bp, Neisseria meningitidis
atgaccctattttgcgaacaagtcccctacccccgccttgctgaagcattcggcacaccgctttatgtgtacagccaatccgcgctgaccgaagcatttgaacactaccaaaccgcgtttgccgctttgaacccgctcgtctgttacgccgtcaaggcaaacggcaatctgagcattatcaaacacttcgcctcgctgggcagcggttttgacattgtgtccggcggcgaattggcacgcgttttggcggcaggcggcgacgcggcaaaaaccatattttcaggcgtaggcaaaagcgaggcggaaatcgagttcgcgctgaatgcaggcgtgaaatgcttcaatatggaaagcatccccgaaatcgaccgtattcagaaagttgccgcacgtttgggtaaaaccgcgcccgtctccctgcgcatcaaccccgatgtcgatgcaaaaacccatccctacatctccacaggtctgaaagccaacaaattcggcatcgcctacgccgacgcgctcgaagcctaccactatgccgcacaacagcccaatttgaaaatcatcggcatcgactgccacatcggttcgcaactgaccgacttaagcccgctggtcgaagcctgcgagcgcattttgattttggttgacgcgcttgccgccgaaggcattgttttggaacatttagacttaggcggcggcgtcggcattgtttaccaagacgaaaatgtgcctgatttgggcgcgtatgcccaagccgttcaaaaactgatcggcacacgccgtctgaaactcattcttgagcccggccgcagcctggtcggcaacgcaggttcgctgctgacacgcgtcgagtttgtcaaatacggcgaagagaaaaactttgtgatggtcgatgcggcgatgaacgatttgatgcgcccggcgctttatgatgcctatcatcacatcgaggcggtcgaaaccaaagacatcgcgacgctgaccgccaacatcgtcggtccgatttgcgaaaccggcgacttcctcggcaaagaccgcaccatcgcctgcgaagaaggggatttgctgcttatccgcagcgcgggcgcatacggggccagtatggcgagcaattacaacgcgcgcaaccgtgcggcagaggtgttggtggacggcaacgaataccgactcatccgccggcgcgaaaccttggaacagcaaatggcaaacgaactcgcctgcctgcaagccgaacatcaaaatgccgtctga

SEQ ID NO: 6033 - DNA, 171 bp, Neisseria meningitidis
atgaaatacggcgtattttttgcggcggcaaccgccctcctgctctcggcctgcggttacaaaggcgacctctacctgcccaaagaaggcgacaaggcgcgtttcggcgtaatccaaaccggtttgcaacttcaaagcaaaccgcaatccgctccacaaacccaaaaatga

SEQ ID NO: 6034 - DNA, 324 bp, Neisseria meningitidis
atgatgaccgaaagcgagtttatccgcgcgagcgaagcattatttgaacacatcgaagaccaaatcgacgaaaacggctgggatttcgactgccggtttgccggaaacgtcctgaccatcgaagccggagacggcgcccaaatcatcgtcaaccgccacacgcccaatcaggaattgtggattgccgcaaaaagcggcggctaccatttcgccgagcaaaacggcaaatggctggcaacgcgcgacggacgcgatttttatgacgttttaaacgaagccctgagcgcggcttcgggcgaagcggtggaaattgcggaattgtga

SEQ ID NO: 6035 - DNA, 1017 bp, Neisseria meningitidis
atgaacacacgtcccttttatttcggactgatatttatcgcgattatcgctatacttgctaactatttaggaaacactgatttttcccatcattatcatatcagtgctttaattattgctatcttgctgggaatggcaatcggcaataccatttatccgcaattttcgacacaagtggaaaaaggcgttttgtttgccaaaggcgcgcttcttcgcactggcattgtgttgtatggttttcgcctcacttttggcgatattgccgatgtaggattaaatgcggttgtcactgatgcaatcatgctaatttcaaccttcttttttaccgcacttttaggcattcgttatctaaaaatggataaacaattggtttatctcactggggcaggttgcagcatttgcggtgcggcagcagtgatggcggcagagcctgttactaaagcagaatcccataaagtttcagtggcgattgccgtagtggtcattttcgggacgcttgctatttttacttaccccttgttctacacgtggtcacaacatttaattaacgcccatcaattcggtatttatgttggttctagtgtacacgaagtggctcaagtgtatgcgattggggaaaatattgatcctatcgtggcgaatactgccgtcatttccaaaatgatccgagtgatgatgctcgccccctttttattaatgctttcttggttattaacacgtagtaatggagtatcagaaaatacatcacacaaaattacaattccttggtttgctgtactttttattggtgttgccatttttaattcttttgatttattaccaaaagaactcgtgaaattattcgttgaaatcgattctttcttattaatttcatcaatggctgcgcttggcttaacgacgcaagcaagcgcaatcaaaaaggcaggattaaaaccgtttgttttaggaatactaacttatttatggctagtggttggtggatttttagtgaactatggaatatcaaaattaatataa

SEQ ID NO: 6036 - DNA, 420 bp, Neisseria meningitidis
atggcacaattaccgctatatctgacttctgaaatcaaagactttactgtcggcacgcctaaagttttagaatcattttccaaacatatcccttatggtgtcgtctttgaagacgacggcgacacaggctacttctatgccgcttcgcaagacgggattttagatgccttgcacatctataatgtcgaagatgtatccgacaaacatatccccaatcatgtcttgattttatgggatgatgcctgcaccatagccgcattgtgtatcaacgactacattcatgccgtctatgattttgtcgaacaggcaggatattgccgcaacggcttccctgaagcaggcggcgaatgggtgaaagtcgaaaaccgcgtcttggatgatgaattgctggacaaaatcctatcccgaaaatctacataa

SEQ ID NO: 6037 - DNA, 507 bp, Neisseria meningitidis
atgcccctactagacagtttcaaagtcgatcacacccgtatgcatgcccccgccgtacgcgtggcgaaaaccatgactacgcccaaaggcgacaccattaccgtgtttgacctgcgcttttgcgttcccaacaaagaaatcctgcctggaaaaggcatacacacgctggagcatttgttcgcaggttttatgcgcgaccacttgaacggcaacggcgtggaaatcatcgacatttccccgatgggctgccgcaccggtttttatatgagtcttatcggcacgccttccgaacagcaggtcgccgatgcgtggctggcttcgatgcaggatgttttgaatgtcaaagaccaaagcaaaatccccgagttgaacgaataccaatgcggcacttatcaaatgcactcgctcgccgaagcgcagcaaatcgcgcaaaacgtgttggcgcgcaaagtggcggtgaacaaaaatgaagagctgacgctggatgaagggctgctgaacgcctaa

SEQ ID NO: 6038 - DNA, 2817 bp, Neisseria meningitidis
atgtccaacagacctacactcctcctcgttgacggatcgtcctacctctaccgtgcgtatcacgcgatggggcaaaacctgaccgcccccgacggcgcgccgacgggtgcgctgtatggtgtattgaatatgttgcgccgtttgcggtcggaatatccgcacgattattgcgcggtggtttttgatgcgaaaggcaaaaatttccgccatcaaatgtttgaagaatacaaggcgacgcgcccgccgatgcccgacgatttgcgcccgcaggcggaagcactgccggatttagtgcgcctgacaggctggccggtattggtgattgggcaggtggaggcggacgatgtgatcggcacgctggcgaaacagggggcggaacatggtttgcgagtcattgtttcgaccggcgataaggacatggcgcagttggtggatgagcgcgttacgctggtgaacacgatgagcagcgaaacgctggacattgaaggcgtgaaggcaaaattcggcgtgcgccccgaccaaatccgcgattatctcgcgctgatgggcgacaaggtggacaacgtgccgggcgtggaaaaatgcggcccgaaaacggcggtgaaatggctggaagcctacggttcgctggctggtgtgatggaacacgcttcggaaatcaagggcaaagtgggcgaaaacctgcaagccgcgctgccccaactgccgctgtcgtatgatttggtcacgattaaaaccgatgtggacttgcacgccgagctttcagacggcatcgaaagcctgcgccgtactacgccgaaatgggcgcagctggttgtcgatttcaaacgctggggcttccgcacctggctgaaagaagcggaatcaaacatgaataccggctcgaccgatgatttgttcggcagcgacagcatcggcgagcaggcggctttgaatgcggaaatgccgtttgaaaaacaagccgaaaaagccaccgcccccgaaaaactggattatcaagccgttaccaccgaagcgcagtttgccgctttgttggacaaactgtcgcgggcggacacaatcggcatcgatacggaaaccacgtcattagacgcgatgaacgcctcgctggtcggcatcagcatcgctttccaagcaggcgaagcggtttacatccccgtaggacacagcctgaccgccgcgcctgaacagcttgatttacaagacgtattaggccgtctgaaaccgcatttgggaaaccccgccctaaaaaaaatcgggcaaaacctcaaatacgaccaacacgttttcgccaactacggcatcgccctgaacggcattgccggcgacgccatgctcgcttcctacatcatcgagagccatctcggacacggcttggacgaattgtccgaacgctggctcggcttggaaaccattacctacgaatcgctgtgcggcaaaggcgcgaagcaaatcggttttgccgatgtcgccatcgggcaggcgaccgaatacgccgcccaagacgccgatttcgccctgcgcctcgaagcgcacctgcgcgcgcaaatggacgaaaaacagcttgaaatgtatgaaaaaatggagctgcccgtcgcgcaggtattgtttgaaatggaacgcaacggcgtgcaaatcgaccgcgccgaactcgcccgccaaagcgcggaactcggcgccgagctgatgaagctcgaacaggaagcctatgccgccgcaggccagccgttcaacctcaattcgcccaaacagctgcaagaaatcctgttcgacaaaatgggcatccccaccaaaggcctgaaaaaaaccgccaaaggcggcatttccaccaacgaagccgtgctcgaacagctcgcgcccgactaccccctgcctaaaatcatcctgcaaaaccgcagcctggcgaagctcaaatccacctacaccgacaaactacccgaaatgatttcccccaaggacggccgcgtgcataccacctacgcccaagccgtcgccattaccggccgcctcgccagcaacaaccccaacctgcaaaatatccccatccgtaccgaagaagggcgtaaagtccgccgcgcctttaccgcaccgcaaggcagcgtcatcgtttccgccgactattcccaaatcgagctgcgcattatggcgcacctctccggcgacaaaaccctgattgccgcgttccaaaacggcgaagacgtacaccgccgcaccgccgccgaagtgttcggcactgcgcccgaaaacgtctcgtccgagcaacgccgctatgccaaaagcatcaacttcggcttaatttacggtatggggcaatacggtttggcaaaatcattgggcatcgacaacctttccgccaaaaactttatcgaccgctacttcgcccgctaccccggcgtcgccgaatacatgcagcgcaccaaagaacaagccgccgcccaaggctacgtcgaaaccctgttcggcagaaggctctacctgcccgacatccgcaacaaaaacgccaacgcccgcgccggagccgaacgcgctgccatcaacgcccccatgcagggcaccgcctccgacctcatcaaacgcgccatgatagacgtgtcccgctggctttcagagtgcgaagcctccccgtgggacgaactcttacaaagcaaactgattatgcaggtgcatgacgaactggtgctggaagtcgttgaaaccgaactggattttgtcaaagaaaaactgccgcagattatggcgaaagtggacggcggattattggatgtaccgctggtggctgaggttggcgtaggggagaattgggaagaggcacattga

SEQ ID NO: 6039 - DNA, 672 bp, Neisseria meningitidis
gtgtttcccgacaaatacaagttgagtttgaaagaaaatatttttttggcaaagaaagtattggttgcccaaattcacaacctcagtcgttttgagaattgtcagacgaccttgttgcagaccgaacaaattatccatggcaaaaatgtagcctccgcgtcactggaagacatccaaaccatcttgaacctgaaacgtgcctatcaatatgtgatttcgcatatttcaaacggcgaaccggtcgatatttcactccttaaaaaaatcaacaacattgttgccaaggacgattctttggcacccggtgatttccgtaccggttcggtcggcgtaacgctattggacggttcccgtcatgccccgaatccagtgaaggaaattgaagtggcccgcgtgttacaaaatatcggactgcaaagcggttcgacgacggaggcagccgtccgttttatgctttattgtatgcggcagcaggttttttgggacggcaacaaacgaacggcaaccttatttgccaacggtctgatgatggcggggggctgcggcatcttggaaatctccgaaatgcagatgccgcaattcaatgaaaaactgtccgcattctatcgctccggcgacgataccgatatttccaagtttgtgtatcaaaattgtatatcgggcatagactga

SEQ ID NO: 6040 - DNA, 1112 bp, Neisseria meningitidis
atgagcaccttcttccagcaaaccgcccaagccatgattgccagacacatcgaccgtttcccgctattgaagttggaccaggtgattgattggcagccgatcgagcagtacctgaaccgtcaaaaaacccgttaccttagagaccaccgcggccgtcccgcctatcccctgctgtccatgttcaaagccgtcctgctcggacaatggcacagcctctccgatcccgaactcgaacacagcctcattacccgcatcgatttcaacctgttttgccgttttgacgaactgagcatccccgattacagcaccttatgccgctaccgcaaccggctggcgcaagacgacaccctgtccgaactgttggaactgattaaccgccaactgaccgaaaaaggcttaaaagtagagaaagcatccgccgccgtcgttgacgccaccattattcagaccgtcggcagcaaacagcgccaggctatagaagtcgatgaggaaggacaaatcaacggccaaaccacaccgagtaaggacagcgatgcccgttggataaagaaaaacggcctctacaaactcggttacaaacaacatacccgtaccgatgcggaaggctatatcgagaaactgcacattacccccgccaatgcccatgagtgcaaacacctgccgcctttgttggaaggactgcccaaaggtcgaccgtctatgccgacaaaggctacgacagtgcggaaaaccggcaacatctggaagaacatcagttgcaggacggcattatgcgcaaagcctgccgcaaccgtccgctgacggaaacgcaaaccaaacgcaaccggtatttgtcgaagacccgttatagtggattaaatttaaatcaggacaaggcgacgaagccgcagacagtacaaatagtacggcaaggcgaggcaacgccgtactggtttaaatttaatccactatatgtggtcgaacagagcttcggtacgctgcaccgtaaattccgctacgctcgggcagcctatttcggactgattaaagtgagtgcgcaaagccatctgaaggcgatgtgtttgaaccttttgaaagcggccaacaggctaagtgcgcccgctgccgcctaa

SEQ ID NO: 6041 - DNA, 4374 bp, Neisseria meningitidis; identical to SEQ ID NO: 649

SEQ ID NO: 6042 - DNA, 432 bp, Neisseria meningitidis
atgaccgaaaacgcacaggacaaggcgcggcaggctgtcgaaaccgtcgtcaaatccccggagcttgtcgagcaaatcctgtccgacgagtacgtgcaaataatgatagcccggtgtttccattcgggaccgttgccgccgccgtccgacttggcgcaatacaacgacattatcagcaacggggcagaccgcattatggcaatggcggaaaaagaacaagccgtccggcacgaaaccatacggcaagaccaaaccttcaacaggcgcgggcaactgtacggcttcatcagcgccatcctgatactgctttttgccgtcttcctcgtatggagcggctaccccgcaaccgccgcctcccttgccggcggcacagtgtttgccttggcgggtgctttcgtgattggaagaagccgagaccaaggcaaaaattaa

SEQ ID NO: 6043 - DNA, 1347 bp, Neisseria meningitidis
atgtcggataacgttccaacgattgcggcagtcgctaccgcaccagggcgcggcggcgtgggcgtgatacgcatatcggggaaaaacctgctgccgatggcgcaggctttgtgcgggaaaacgcccaagccgcgtaccgcaacctatgctgattttacggacacggacggacaggcaatcgacagcgggcttttgctgttttttgccgcaccggcaagttttacgggtgaagatgtcatcgagcttcagggacacggcgggccggtggtgatggatatgctgctgaaccgctgtttggaattgggcgcgcgccttgccgaaccgggcgagtttacgaagcgtgcgtttttgaacgacaaactggacttggcacaggcggaaggcgtggcggatttgattgacgcatccagccgttcggcggcgcgtctggctttgcgctcgctcaagggcgatttttcgcggcggatacacggtctggtcgaagacttgattaccttgcggatgctggtcgaagcgacgttagattttcccgaggaagacattgattttctcgaagcggcagacgcacgcggcaaactggacggcttgcgccgcgccgtggatgatgtgcttgccaacgcgcagcagggcgcgattttgcgcgaaggtctgaatgtcgtattggtcggcgcgccgaatgtgggcaagtccagcctgctgaacgcgttggcgggcgacgaagtggcgattgttaccgatattgccggaacgacgcgcgacgcggtcagggaacgtatcctgattgacggcgtgccggtgcatattgtcgatacggcaggtttgcgcgagacggacgacgtggtcgagcgtatcggcatcgaacgcagccgcaaagccgtatccgaagccgatgtcgcgctggtgttggtcgatccgcgcgagggtttgaatgaaaagacacgggcgattttggacgcgttgccgccggagttgaaacgcatcgaaatccacagcaaatccgatttgcacgcacacgcggcaggcgggttcggtacgggcgcggaaaccgtcatcgcgttgtcggcgaaaaccggcgacggcttggacgcgctgaaacggacgttgttgcgcgaggccggttggcagggcgaaagcgaagggttgtttttggcgcggacgcggcacgtcaacgcactcaaagcagcgcaggaagaattgtcgctggcggcattgtgcggcaaccatcaaatcgagctgtttgccgaacacttgcgcttggcgcaggtcgcatgcggcgaaatcacgggcgagtttacggcggacgacctgctcggcgtgattttttcgaggttttgtatcggaaaataa

SEQ ID NO: 6044 - DNA, 2145 bp, Neisseria meningitidis
atgaataccccattgttccgtctcagcctgctctcgcttaccctggcggcaggttttgcccatgcggcagaaaataatgccaaggtcgtactggataccgttaccgtaaaaggcgaccgccaaggcagcaaaatccgtaccaacatcgttacgctgcaacaaaaagacgaaagcaccgcaaccgatatgcgcgaactcttaaaagaagagccctccatcgatttcggcggcggcaacggcacgtcccaattcctgacgctgcgcggcatgggtcaaaactctgtcgacatcaaggtggacaacgcctattccgacagccaaatcctttaccaccaaggcagatttattgtcgatcccgctttggttaaagtcgtttccgtacaaaaaggcgcgggttccgcctctgccggtatcggcgcgaccaacggcgcgatcatcaccaaaaccgtcgatgcccaagacctgctcaaaggcttggataaaaactggggcgtgcgcctcaacagcggctttgccagcaacgaaggcgtaagctacggcgcaagcgtattcgggaaagagggcaacttcgacggcttgttctcttacaaccgcaacaatgaaaaagattacgaagcaggtaaaggcttccgtaataatttcaacggcggcaaaaccgtaccgtacagcgcgctggacaaacgcagctacctcgccaaaatcggaacaagcttcggcgacggcgaccaccgcatcgtattgagccatatgaaagaccagcaccggggcatccgtaccgtccgtgaagaatttaccgtcggcggcgataaagagcgaataagtatggaacgccaagcccctgcttaccgcgaaaccacacaatccaacaccaatttggcgtacacgggtaaaaacctgggctttgtcgaaaaactggatgccaacgcctatgtgttggaaaaagaacgctattccgccgatgacagcggcaccggttacgcaggcaatgtaaaaggccccaaccatacccaaatcaccactcggggtatgaacttcaacttcgacagccgccttgccgaacaaaccctgctgaaatacggtatcaactaccgccatcaggaaatcaaaccgcaagcgtttttgaattcacaatttaaaattgaagataaagaaaaagcaactgatgaagagaaaaataagaaccgtgaaaatgaaaaaattgccaaagcctaccgtctgaccaacccgaccaaaaccgataccggcgcgtatatcgaagccattcacgagattgacggctttaccctgaccggcgggctgcgttacgaccgcttcaaggtgaaaacccacgacggcaaaaccgtttcaagcaacaaccttaacccgagtttcggcgtgatttggcagccgcacgaacactggagcttcagcgcgagccacaactacgccagccgcagcccgcgcctgtatgacgcgctgcaaacccacggcaaacgcggcatcatctcgattgccgacggcacgaaagccgaacgcgcgcgcaataccgaaatcggcttcaactacaacgacggcacgtttgccgcaaacggcagctacttctggcagaccatcaaagacgcgcttgccaatccgcaaaaccgccacgactctgtcgccgtccgtgaagccgtcaatgccggttacatcaaaaaccacggttacgaattgggcgcgtcctaccgcaccggcggcctgactgccaaagtcggcgtaagccacagcaaaccgcgcttttacgatacgcacaaagacaagctgttgagcgcgaatcctgaatttggcgcacaagtcggccgcacttggacggcttcccttgcctaccgcttccaaaacccgaatctggaaatcggctggcgcggccgttatgttcaaaaagccgtgggttcgatattggtggcaggtcaaaaagaccgcaacggcaaattggaaaacgttgtacgcaaaggtttcggtgtgaacgatgtcttcgccaactggaaaccgctgggcaaagacacgctcaatgttaatctttcggttaacaacgtgttcaacacgttctactatccgcacagccaacgatggaccaataccctgccgggcgtgggacgtgatgtacgcttgggcgtgaactacaagttctaa

SEQ ID NO: 6045 - DNA, 966 bp, Neisseria meningitidis; identical to SEQ ID NO: 901

SEQ ID NO: 6046 - DNA, 969 bp, Neisseria meningitidis; identical to SEQ ID NO: 3005

SEQ ID NO: 6047 - DNA, 975 bp, Neisseria meningitidis; identical to SEQ ID NO: 2963

SEQ ID NO: 6048 - DNA, 627 bp, Neisseria meningitidis
atgacacaagaacatttcccatcattcttcaaccaagccccgaccattaccgtccaagacgcattggccgaattcctcggcgcggccgaaaacggcatcctcacttaccgctacgccgatgccgtgcgcctgtgcggacattcctgcccgaccgtcgcgggcgcgtacctgatggttatcaaaggtctgaaagcactttacggcgaagagctgcccgaacgcggcggcatcgaagcctttatgcagggcgcgcgcgacgaaggcacggtcggcgtaaccgcgtccgtcgtccaactcctcaccggcgcagcccccgaaaccggctttggcggcatcggaatgcagggacgctttgcccgccgccacctcttatcctttggtgtaggcgaaatcaacggcacactgaccctgcgccgcaaagacaacggcaaaaccgtcgccgtcggcctcaacgccgccctgcaacccttcgcacccgaaatgcgcgacatcatgcccaaagccgtcagcggcagcgcaagcgcagaagaactcgaacgcttcggacaactctggcaggcacgcgttaaagcatttttaaccgaatcggcggacgacccgcagttcgtcatcgtccgcgaagtgtga

SEQ ID NO: 6049 - DNA, 759 bp, Neisseria meningitidis
atgattaccatccgcaacgtcagctaccgcatcggcacacgccccatcctcgacaacgtcagcctcgacatccccgaaggcggcattaccgccctcgtcggccccaacggtgcgggcaaatccaccctgttttcctttatggcgcggctgcgaccgcttgaaagcggcagcatcgcctaccgaggcaaaaatcttgccgatacccccaccgccgaactcgccaaaaccctgtccatcctcacccaagaaaacagcatcatgagccgcatcaccgtgcgcgacctgctgatgttcggccgttacccctaccatcaaggcagaccgactgccgaatgccgccgtatcgttaacggtgcaatcgaagaattccacctgcaagacctctccgaccgctacctgaccgagctttccggcggccaacgccaacgcgccatgattgcgatggtgttctgccaaagcaccgactacgtccttttggacgaaccgctgaacaacctcgatatgtatcacgcccgctcgctcatgcaaatcctgcgccggctgaccgacgaacacaagcgcaccaccgtcgtcgtattgcacgacatcaaccaggcagcagcctacgccgaccacgtcgtcgccatgaaaaacggccaagtcgccatgcagggcaaacccaacgatattttcaccgccgcaaacatcaaaaccctattcgatatggacgtcgacgtcctcgattacgaaggcaaaaaattggttatccaccatatctaa

SEQ ID NO: 6050 - DNA, 1095 bp, Neisseria meningitidis
atgagcatgaaacactttccatccaaagtactgaccacagccatccttgccactttctgtagcggcgcactggcagccacaagcgacgacgatgttaaaaaagctgccactgtggccattgttgctgcctacaacaatggccaagaaatcaacggtttcaaagctggagagaccatctacgacattggtgaagacggcacaattacccaaaaagacgcaactgcagccgatgttgaagccgacgactttaaaggtctgggtctgaaaaaagtcgtgactaacctgaccaaaaccgtcaatgaaaacaaacaaaacgtcgatgccaaagtaaaagctgcagaatctgaaatagaaaagttaacaaccaagttagcagacactgatgccgctttagcagatactgatgccgctctggatgaaaccaccaacgccttgaataaattgggagaaaatataacgacatttgctgaagagactaagacaaatatcgtaaaaattgatgaaaaattagaagccgtggctgataccgtcgacaagcatgccgaagcattcaacgatatcgccgattcattggatgaaaccaacactaaggcagacgaagccgtcaaaaccgccaatgaagccaaacagacggccgaagaaaccaaacaaaacgtcgatgccaaagtaaaagctgcagaaactgcagcaggcaaagccgaagctgccgctggcacagctaatactgcagccgacaaggccgaagctgtcgctgcaaaagttaccgacatcaaagctgatatcgctacgaacaaagctgatattgctaaaaactcagcacgcatcgacagcttggacaaaaacgtagctaatctgcgcaaagaaacccgccaaggccttgcagaacaagccgcgctctccggcctgttccaaccttacaacgtgggtcggttcaatgtaacggctgcagtcggcggctacaaatccgaatcggcagtcgccatcggtaccggcttccgctttaccgaaaactttgccgccaaagcaggcgtggcagtcggcacttcgtccggttcttccgcagcctaccatgtcggcgtcaattacgagtggtaa

SEQ ID NO: 6051 - DNA, 339 bp, Neisseria meningitidis
atgaaaaaaatcgaggcgattgtcaaaccgttcaaactcgacgacgtgcgcgaggcgttgacggaaatcggcattacgggcatgaccgtcagcgaggtcaaagggttcggcaggcagaaggggcatacggaaatctatcgcggcgcggaatacgccgtcgatttcctgcccaaaatcaaaatcgagctggtgttggcggatgatgctgtggaacgcgcgattgacgtgattgtcgaggtggcgcgttcgggaaaaatcggcgacggcaagatttttgtgctgccggttgaggaggcaatccgtatccgcacgggcgaacgttcggacgcggcagtctga

SEQ ID NO: 6052 - DNA, 3963 bp, Neisseria meningitidis
atgtctgtcgttttgcccttgcgcggcgttaccgccctttccgatttccgtgttgaaaaactcttgcaaaaagccgccgcactcggtctgcccgaagtcaaattaagcagcgaattttggtatttcgtcggcagcgagaaagcacttgatgccgcgactgtcgaaaaactgcaagccttgttggcggcgcaaagcgttgaacaaacgccaaaagcgcgcgagggcttgcatttgtttttggtcacgccccgtttgggtacgatttcgccgtgggcttccaaggcgaccaatatcgcggaaaactgcggtttggcaggcatcgaacgcatcgagcgcggtatggcggtgtggctggaaggtcgtctgaacgatgaacagaaacagcaatgggcggctttgctgcacgaccgcatgaccgaaagcgtgctgcccgattttcagacggcctccaaattattccaccatctcgaatccgaaactttctccggcgtcgatgttttgggcggcggtaaagaagctttggtcaaagccaataccgaaatgggcttggcactttccgccgacgaaatcgattatctggtcgaaaactatcaggctttgcagcgcaatccgtccgatgttgaattgatgatgttcgcgcaggcaaacagcgaacactgccgccacaaaatcttcaacgccgatttcatcctcaacggcgaaaagcagcccaaatccctcttcggtatgatacgcgacacacacaacgcgcatcccgaaggcacggtcgttgcctataaagacaattcgtccgtaatcgaaggcgcgaaaatcgagcgtttctatccgaatgcggcggaaaaccaaggctaccgtttccacgaggaagacacgcatatcatcatgaaagtggaaacgcacaaccacccgaccgccatcgcgccgtttgcgggtgcggcgacgggcgcgggcggcgaaatccgcgacgaaggcgcgacgggcaaaggttcgcgtccgaaagcgggcctgaccggctttaccgtgtccaacctcaatattcccgacctcaaacagccgtgggaacaagactacggcaagccggaacatatttcctcgccgctggacatcatgattgaaggcccgatcggcggcgcggcgttcaacaacgaattcggccgccccaacctcttgggctacttccgcacttttgaagaaaaatttgacggtcaggttcgcggctatcacaaaccgattatgattgccggcggcttgggcagcattcaggcgcagcagacgcataaagacgaaatccccgaaggcgcattgctgatccaactgggcggcccgggtatgcttatcggcttgggcggcggcgcggcttcttcgatggataccggcacaaacgacgcgtctttggacttcaactccgtgcaacgcggcaaccccgaaatcgaacgccgcgcgcaggaagtcatcgaccgctgctggcagctcggcggcaaaaacccgattatctccatccacgacgtaggcgcgggcggcctgtccaacgccttccccgaactggtcaacgatgccagacgcggcgcagtattcaagctgcgcgaagtgccgcttgaagaacacggcctcaacccgctgcaaatctggtgcaacgaatcgcaagagcgttatgtgttgtcgattttggaaaaagatttggatgctttccgcgccatctgcgaacgcgaacgctgcccgtttgccgtagtcggcacggcgactgacgacggtcatttgaaagtacgcgacgatttgttcgccaacaatcccgtcgatttgccgttgaacgtcttgctcggcaaactgcccaaaaccacgcgcaccgacaaaacggttgcaccgtccaaaaaaccgtttcacgcgggcgatatcgacattaccgaagccgcctaccgcgttttgcgcctgcctgccgtagccgccaaaaacttcctgattaccatcggcgaccgcagcgtcggcggtttgacgcaccgcgaccaaatggtcggcaaatatcaaactccagtagccgactgcgccgttaccatgatgggcttcaacacctatcgcggtgaagcgatgtctatgggcgaaaaaccgaccgtcgccctgtttgatgcgcctgcttcgggcagaatgtgcgtcggcgaagccatcaccaacatcgcggcggtcaacatcggagacatcggcaacatcaaactctccgccaactggatggcggcgtgcggcaacgaaggcgaagacgaaaaactctaccgcactgtcgaagccgtttccaaagcctgtcaggcattggatttgagcatccccgtgggcaaagacagcctgtcgatgaaaaccgtttggcaggacggcgaggagaaaaaatccgtggtttcaccgttgagcctgattatctcagcgttcgcgcctgtgaaagacgtacgcaagactgttacgcctgagttgaaaaacgtcgaagacagcgtattgttgtttgtcgatttgggcttcggcaaagcgcgtatgggcggttcggcgtttggtcaggtgtacaacaatatgagcggcgacgcgcccgatttggacgatacaggtcgtctgaaagccttttacagtgtgattcagcagcttgttgccgaaaacaaactcttggcgtatcacgaccgcagcgacggcggcttgtttgccgttttggtagaaatggcgtttgcggggcggtgcggcttggatatagatttaaatttattgcttgcacaaacatttattaccaaccataccgctctgtctcaatcattgcggactgaagaggtaaaagcgttggctgaatggcaagaaaccattgcccgcacattatttaatgaagagttgggtgctgttatccaagttagaaaacaagatgttgccgatattatcaatttattctatcaacaacagctgcatcataatgtctttgaaatcggtacgttaactgatgagaacacgttaatcatccgcgacgggcaaacgcaccttatttctgacaacctaatcaaactgcaacaaacctggcaagaaaccagccatcaaatccaacgcctgcgcgacaaccctgcctgcgccgacagcgagttcgcactgattggcgacaacgaacgcagcgcattgtttgccgacgtgaagttcgacgtgaacgaagacatcgccgcgccgtttatcaacagcggcgcgaaacccaaaatcgccatcctgcgcgaacagggcgtaaacgggcaaatcgaaatggccgccgcctttacccgcgccggattcgatgcttacgacgtgcatatgtccgacctgatggcaggccgcatccacctcgccgacttcaaaatgctggcggcgtgcggcggcttcagctacggcgacgtactcggcgcgggcgaaggctgggcgaaatcgattctgttccaccctgctctgcgcgaccagtttgccgccttcttcgccgacccggacacgctgacattgggcgtgtgcaacggctgccaaatggtcagcaaccttgccgaaatcatccccggcacggcaggctggccgaagttcaaacgcaacctgagcgaacagtttgaagcacgcctgagcatggttcacgttccgaaatcagcgtcgctgattctgaacgaaatgcaaggctccagcctgcctgtcgtggtcagccacggcgaaggccgcgccgacttcgcgcttcacggcggcaatatttccgccgatttgggcattgcgctgcaatacatcgacggacaaaaccaagtgacccaaacttatccgctcaaccccaacggctcgcctcaaggcatcgccggcgttactaacgccgacggccgcatcaccatcatgatgccccaccccgaacgcgtgtaccgtgccgcgcaaatgagctggaaaccggaaggctggacggaactgtccggctggtaccgcctctttgccggcgcacgtaaagccttgggctaa

SEQ ID NO: 6053 - DNA, 759 bp, Neisseria meningitidis
atgaaaatcacccccgtcaaagccctaaccgacaactacatctggatgatacagcacggcaaccatgccgtctgcgtcgacccttccgaaccctcgcccgtcttggaattcctcgtccgcaaccgcctcatgcttgcccaaacatgggtaactcacccccatcccgaccacgagggcggtgcggcggcactctggcgcggctacatggaatcgcccgtttacggcgaatccgacatcgaagcagcaacccacaccgtaaccgccggcacccaattcaccttcggcgacggacaggttaccgtttgggcaacacccggccacacagaccgccacaccagctaccttctcgaaacttcagacggcatacacgtcttttgcggcgacacccttttttccgccggctgcggacgcgtgtttaccggcacaatcgaacagctttacgacagcttccaacgcttcaaccgcctgcctgaaaacaccctgttctatccggcgcacgaatacaccgccgccaacctgcgtttcgccgcccatatcgagccggacaacgccgacattcagacggcactgaaagcggcggcgcatacgcctaccctgcccgttaccctcgcgcacgaacgccgcgtcaatccgtttttgcgcgtcgacctgccgcacgtcagagaccgcgccgaggcattgagcgggaaaacgttaaacagcagcctcgatacctttgtcgcgctgcgtgaacttaaaaaccaataccggacgaaataa

SEQ ID NO: 6054 - DNA, 4296 bp, Neisseria meningitidis; identical to SEQ ID NO: 3583

SEQ ID NO: 6055 - DNA, 1455 bp, Neisseria meningitidis
atgagcatcgaaccaacccctccgaaccttgaaaacgacggtatcgaaaacgatgtagaacgcgtttccgccgatttcgaccgtgtccactccctctgcgaaatcctcgaacctgcttttgaacaaatcgaaaacggtacaccgctcgaagacgcgccgctgcgcgacaagctgaccgagctgaccgtcctcttgagcgagctgcaccctgccgacgtggcggcggtattggaatcgctaccgccgcgcgaacgcaatatcgtctggattctggtcaaaccggaagacgacggcgaagtattgctggaagtatccgacgcggtgcgcgaaacgctgatcgagtcgatggacaaagacgaattgttggcagcggtcgatgatttggacgcggacgaattggcggaactggcagacgatttgccgcaccaagtggtttacgaagcgctacaaacccgcgatgaggaagaacgcgcccaagtcaaagcggcaatgtcctacgaagacaaccaagtcggtgcgattatggacttcgagttggtcagcatccgcgccgatgtcgcctgtgaagtggtgctgcgctatctgcgccgcttcgacagcctgcccgaccataccgacaagatttttgtggtcgatgaaaacgacgtactgcagggcgtgctgcccatccgcaaacttttggtcgccgatcccgaagacttggtggaaaacgtgatggcgaaagatgtcgtgcgtttccgcgccgaagatgacgtggaagaagcggcgcaggcgtttgaacgctacgacttggttaccgcgcccgtcgtcgatgaaaacaaaaagctcatcggcaggattaccatcgacgagatggtggacgtgatccgcgaagaatcggaagcggatatgctgaatatggcgggtttgcaggaagaggaagacctgttcgcccccgtgtgggattcggtgaaaaaccgctggatgtggctcgccgtcaacctctgcaccgccttcctcgccagccgtgttatcggcgcgtttgaaggcagcatcgaaaaaatcgtcgcactcgccgcgctgatgcccatcgtcgccggcataggcggtaactcgggcaaccagacgattaccatgattgtccgcgcgatggcgatggggcagctgacggatatgcaggcggggcgtttgctgaaaaaagaagtcggtgtcgccttggtcaacggcatcatttggggaacggtcatgggcgcagtatcttggctgctttacggcagcctcggcatcgggctggttatgattgccgcgatgacgctcaacctcctgctggcggcaaccgtcggcgtattaattcccgtggtaatggaaaagttcggacgcgatcccgcactgggcagctcggtgctgattaccgccgttaccgactccggcggcttcctgattttcttggggctcgccaccctattcctgctttaa

SEQ ID NO: 6056 - DNA, 909 bp, Neisseria meningitidis
atgaatcaaaccgccatcaaccgcgccgatgtgcgtacccgctttatcttcgacgatatgcccgtgcgcgggctgcacgtccgtctggaaaacgtgtggcagcacattgtaaaacagaaaaactatcccgccgccatccgccgcgctttgggtgagttgttggcggcgggtgtgttgctgtcgggcaacctcaaaaacgaaggcacgctgattgtgcaggttcaggggcgggggcggctgaaaatgctggttgcggaagcggcttccgaccgtaccgtccgtgcaaccgcgcgttgggacgaaaccgcagaaatagccgatgacgaaagcctcggcgaccttttgggcgagggcggcgtattcgtgctgacgctgcagcccaaagacggcgaaccctggcagggcgtagtgcctttggaaggcggcggtatcgcgcaaatgttggtgaactatatgaaacgttccgaacagcttgatacgcacatcgtcctgtctgcaagcgacgaagcggcgggcggtctgctggtgcagcgtctgcctgaagaggtattggatgaagaggcatgggaacacgtcagtacgctggcgcgcacgctgacggcggaggagctggcaggactggacgcgcaacacgttttataccgcctgttccacgaaacgccgccgcgcgtgttcgagccggaaacgtttgaattttcatgcacctgttcgcgcggcaaagtcagcgatatgctgttgatgctgggcggggaagaagtcggcggcgtggtggtggaacaaggcagcatcgaagtcgattgcgatttctgccacagcaaatatgtgtttgacgaaaccgatgtcaacgcgctgttcggggaggatgtggtcggcgttgccaaagggctgccccggcataccgtccaataa

SEQ ID NO: 6057 - DNA, 756 bp, Neisseria meningitidis
atggattcttttttcaaaccggcagtttgggcggttttgtggctgatgtttgccgtccgccccgcccttgccgacgagttgaccaacctgctcagcagccgcgagcagattctcagacagtttgccgaagacgaacagcccgttttacccatcaaccgagcccccgcccggcgggcgggcaatgccgacgaactcatcggcagcgcgatggggcttaacgaacagcccgttttacccgtcaaccgagtccccgcccggcgggcgggcaatgccgacgaactcatcggcaacgcgatggggcttaacgaacagcccgttttacccgtcaaccgagcccccgcccggcgggcgggcaatgccgacgaactcatcggcaacgcgatgggacttttgggtattgcctaccgctacggcggcacatcggtttctaccggttttgactgcagcggcttcatgcagcacatcttcaaacgcgccatgggcatcaacctgccgcgcacgtcggcagaacaggcacggatgggtacgccggttgcccgaagcgaattgcagcccggagatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatacgcgttcgcccgccgggtcaagaaaaacgacccgtcccgctttctgaactga

SEQ ID NO: 6058 - DNA, 219 bp, Neisseria meningitidis
atgagtatgcccgaaatgcccaaatggtacgacgatgacggacagatcgtgtcctgtaccgaaaaggtcaaagtgatgtccgaaaatatggccgagctgtatcagacggcacaagacgcgtttgaagacgcgctgctgatgggttgcggcgaacgtcagttgcgcgattacctgctcgcgctgattgaaggtttggaaaatccctaccgcaaagtctga

SEQ ID NO: 6059 - DNA, 348 bp, Neisseria meningitidis
atgaacatcatccgcgcgctcctcatcatcctcggctgcctcgccaccggcgaaaccgccgttttcctagcaggcatcaaactgcccggcagcatcgtcggcatgggcgtgctgtttgcgcttttgcaggcgggttgggtcaaaacgtcttggctgcaacagcttaccgacgcgctgatgtcgaacctgacgctgttcctcgtgccgccctgcgtggcggtcatcagctatttggatttgattgccgacgattggttttcgatactggtttccgcctccgccagcactttgtgcgtactgctggttacgggcaaagtccaccggtggatacggggtattatccgatga

SEQ ID NO: 6060 - DNA, 693 bp, Neisseria meningitidis; identical to SEQ ID NO: 1789

SEQ ID NO: 6061 - DNA, 1221 bp, Neisseria meningitidis
atggctgtcaacctgaccgaaaaaaccgccgaacaactgcccgacatcgacggcattgccctctacaccgcccaagcaggcgtgaagaagcccgggcataccgacctgacactgattgccgtagccgccggcagcaccgtcggtgcagtcttcacgaccaaccgtttctgtgccgcgcccgtccacatcgccaaatcgcaccttttcgacgaagacggcgtgcgcgccctcgtcatcaacacgggcaacgccaacgcgggtacgggcgcacagggcagaatcgatgctttggcagtgtgtgccgccgccgcccggcaaatcggctgcaaaccgaaccaggtgctgcccttctccaccggcgtgattctcgaaccgctgcccgcagacaaaatcatcgccgccctgcccaaaatgcagcctgccttctggaacgaagcggcacgcgccatcatgaccaccgacaccgtgcccaaagccgcctcgcgcgaaggcaaggtcggcgacaaacacaccgtccgcgccacgggcatcgccaaaggctcgggcatgattcatcccaatatggcgaccatgctcggtttcatcgccaccgatgccaaagtttcccaacccgtcctccaactgatgacgcaggaaatcgccgacgaaaccttcaacaccatcaccgttgacggcgacaccagcaccaacgacagcttcgtcatcatcgccaccggcaaaaacagccaaagcgaaatcgacaacatcgccgacccgcgttacgcccaactcaaagaattgttgtgcagcctcgcgctcgaactcgcccaagccatcgtccgcgacggcgaaggtgcgaccaagttcatcaccgtccgcgtcgaaaacgccaaaacccgcgacgaagcccgccaagccgcctacgccgtggcacgttcgccgctggtcaaaaccgcctttttcgcctccgaccccaacctcggcaggctgctcgccgccatcggttatgccggcgttgccgacctcgataccgacctcgtggaaatgtatctcgacgatattttggttgccgaacacggcggacgcgccgcaagctacaccgaagcacaagggcaggcggtgatgtcgaaggccgaaatcaccgtccgcatcaagctgcatcgcggacaagccgccgccaccgtctatacctgcgacctgtcgcacggatacgtttccatcaacgccgattaccgttcctga

SEQ ID NO: 6062 - DNA, 1410 bp, Neisseria meningitidis
atgacctccacattcccccgccgcctcgcccgcaaaatccgccaaacccgccgcctgtcgcgcaaaagcatcgcctttctgttccttttggcaggttcggcactcgtcgccctgaccgcgctgttttttgcccatcttgccgattttgcgctggaactgaacgccaaactggttcaacaatacccgtggttcgcgtgggtcgcgcttcctttgggtttaccgcttattgcgtggctcacacgcaaattcgcccccttcaccgccggcagcggcatcccgcaggtcatcgcctcactgtcgctgccctacggcgcacagaaaacgcggctgatccgcctcgggcagacgctgctgaagattccgctaacctttttgggtatgctgttcggcgcgtccatcggacgcgaaggtccgtccgtgcaggtcggcgcggcagtgatgggcgcgtggggcgcgtggtgcaagaaacacggcttggcattcaaagggatgcaggaaaacgatttgatggcggcgggcgcggcgggcggtttggcagccgcgttcaacgcgccgctggcgggcgtgattttcgccattgaggaactcgggcgcggcatcatgttgcgctgggagaggcaaattcttttgggcgtgctcgcctccggtttcatacaggtcgccattcagggcaacaacccgtatttttccggcttcaacggcggcgtattggaacatatctttctgtgggtcgcactgtccggcctggtttgcggcgcggcgggcgggctgttcggacgtttgctctatcgcggtgcggcggcgtttgcaccgcgcaagatacgcggcttcatccgcaaccgtccgctgctgctggcggcactgatggggctgctgctcgccctgctcggcacgttctaccaaggcaaaacctacggcaccggctaccacgaagccgcccaagccctgcacggcatctacgaagcccccttcggactcgccgccgccaaatggctcgccaccgtattcagctattgggcaggcgttccgggcggcattttcactccctcgctgaccataggcgcggttttgggcgagcatatcgccgccatcgccgacatatcgcagggtgcaaacatcatcgtcctcatctgcatggcggcatttctggcgggcgcgacacaatccccgattacttccgccgtcgtcgtcatggaaatgacgggcggacaaagcctgctgttttggatgctaattgcctgcattttcgcctcgcaggtttcgcgccagttttcgccgcgtccgttctaccacgcatcgggaatgcgcttccgccagcgcgtgcttcaagaaaccgccgcccaaaccggcaatgcgcccgcaagaccgcaaacagcaaacagcaaaacgggaatgccgtctgaaaattaa

SEQ ID NO: 6063 - DNA, 1392 bp, Neisseria meningitidis
atgtttcccgatttctcccaaaccctctccaaagaccgccacttcctgcgttccgccttcaaaaatcccaacaaatacggcggtttgtccaaaatcgaagaaaaataccgaaaatcgcacgaaatctttttgaagcgtttggcagccttgccaaaacccgaattcgacaacaccctgcccgttcacgagaagctcgaagaaatcaaaaaagccattgccaagaatcaggtaacgattatttgcggcgaaaccggttcgggcaaaaccacgcagttgcccaagatttgcttggaactcgggcgtggggcggcaggattgatcgggcatacccagccgcgccgtttggccgcgcgctccgtagcagagcggattgccgaagagctgaaatccgaaatcggcagcgcggtcggctataaagtacgcttcaccgaccacacctcgcgcgatgcctgcgtcaagctgatgaccgacggcatcctgctggcggaaacgcagaccgaccgttatctcgccgcctacgacacgattatcatcgacgaagcgcacgagcgcagcctgaacatcgacttccttttgggctatttgaaacaactcctgccgcgccgccccgatttgaaagtcatcatcacctcggcaacgatagacgcagaacgcttctcccgacacttcaacggcgcgcccgttttagaagtgagcggacggacgtatcccgtcgaaatcctctaccgaccgctgaccggcaaagacgaagacgacgcagaagtggagttgaccgacgcgattgtcgatgcggcggacgaattagcgcgacacggcgaaggcgatattttggtattcctgccgggcgagcgcgaaatccgcgaaactgccgaagccctgcgcaaatccacgctgcgccgcaacgacgaaatcctgcccctgttcgcacgcctgtcgcacgccgagcagcacaaaatcttccacccctcaggcgcgaaacgccgcatcgtattggcaaccaacgtcgccgaaacctcgcttaccgtgccgggcatcaaatacgtcatcgacaccggcctcgcgcgtgttaaacgctattccgcacgggcgaaagtggagcagcttcatatcgaaaaaatctcccaagccgccgcccgccaacgatccggccgctgcggacgcgtctccgcaggcgtgtgtatccgactgttttcagaagaagattttaacagccgccccgaatttaccgaccccgaaatcgtccgcagcaacctcgccgccgtcatcctgcgcatggcagcattgaaactcggcgatgtggcggcattcccgtttttagaaatgcccgattcacggtatatcaatgacggttttcaggtgttgttggagttgggggcggtggaggccgtctga

SEQ ID NO: 6064 - DNA, 1644 bp, Neisseria meningitidis
atggacgaaattcaaatacccaaaaaagtggaattacaaaccaaactagaaaatgaaaagattgttttatcgaaaggttctaccacgattattgttggtgctaatggcacagggaaaacaagattagctgtttatattgaagaacaattaaaggaaaaagcacacagaatttcggctcatagagcattaaaattaaaccctaatgtcaataaaataccagaaaagagtgccaaaacatatctatcttatggtcagaactgggatggaatcgatgtatcaaatagaaaaaattatagatgggataataactcatatactcatttactcaacgattttgattggttattacaatatttattcgctcaacaaaataatattgcggtagcaaataatcaaaagctcaaccgtaatgaaaaagtaaccaattcaaaaacaaagctagatattttgcaagaagcatgggaaacattattaccacacagaaaattacatattacagcagatgatattcaagtctctgctgtagataatgaggaattgtattctgcctcaaatatgagtgatggagagcgagcacttttctatattcttggacaagttttgtcagtagatgacggttctgtcttaatttttgatgagcctgaattacatattcataaatcaattatttcaaatctatgggataaaattgaagaattacgacctgattgttcatttctaatcattacacacgatattgaatttgctgcaactcgagtagctaaaaaatatgttatcagaaattattatccgacccctgcttgggatatttctgaagttcctgaaagtaattttgatgaagaaacaataacgatgattttaggtagccgtaagccaatattatttgttgagggcaacaataatagtttagatattgctacttaccgctattgttatcctgattggaccatcatacccaaaggggcatgcaaagatgtcattcaatcagtatcatcgctgaaaaaattaagtaatgaaatgccattactaaacttaaaatgttcaggtattgtcgatttagatagtagggatgaaagagaaattgaacaattaaataatttgggtatttacattttacctgtatccgaaattgaaaatctttttagcttaactgatgtagcaaaagagatattgaaactaaatcaatattcagatgaagaattactcaataaacttaatggatttaaatccgaactaattaaatatatagataatgaattaaaagacgataaattagacgaatttgttgtaaaacaggttcgacgtaaaattgataattatttaaaaaatattgatttatcctccaaaataacaagtactgatatgaaaaaatcattacttaatgaaatttctactttaacagaacagaaaattgaaacatggatttcagaaattaaaaatgaaattcaaagatgtattgaacagcaagatttggataaattacttactatatatgataataaaggactcttggctaaatcagcttgtgttttaaaaggaatgcgtaacaaacatgaatttgaaagctggataatgagaacattaaaaggaaggaataaagattttattgatgcaatcagacagaaacttccaattctggattaa

SEQ ID NO: 6065 - DNA, 183 bp, Neisseria meningitidis
atgaaaaatcatcaaactacactctctttccctacttcgagtagcctgaaaccttgcgcagacaaacaaggcctgtctgaagaccgcagccaataccgcctgaccaaactcggcgaacaaatggcgcacctgcctatcgacccgaaaattgcgcgtattttgttagtattattccgtttttaa

SEQ ID NO: 6066 - DNA, 1578 bp, Neisseria meningitidis
atgatgaaaaaatctttccttacgcttgttctgtattcgtctttacttaccgccagcgaaattgcctatcgctttgtatttgggattgaaaccttaccggcggcaaaaattgcggaaacgtttgcgctgacatttgtgattgctgcgctgtatctgtttgcgcgttataaggtgacgcgtttgttgattgcggtgttttttgcgttcagcattattgccaacaatgtgcattacgcggtttatcaaagctggatgacgggcatcaattattggctgatgctgaaagaggttaccgaagtcggcagcgcgggtgcgtcgatgttggataagttgtggctgcctgtgttgtggggcgtgttggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcggacgcgtgttgccgtatcagttgtttgatttaagcaggattcccgcctttaagcagcctgctccaagcaaaatcgggcagggcagtgttcaaaatatcgtcctgattatgggcgaaagcgaaagcgcggcgcatttgaagctgtttggctacggacgcgaaacttcgccgtttttaacccggctgtcgcaagccgattttaagccgattgtgaaacaaagttattccgcaggctttatgactgcagtgtccctgcccagttttttcaatgcgataccgcacgccaacggcttggaacaaatcagcggcggcgataccaatatgttccgcctcgccaaagagcagggctatgaaacgtatttttacagcgcgcaggcggaaaacgagatggcgattttgaacttaatcggtaagaaatggatagaccatctgattcagccgacgcaacttggctacggcaacggcgacaatatgcccgatgagaagctgctgccgttgttcgacaaaatcaatttgcagcagggcaagcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgttcgccaagatatctacaatcaaggcacggtgcagcccgacagctatctcgtgccgctagtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatga

SEQ ID NO: 6067 - DNA, 3420 bp, Neisseria meningitidis
atgcaaaatatgaaaaaccaagtacgcggatcaggcatggatgcccgatccaatccggccaatgtttcagacggcctgcaaaacagttcgggtcatatcggtaccaacacgcgttaccgcctgaccaaactcggcgaacagatagcgcgcctacccatcgacccgaaaatcgcgcgcattttgctggcggcgaagaaacacgactgcatggcggaaatattggtgattgcgtccgcgctgtcgattcaagacccgcgcgagcggccgctagaagcgcgcgatgcctcagccaaggcgcacgagcgttttaccgacaagcagtccgatttccttgcctatctgaacatttgggacagcttccagcgcgaacgcgataaaggcttgtccaacaagcagctggtgcagtggtgccgccaatatttcctgtcgcacctgcggatgcgcgagtggcgcgagctgcaccaccagcttgcccaaaccgcgattgaaatgggtttaaccaccaaggaagccgctttcagacgacctcccgaagtcaggcagctcacgtcgtctgaaaatgcgggtgaccaagacctatctgctaaactcaaacaaaaacaactggataaaaagcaacaccgcgcccaaatccgcgccgccaaagaagcgggctacgaacaaatccaccgcgccctgctcactggccttatcgccaacgtcggcatgaaatcgcccgacggtaacgactacaccggcgcgcgcggcagccgcttccaccttttccccgcctccgccctgttcaaagccaaacccaaatgggtgatggcggcagaattggttgaaaccacgcgcctttacgcgcgcgacgtcgccgttatccagcccgaatggatagagcaggaagcgccgcacctcgtccgctatcattatttcgagccgcattgggaacaaaaacgcggcgaagtcgtcgccagcgaacgcgtgacgctttacggtctgaccgtattgccgcgccgccccgtgtcttacggcaaagttgcccccgaagaagcgcgcgaaatctttatccgcagcgcgttggtggcgcaggaatgcgatttgaaagcggatttttttgtccacaacaaaaagctgattaaagaaattaccgaactcgaacacaaatcgcgcaagcaagacgtgctggtcgatgacgaagccctgtttgcgttttataacgaacgactgcccgaaatggcttggaaagacgcgcaaggcagcgtttggggaagtgaagattccgtacggattattgaatctgacaaagccgagaggtcgtctgaaaatgagcgcaacgagtttcgtaaaaacaagcgtaatgggtctcgccaaaatgaaaatcacggcaacaccgtaggttgggttgaaaacccaacatcagccgcaactgcaaaaactgttgggtttgacaatccaacctacgctgcccaacaaaccaccccctcccccgtgggggagggtcggggagagggcaaaacagttgccgcacaaaccaacttttccgcaaccgcagcaaaccctctccctaaccctctcccgcaggagagggaacagagtgccgcagcttcaacgatttcagacgacctgcgtcctgcaaatctgcagcaaaccgccccctcccccgtgggggagggctggggagagggcaaaacagttgccacacaaaccaacttttccgcaacctcaacaaaccctctcccgcaggagagggaacagagtgcctcagcttcaacgttttcagacgacctgcgtcctgcaaatctgcagcaaccctctccctcccccgtgggggagggctggggagagggcaaaacagttgccacacaaaccaacttttccgcaacctcaacactttcagacgactccaaacccaaaaagcagcctgcaccccaaaaaaaccgtctgaaacccctacccctcgccgacatccgcaccttccaagcctggctcaaaaccgccgagcgcgacaatccgcgcctgctgttcctcagccgcgacgatctgatgcaacacgccgccgcacacattaccgaagaacagttccccaaattctggcaaaccgcagacggcaaattcaaactttcctaccgcttcgagccgcaccatccgctagacggcgtgaccatgaccgtgccgctgaccgtcctcaaccgcctgcacgcgccgtcgctcgaatggctggtgcccggcatgatacgcgaaaaaatccagttgcaaatcaaagcactgcccaagcaaatccgccgcatctgcgtgcccgtgcccgaattcatcacccaatttttaagccaaaaccccgaccgcaacgcccccatcctgccccaactcgcccaagccatcgccaaaaccgcaggcgacatccgcatattcgagcaaatcaaccaagacgaatgggccgcgttcaggctgcccgaacactgctatttcaacctccgcattatcgacgacggcggacaagagcttgccggcggccgcaaactgcacgaattgcaacaacaactcggtcaagctgccgccgttaccttccgtgacaacacccaagaatttgagcgcgacaacgtcaccgcatgggacatcggcaccctgcccgaatccatcaaattcgcacgcggcaaacaacagctcaccggctatctcggcctacaaaaagaaaaagacggccgcatcgccctgcgcctgtttgataccacagaagccgcagagcaggcacaccgtcaaggtgtcatcgaattgatgaagctgcaattaaaagagcaggtaaaggatttgaacaaaggcatccaaggcttcacccaagctgccatgctgctcaaacacatcaacgccgacactctgcgcgacgacctcacccaagccgtctgcgaccgcgcctttatcggcgaagacgagctgccgcgcaacgaaaaagccttcaaagaacaaatcaaacgcgcccgcagccgcctgcccgccgtcaaagaagccctcagccgctacctgcaggaaaccgccgccgtctacgccgaactcaacagcaaactcggcaaacacccattgacccaccttctaagactacgcctgcaaaccctgctcgccgccggcttcgccacccgaaccccgtgggcacaatggccgcgcctccccatctacctcaaagccatgaccctgcgcctcgaaaaatacagcagcaaccccgcccgcgacgcagcccgcgaagccgatatccaagagctggaacaaatgtggcaggaaaaaacagacagcctgattaaacaaggtctccccatttcagacggcctcgccgcgtttaaatggatgattgaagaattgagggtgtcgctgttcgcgcaggaattgaagacaccgtatccggtgtcggtgaagcggctgttgaaagagtgggaaaaaattgaaaaataa

SEQ ID NO: 6068 - DNA, 1092 bp, Neisseria meningitidis
atgcagacatttaatcgtgagagactggaatttgcgctggataaacgtggttgtacgcaaacaaaattagctgagttattaggtattaccgctcgacaggttagaaactatgtaaaagatgagcaaatacctgatttaaatgaattagccaatttattagagtttccagttcatttctttactaatgacgaaagactgcctgagttgaaatctcaggcagtaagttttcgtgctcgttcacgcacctcgaagaggcttgaaaaacaagcattaaatcatagcattacggcttttttgttaaatgactggctcgagacagaatttacactaagtcaagccgtattgcctgatttttctgatatttctcctgaagaggctgctcaggaactaagattagaatgggggcttggcaatgaacctattccgaatatgatcaccctacttgaagttaagggtgttcgtgtattttcattatctttagatacaaaggacattgatgccttttgtacttggtatgaaaatcatccatttgtatttttaaatacacaaaaatctgcagaacgtagtcgatttgatgctgcccatgaattagggcacttaatccgtgataaatacagtatggaacatagtaaaaatagtgaaattacagaagatgaacctcgtgatattatcgaaaaagaggctaatgcctttgcttcagcttttttaatgccggaggctgcactacgcttatatcgtcatgttcctatcactattgaaaatttattaaaaatcaaaagacgatttggtgtatcacttgttgccttagcatatcggatgcataaattaggaatgattactgataggatgtatatacacaatctttgtcctttgtttgcaaagaaaaaatatcgaactatcgaaccagagccaatggaaagggaaatatcaagcgcattacgtaaaatgcttactattttaaaaaatgatggcattggtattgaacagattgctgaaaatttaaacgtatcccccaaagatgttgctgatttaacttttggattagttgagagggacttaaatagatataggaaacttcgattagtcaaataa

SEQ ID NO: 6069 - DNA, 645 bp, Neisseria meningitidis
atggtggaatttgcattatcagaacctttcccatttgaagtaggagaaatagtcgagcaacaaaatagtgatattgctttaagtgaaatcagcaagtacttatctcaggagatgcttaaagagattgtacttactgcgcataataatattcaggacaaagcagcattatctgacagaaatacattggggatgtatcggcaagcagaaattacatttgctctaagggtatatttaagtaaagatggctggacgcttgagccttggtcgggtggtgcatttctatgtctctcgccatgtcgaactaaaagtattattgtggctactgctacttcagatgttggtaggcatcacgggatgccaatgacaaccgcaaggaaaggtaagggatttgaggaggctattcgtaattcaaaactagatttgcctgatactgtgcagttttgggttctgctgtttcactggaagtataataaagtgcaacttgaattatctttaccgagtggttttgttagtcatcaaataactgggtacaagcagcgaattatattagctgatgttgatttaactaaatttgatgagcttgaacgtaagcaacctgttgaagaatatgagcctttggttgaaagaaaacaaaaagcaggataa

SEQ ID NO: 6070 - DNA, 249 bp, Neisseria meningitidis
atgagaagtttactggttcgggcgatgtttggggagaggatggtgggaagatttgttttacaaagtggcaaaaggtcgtctgaaaatagggttcagacgaccttttggtttagttgggaagggctgtggtttaaaaagactgcgtgcgtatgtaccgcacacaccctacacacggattccaagttttgcgtgatttgcaggtcgggtgtgccgaaagataaggacacggttgggcaggctacttattaa

SEQ ID NO: 6071 - DNA, 270 bp, Neisseria meningitidis
atgagtaatgtacacccttatacaatttttgctactatgccccataaatccacggctaaagatatccttattatgtcctatgatttatcgaaacgacttgtaatcggcttagcatcaagtgccctattcgacttatccgaatcggataatatatttagaatggaaggggcagaaacctataggcaatatcagagagaaaaacaaaaccatcccctaaaaaaggcgttgtctttccatttattaaaaaacttctgtcaatcaatgaaataa

SEQ ID NO: 6072 - DNA, 450 bp, Neisseria meningitidis; identical to SEQ ID NO: 821

SEQ ID NO: 6073 - DNA, 447 bp, Neisseria meningitidis
atgtcggtgatggcgggacggcatccgtacggtgtccggtcgggtttgcggaggaacggcttgaaactttgggatattcattttagaatgactcgttttatcgtcgcaagatgcggtttattgtttgcaacccttaaaggaaaaaccatgaagaaaatgttcgtgctgttctgtatgctgttctcctgcgccttctcccttgcggcggtaaacatcaatgcggcttcgcagcaggagttggaggcgctgccgggcataggcccggcgaaggcgaaggccattgcggaataccgtgcgcaaaacggtgcgttcaagtctgtagacgatttgaccaaggtaaagggcatcggccctgcggtgctggcgaagctgaaggaccaggcttcggtcggcgcgcccgcaccaaaaggcccagccaaaccggctataccggccgctaaaaaatag

SEQ ID NO: 6074 - DNA, 663 bp, Neisseria meningitidis
atggatatgttggaaattttgttccgccatcaagacttcgtcgccatcaacaaaccgggcggcatatccgtccaccaagacagcggcgagaccggactggcccgaacactcgccatacagttgggcgtagagcgtgtgtggctgctgcaccgattggacaaacagaccagcggcattttactgtttgccctcaacaaagaaagcgcgtccgcccttagcggacagtttgccggcaaaagcatcaaaaaaacctatttggcactgtccgaccgcaagccgtccaaaaagcagggttggattaaaggcggaatggaaaaatccagatgtggaatgtggaagttgacgcgcaatacagaaaatatcgccgttacccgattccacagcatcagtatcgccgaaaaactgcggctgttcatcctagaaccgcatacgggcaaaacgcaccaattgagagtggcgatgaaaagtttgggcagtccgattctgggcgacagcttatacggcggaacagaatccgaaaccatgtttctgtatgcatggaaaatacaatttgactaccaaaaccgacaaatcgaaattgttgcacccttaaaaaacgaatggcagactgaaaatatccatcgggcactggaagaattctgtatggaaaataaaattgactga

SEQ ID NO: 6075 - DNA, 513 bp, Neisseria meningitidis
atgttaccgaatacaccgcgccgcgccgtttatgccggcagtttcgatccgcccacattggggcatctgtggatgatacggcaggcgcaatctatgtttgacgaactcatcgtcgccatcggcattaaccccgacaaacgcagcacctataccgtcgctgaaaggcaggatatgttgtgcgatattactaaaatgtttcccaacgtcagaaccgatgtatttgaaaaccgatttctggtgcattacgcccgtgaggtagatgcaggattcatcgtgcgcggcatccgttctgcttcggattacgaatacgaacgttccatgcgccatatcaacagcgacctcgcccccgaaatatccaccgtattcctcatgccgccgcgcgaaatcgccgaagtgtcgtccactatggtcaaaggactggtcgggccggaaggctggacggaaacgatccaccgctacgtgccgcaagctgtgtacgaaaaaatccttgccgaacatcaacacgaaaattga

SEQ ID NO: 6076 - DNA, 684 bp, Neisseria meningitidis
atgcaacacgacgtttacgactacaccgcgcatacggtttctaaaaacaccgtcctgcagaaaacctaccgcctgctcggattttcatttattccggcttccgcaggcgcggcacttgccgccaatgccggtttcaatttttacgccgccttcggttcgcgctggatagggtttgccgtcgtgttggcgtttttctacggtatgatccacttcatcgagaaaaaccgttacagcaataccggcgttaccctgctgatggtattcacattcggtatgggcgtattgatcggccccgtgctgcaatacgcgctccatattgccgacggtgcgaaaatcgtcggcattgccgccgcgatgaccgccgccgtctttttaacgatgtccgccttggcgcgccgaacccggctcgatatgaacgcgctcggacgcttcctgaccgtaggtgcggtcattctgatggtcgccgtggttgccaatctgtttttgggtattcccgcactcgccctgaccatttccgccggttttgtcttgttcagttccttaatgattatgtggcaggtacgcaccgtcatcgacggcggcgaagacagccacatcagcgcggcactgacactgtttatctcgctttacaacatcttcagcagcctgctgaacatcctgttgtctttaaacggcgaggattga

SEQ ID NO: 6077 - DNA, 267 bp, Neisseria meningitidis
atggcacgcatggtattctgcgtcaagctcaacaaagaagccgaaggcatgaaatttccgccgcttcccaacgaattgggcaagcgcatttttgaaaacgtatcgcaagaagcgtgggcggcgtggacgcgccaccaaacgatgctgattaacgaaaaccgtttaagcctcgccgatccgcgcgcgcgcgaatacctggctcagcagatggagcagtatttcttcggcgacggcgcggatgccgttcagggatacgttccgcaataa

SEQ ID NO: 6078 - DNA, 471 bp, Neisseria meningitidis
ttgaacatcaccgttttggcagtcggcaccaaaatgccgcgctgggttgatgaggccgtcgccgaatacgccaaacgcttcggacgcgacgtcgcctacgcactcaaagaaatcaaacccgaaaaacgcggcgcgggcgtgaatgccgcccaaggtatggcggcggaagaaaaacgcatccttgaagccattccgcaaggcgcgttcctcgtcgttcttgacgaacgcggcaaagcaccgacctccgtcgagctggcggaacacctcaaaagctggcggcaaaacggcgaacacgtctgcttcgtcatcggcggcgcggacggcatgaccgaccgcctcaaacagcaggcacgcatgatgatgcgcctgtccagcctgaccctgccgcacggcatggtgcgcgtctttctgaccgagcagctctaccgcgccgtttccatcctgcacaaccatccctatcatcgggaataa

SEQ ID NO: 6079 - DNA, 387 bp, Neisseria meningitidis
atgaacgaacaagaactgcaagacctgcaaaaaatggtcggggtcgccgtcaacgccctcggagacatcaaagccaaagacatttccgttctcgaaacccaagacaaaacttcgctgtttgccagaatgattatcgccagcggcgacagtacgcgccaagtcaaagcactggccaacaacgttgccgtcgatttgaaagaagccggttttgaaatcctcagtaccgaaggcgacagcggcgaatggacgctggttgatgcaggagacctcgtcgtccacgtcatgctccctgccgtgcgcgacttctacgacatcgacaccctctggggcggcgagaaaccgagtttccacgccggaatgcagaagccgtggcacgcggcagactga

SEQ ID NO: 6080 - DNA, 606 bp, Neisseria meningitidis
atgaagaaaatcggattgttcggcggtactttcgacccgatacacaacggacatcttcatatcgcccgtgcctttgccgacgaaatcggcttggacgcggttgttttcctgccgacaggcggcccgtatcacaaagacgcagcctccgcttccgccgccgaccgccttgccatggtcgaattggcgacggcagaagacgcgcgttttgccgtcagcgattgcgacatcgtccgagaaggtgcaacctatacttttgataccgtccaaatcttccgccagcagttcccatccgcgcaactctggtggctgatgggcagcgacagcctgatgaagctgcacacatggaaaaaatggcagatgctcgtgcgcgaaaccaatatcgccgtcgccatgaggcagggcgacagcctgcaccaaaccccgcgcgaactgcacgcgtggctgggcaagtcccttcaggacggcagcgtccgcatcttgtccgccccgatgcataatgtgtcgtcaacggaaatccgccgcaaccttgccggccaaggcgtttcagacggcatcccgcctgccgccgcacgctacatccgcgaacacggtttgtatgaaaaataa

SEQ ID NO: 6081 - DNA, 600 bp, Neisseria meningitidis
atgagcgagttggataacatccttgcccataaccggcagtttgtcgagtcgggcgaatatgaaaaatactttaccgacaaataccccgaacgcgggctggcagttttgtcctgtatggatgcgcggattatcgggctgctgcccgacgcgttgggtttgaaaaacggcgatgccaagctgattaaaaatgccggcgcgctggttacgcacccgtggggttcggtgatgcggagccttttggttgccgtgtttgaactgaaggtcagagagattatggtcatcgcccatcacgattgcggtatgcaggggctgaatgccgaagaattcctcgggcgcgtccgggaaagccggattcccgaagaccgtatcgaaaccctgcgttatgccggtatcgacctcgacggctggctgaccggtttcgacaacgtcgaagacagcgtgcgccacacggtggaccttatccgtaaccatccgctgatgccgcgccatatcgccgttcacggactggtcatccatcccgttaccggcaaactgacgctggttgtggacggcagtgtttcagacggcatggacttatcggaaggaatggaaacatcatga

SEQ ID NO: 6082 - DNA, 1596 bp, Neisseria meningitidis
atgtgggggcttttgggtacaatcgcaacatcagtgtttcaagtggggaaggcgatggatggacggcgttgggtggtatggggtgcttttgccctgctgccttcggcttttttggcggtaatggtcgttgcgcctttgtgggcggtggcggcgtatgacggtttggcgtggcgcgcggtgctgtcggatgcctatatgctcaaacgtttggcgtggacggtatttcaggcagcggcaacctgtgtgctggtgctgcctttgggcgtgcctgtcgcgtgggtgctggcgcggctggcgtttccggggcgggctttggtgctgcgcctgctgatgctgccttttgtgatgcccacgttggtggcgggcgtgggcgtgctggccctgttcggggcggacgggctgttgtggcgcggcaggcaggatacgccgtatctgttgttgtacggcaatgtgtttttcaaccttcctgtgttggtcagggcggcgtatcaggggtttgtgcaagtgcctgcggcacggcttcagacggcacggacgttgggcgcgggggcgtggcggcggttttgggacattgaaatgcccgttttgcgcccgtggcttgccggcggcgtgtgccttgtctttctgtattgtttttccgggttcgggctggcgctgctgctgggcggcagccgttatgccacggtcgaagtggaaatttaccagttggtcatgttcgaactcgatatggcggttgcttcggtgctggtgtggctggtgttgggggtaacggcggcggcagggttgctgtatgcgtggttcggcaggcgcgcggtttcggataaggcggtttcccctgtgatgccgtcgccgccgcagtcggtcggggaatatgtgctgctggcgtttgcggcggcggtgttgtctgtgtgctgcctgtttcctttgttggcaattgttgtgaaagcgtggtcggccggcgaatcgtggcgtgtgttaatggaaagtgaaacgtggcaggcggtgtggaatactttgcgcttctcggcggcggcggtgtatgcggcggcggttttgggtgtggtgtatgcggcggcggcgcggcggtcggcgtggatgcgcgggctgatgtttttgccgtttatggtgtcgccggtttgtgtttcggcgggcgtgctgctgctttatccgcagtggacggcttcgttgccgttgctgctggcgatgtatgcgctgctggcgtatccgtttgtggcaaaagatgttttatcagcctgggatgcactgccgccggattacggcagggcggcggcgggtttgggtgcaaacggctttcagacggcatgccgcatcacgttccccctcttgaaaccggcgttgcggcgcggtctgactttggcggcggcaacctgcgtgggcgaatttgcggcgacattgtttctgtcgcgtccggaatggcagacgctgacgactttgatttatgcctatttgggacgcgcgggtgaggataattacgcgcgggcgatggtgctgacattgctgttggcggcgttcgcgctgggtattttcctgctgttggacggcggcgaaggcggaaaacagacggaaacgttataa

SEQ ID NO: 6083 - DNA, 1386 bp, Neisseria meningitidis; identical to SEQ ID NO: 585

SEQ ID NO: 6084 - DNA, 519 bp, Neisseria meningitidis
atgactacgcattttgtcgttatgggcgtatgcggctgcggcaagaccaccgccgcgctgtccctgcagaaacacctcggtcaatgtccctatgccgaaggcgacgagttccacacccaagccaaccgcgacaagatgggcgcgggtattccgctgaccgatgaagaccgctatccgtggttgggcaatctgcgcgactggatgacgcaacaggcgcaaaacggtgcgaaccacaccatcgtaacctgttccgccctcaaacgcggctaccgcgacattctgcgcggagccgaaggcaaagctgccttcatccacctcagtccgccgcaagacatcaacctcgagcgcatgatgtcgcgcaaaggacattacatgaaagcagggatgctcgattcgcaactggaaatcctcgaggaactgggcgaaggcgaatacggggtcaaaatcgccaaccccggcacgcccgaagcggtcgaagccgatattctgaactgggttgcctcggaaaacctgctttga

SEQ ID NO: 6085 - DNA, 918 bp, Neisseria meningitidis
atgtctgtctataccagtgtttccgatgatgaaatgcgcggcttcctgagcggttacgatttgggggaatttgtttccctgcagggcatcgcgcaggggattaccaacagcaattattttctgacgacgacttcgggacgttatgtgctgaccgtgtttgaagtgttgaaacaggaagagctgccgttttttctggagcttaaccggcatttgagtatgaagggcgtggcggttgccgcgccggttgcgcgcaaagacggccggcttgattccgttttggcgggtaagcctgcctgcctggttgcctgcctgaaaggttcggataccgcgctgccgacggctgagcagtgttttcataccggtgcgatgttggcgaaaatgcaccttgccgccgccgatttccctttggaaatggaaaacccgcgttacaatgcgtggtggacggaggcgtgcgcccggctgctgcccgtcctgtcgcaagacgatgccgcactgctgtgttccgaaatcgatgcgttgaaggacaatctcggcaatcatctgccttcgggcatcatccatgccgatctgtttaaagacaatgtgttgcttgacggcggtcaggtatcgggcttcatcgatttctattacgcctgccggggcaattttatgtatgacttggcgattgcggtcaacgattgggcaaggacggcggacaataagttggatgaggcgttgaaaaaggcgtttatcggcggttatgagggcgtgcgccccttgagtgccgaagaaaaggcgtatttcccgaccgcccaacgtgccggctgcatccgtttttgggtgtcgcgcctgttggattttcattttccgcaggcgggcgagatgacgtttatcaaagacccgaacgcgttccgcaacctgctgttgagtttgggttga

SEQ ID NO: 6086 - DNA, 729 bp, Neisseria meningitidis
atgggagggaaaatgtccgacaaaaaatataatgtcgatgagggggaaatcgccaaattcagccggattgccgacaaatggtgggacaagtcgggcgagttcaaaaccttgcacgacatcaatccgctgcggctggattatatcgacggacacgcggatttgtgcggcaaacgggttttggacgtgggctgcggcggcggcatcttggcggaaagtatggcgcggcgcggcgcggcgtttgtaaagggcatcgacatggcggagcagtcgttggaaaccgcccgcctgcacgcggctttgaacaatgtcgccgatatcgaatacgaatgtatccgcgtggaagaccttgccgaggcggaaccgcactcgttcgatgtggtaacgtgcatggaaatgatggaacacgtccccgatcccgccgccatcgtgcgtgcttgtgccaatctggtcaaaccggacggcatggtgtttttttccaccatcaataaaaacccgaaatcgtacctgcatctgattgtggcggcggaatatctgttgaagtttgtccccaaaggcacgcacgactggaaaaaattcatcgcacctgccgagctggcgcgaatgtgccgtcaggcaggcttggatgtggcggatacgaagggtatgacttaccatgtgttgtcgcaaacttatgccctgtgcgattcgaccgatgtgaattatatgtttgcctgccgtccggcgttctga

SEQ ID NO: 6087 - DNA, 1242 bp, Neisseria meningitidis; identical to SEQ ID NO: 1341

SEQ ID NO: 6088 - DNA, 1054 bp, Neisseria meningitidis
atgaagctcaaaatagacattgcaaccaacaacttcaaacacggcggcggcacggaacgctacacattggatttggtaaagggtctgaacagacaaaacatcacaccggccgtttatgcgacgaaatttgatcacagcattcctgaatacgccctaatcgaaccccatcttgtcgatcaacaccggacgctgaaaaaactacgctcattcctcttttcaagccggctcgctcaaaccagaaaaaacagtgccgccaaactgattgcctgccaccacgccgattacgccgacctcctcatctgcggcggcacacacttgggctacctgcaccatatggcgcaaaaaccgaacctgctcgaccgcctcgccatacgccgcaaccgcagcaactacgccaccgccaaactgattatggcgcattcccatatgatgcggcgcgaactggtcggactgtacggcgttccccctgaaagaatccaagtcgccccccccccccgcagatacggaacgcttctttccacaacccggagaaactgccgacctgcgcgccaaatacggctttgccgaccatgaaaccgttttcctgttcccatcgaccggccacacgcgcaaaggtctggaactgcttgccgactttttcgaacataccagcctgcccgtcaagctcgccgttgtcggctccccgcttccccgccctatgaaaaacgtcgtcggactgggcttctgcaccgatatgcccgaactctaccgcgccgccgactttaccattatggcttccctgtacgaacccttcgggctggtcggcgtcgaatccgtcctatgcggcacacgcgtcgtcctctccgaaaacatggcatgtacagaggtcatgaacgaagaagccggcttctttttctcacgccaaaacccggaaaccctggcgcaagccgttgcccaagccgtcagccttaaaaaacagggcggacaccgcctgtccgacccgatgcgggcactgaactacaacccggctttagacaaacacatcgggctgattcttgaaatgcttgccgcctga

SEQ ID NO: 6089 - DNA, 564 bp, Neisseria meningitidis
atgaaactcatcattctcgaccgcgacggcgtcatcaatcaggaccgcgacgacttcgtcaaatccgttgacgagtggatacctgtcgaaggcagcatggatgcggtggcatttctgacgcaggcaggctacaccgtcgccgttgccaccaaccaatccggcatcgggcgcaaatattttaccgttcaaaaccttaccgaaatgcacgccaaaatgcaccgcctcgtccgtcaggcaggcggcgaaatcaacggcatctggttctgcccgcacaccgatgccgacaactgcaactgccgcaagcccaaaccgggtatgattgaagacatcatcggacgcttcaacgcccaagcctcggaaacctggctggtcggcgacagcctgcgcgatttgcaggcaatcgatgccgtcggcggcaaacccgcgctggttctgaccggaaaaggcaaaaaaacgctctcccaacacggacacgaattgcccgaacacacacaggttttcgataccctgctcgatttctcacaatacatcatgcaggaaaacaccgcaccgcaagccgactga

SEQ ID NO: 6090 - DNA, 744 bp, Neisseria meningitidis; identical to SEQ ID NO: 2633

SEQ ID NO: 6091 - DNA, 693 bp, Neisseria meningitidis
atgaccgcctttgtccacaccctttcagacggcatggaactgaccgtcgaaatcaagcgccgtgccaagaaaaacctgattatccgccccgccggcacacataccgtccgcatcagcgtcccaccctgcttctccgtctccgctctaaaccgctggctgtatgaaaacgaagccgtcctgcggcaaacactggcgaaaacaccgccgccgcaaactgccgaaaaccggctgcccgaatccatcctcttccacggcagacagcttgccctcaccgcccatcaagacacgcaaatcctgctgatgccgtctgaaatccgtgttcccgaaggcgcacccgaaaaacagcttgcgctgctgcgggactttttggaacggcaggcgcacagttacctgattccccgcctcgaacgccacgcccgcaccacacaactgttccccgcctcctcctcgctgacctctgccaaaaccttctggggcgtgtgccgcaaaaccacaggcatacgcttcaactggcggctggtcggcgcaccggaatacgttgccgactatgtctgcatacacgaactctgccacctcgcccatcccgaccacagccccgccttttgggaactgacccgccgcttcgccccctacacgcccaaagcgaaacagtggctcaaaatccacggcagggaacttttcgccttaggctga

SEQ ID NO: 6092 - DNA, 798 bp, Neisseria meningitidis
atggataccgcacaaaaacaacgctgggcaataaccctatcctatgacggcagccgcttttacggctggcagaaacaggctgacggcgtaccgaccgttcaggcggcattggaaaccgcgctcgcccaaatagcaggggaagcggtttccaccaccgttgccggcaggaccgacaccggcgtgcatgccaccgcccaagtcgtccacttcgacacaactgccgcccgtccccaacaggcatgggtgcgcggcgtaaatgcccacctgcccgaaggcattgccgttttgcacgcccgacaggtcgcccccgaatttcatgcacgatttgacgcatacggacggcactaccgctacctgctcgaatccgcccccgtccgttcccccctgctcaaaaacagggcaggctggacacacctcaaactcgacatcgggcagatgcggcaggctgccgccttattggtcggcgaacaagacttctccagcttccgcgccgccgaatgccaagcaaaatcccccgtcaaaaccatctaccgcgccgaccttacccaaagctcaggactcgtccgcctcgatttgcacggcaacgcctttttgcaccacatggtacgcaacatcatgggcgcgctcgtttatgtcggcagcggcagactcagcgtcgaaggcttcgccgcactgattcaagaacgcagccgcctcaaagccccgccgaccttcatgcccgacggactttacctgaccggcgtcgactatcccgaggcatacggcatcatccgcccccaaatccccgaatggctttaa

SEQ ID NO: 6093 - DNA, 240 bp, Neisseria meningitidis
atgattctcaacatacgcaaaatgggaaactcgcaaggcgtgattctgcccaaatcattattgggtcaaataggggcagtagacagcttggctgttacagttgaaaagggcaatattattttaagctgtcctaccgttcgcaggggatgggcagaagctgccgcaatgcttgtcgaaaccgagcaggagcattttttttccgaaattgaaaacgaagcggataaagaatggatatggtag

SEQ ID NO: 6094 - DNA, 324 bp, Neisseria meningitidis
atggatatggtagtacgcggcggaatctatctggtctccttagacccgaccgtaggaagcgaaatcaaaaagacacgtccttgtgtcgtagtctctcctcctgaaatacacaactatctcaagactgtgctgatcgttcccatgacgagcggaagccgtcctgccccgttccgcgtcaatgtccgctttcaggataaagacggtttgcttttgcccgaacagattagggctgtggataaagccggattggtcaaacatcttggcaatttagacaacagtacggctgaaaaactgtttgcagtattgcaggagatgtttgcctga

SEQ ID NO: 6095 - DNA, 996 bp, Neisseria meningitidis
atgaaaaaatccctgattgccctgactttggcagcccttcctgttgcagcaatggctgacgttaccctgtacggcaccatcaaagccggcgtagaaacttcccgctctgtatttcaccagaacggccaagttactgaagttacaaccgctaccggcatcgttgatttgggttcgaaaatcggcttcaaaggccaagaagacctcggtaacggcctgaaagccatttggcaggttgagcaaaaagcatctatcgccggtactgactccggttggggcaaccgccaatccttcatcggcttgaaaggcggcttcggtaaattgcgcgtcggtcgtttgaacagcgtcctgaaagacaccggcgacatcaatccttgggatagcaaaagcgactatttgggtgtaaacaaaattgccgaacccgaggcacgcctcatttccgtacgctacgattctcccgaatttgccggcctcagcggcagcgtacaatacgcgcttaacgacaatgcaggcagacataacagcgaatcttaccacgccggcttcaactacaaaaacggtggcttcttcgtgcaatatggcggtgcctataaaagacatcatcaagtgcaagagggcttgaatattgagaaataccagattcaccgtttggtcagcggttacgacaatgatgccctgtacgcttccgtagccgtacagcaacaagacgcgaaactgactgatgcttccaattcgcacaactctcaaaccgaagttgccgctaccttggcataccgcttcggcaacgtaacgccccgagtttcttacgcccacggcttcaaaggtttggttgatgatgcagacataggcaacgaatacgaccaagtggttgtcggtgcggaatacgacttctccaaacgcacttctgccttggtttctgccggttggttgcaagaaggcaaaggcgaaaacaaattcgtagcgactgccggcggtgtcggtctgcgccacaaattctaa

SEQ ID NO: 6096 - DNA, 1902 bp, Neisseria meningitidis
atgactacgccaaaaaaaaccgccaaaacttccggcaacgaagcgcgcgagcttgccgacttgagcgaagacatcggcatctgctttaaatatccgaactcggaacgcgtgtatctgcaaggcagccgcgacgacatccgcgtgcctttgcgcgaaatccgtcaggacgacacctacacggcgcaaggtacggaagccaatccgccgattcccgtctacgacaccagcggcgtgtacggcgacccggcggcgcatatcgacctgaaacaaggtctgccgcacatccgcaccgcgtggctggacgaacgcggcgataccgaaatcctgcccaagctctccagcgaatacggcatcgaacgcgcacacgatccgaaaaccgcccatctgcgtttcaaccaaatcacccgcccgcgccgcgcgaaaagcggcagcaacgtaacccagcttcactacgcgcgccaaggcattatcacgcccgaaatggagtttgtcgccatacgcgaacgtttaaaattagacgaattgtcccaaaaaccggaatacgccaaactcttggaacagcacgcggggcaaagtttcggtgcgaacatcccgacccatcccgaccaaatcacgcccgaattcgtgcgccaagaaatcgccgccggacgcgcgattattcccgccaacatcaaccaccccgaactcgaaccgatgattatcggccgcaactttcgtgtcaaaatcaacggcaacttgggcaactccgccgtcacctccagcctgaccgaagaagtcgaaaaaatggtgtggtcgctgcgttggggcgcggacacgattatggatttgtccaccggcgcgcacatccatgaaacgcgcgaatggattatccgcaacgcgcccgtccccatcggcaccgtgccgatttaccaagcgttggaaaaaaccggcggcatcgccgaagatttgacttgggatttgttccgcgacaccctcatcgaacaggcggagcaaggcgtggactatttcaccatacacgcgggcgtgttgctgcgttatgtgccgatgaccgccaaccgcctcaccggcatcgtctcgcgcggcggttcgattatggcgaaatggtgtttggcacatcatcgggaaaatttcctctacacgcatttcgacgaaatctgcgaaattatgaaagcgtatgacgtatcgttcagcctcggcgacggcctgcgccccggctgcattgccgatgccaacgacgaatcccaattcgccgaactgcacaccttgggcgaattgaccgataaagcgtggaaacatgacgtacaagtcatgatcgaaggccccggccatgtgccgctgcaacgcgtcaaagaaaacatgaccgaagagctgcaacactgctttgaagcacctttttacacgctcggcccgctcgttaccgacatcgcacccggctacgaccacatcacctcgggcataggcgcggccaatatcggctggtacggcacggcgatgctttgttacgttaccccgaaagagcatttggggctgcccgacaaagaagacgtgcgcaccggcatcatcacctacaaactcgccgcccacgccgccgatctcgccaaaggctggccgggcgcacaattacgtgacaacgccctgagcaaagcgcgtttcgagttccgctggcgcgaccaatttcgcttaagcctcgaccctgaacgtgccgagagcttccacgacgaaaccctgcctgccgaaggcgcgaaaatcgcccacttctgctcgatgtgcggccccaaattctgctcgatgaaaatcacgcaggaagtgcgcgactacgccgacaagcaaaaagcccaacggcagggcatggaggaaaaagcggtcgagttcgtcaaaaaaggcgcgaagatttacagttaa

SEQ ID NO: 6097 - DNA, 876 bp, Neisseria meningitidis; identical to SEQ ID NO: 411

SEQ ID NO: 6098 - DNA, 939 bp, Neisseria meningitidis; identical to SEQ ID NO: 2837

SEQ ID NO: 6099 - DNA, 972 bp, Neisseria meningitidis
atgagcaccttcttccagcaaaccgcacaagccatgattgccaaacacatcaaccgcttcccgctattgaagttggatcaagtgattgattggcagccgatcgaacaatacctgaaccgtcaaaaaacccgttaccttcgagaccaccgcggccgtcccgcctatccgctgctgtccatgttcaaagccgtcctgctcggacaatggcacagcctctccgatcccgaactcgaacacagcctcattacccgcatcgacttcaacctgttttgccgtttcgacgaactgagcatccccgattacagcaccttatgccgctaccgcaactggctggcgcaagacgacaccctgtccgaattgctcaaactgatcaaccgccaactgaccgaaaaaggtttaaaagtagagaaagcatccgccgccgtcattgacgccaccattattcagaccgccgacggcaaacagcgtcaggccatagaagtcgatgaagaaggacaagtcagcggccaaaccacacggagtaaggacagcgatgcgcgttggatcaagaaaaacggcctctacaaactcggttacaaacaacatacccgcaccgatgcggaaggctatatcgagaaactgcacattatagtagattaaatttaaatcaggacaaggcgacgaagccgcagacagtacagatagtacggcaaggcgaggcaacgccgtactggtttaaatttaatccactatattatgcgcaaagcctgccgcaaccgtccgctgacggaggcgcaaaccaaacgcaaccgatatttgtcgaagacccgttatgtggtcgaacagagcttcggtacgctgcaccgtaaattccgctacgcccgggcagcctatttcggactgattaaagtgagtgcgcaaagccatctgaaggcgatgtgtttgaacctgttgaaagccgccaacaggctaagtgcgcccgctgccgcctaa

SEQ ID NO: 6100 - DNA, 1776 bp, Neisseria meningitidis
atgagtatcgtgctgcacggcgtggcggcgggcaaaggcattgccgtcggttgcgcccacctgattgcgcgcggtacggaggaagtgccgcagtatgatgttgcggaggcggacaccgatgccgaagccgaacgtttcgatgccgccgtcaaagccacgcgcaaagagttggaacagctccgcagcgcgattcccgaaaacgccccgaccgagttgggcgcgttcatctcgctacacctgatgctcttgaccgatgttaccttgtcgcgcgaacccgtcgatattttaagggaacaaaaaatcaacgccgagtgggcattgaagcagcagagcgacaaactcgccgcccaattcgacaatatggacgatgcctatttgcgcgaacgcaagcaggatatgctgcaagtcgtccgccgcatccacaacaacctgatcgggcagggcaacgagttggaagttgccgacaacctgtttgacgaaaccgttctgattgcaaacgacctttcgcccgccgacacggttttgtttaaagagcagcgcattgccgccttcgttaccgatgccggcggccccaccgggcatacggcgattttgggcaggagcttggacatcccgtccgtcgtcgggctgcacaacgcgcgcaaactgattaccgaaggcgaaacggtcattgtggacggtatcaacggcgtgttgattatcgcgccggatgagtcggtgttgaacgaataccgccgccgtgcccgcgaataccgcagccacaaacgcgatttgaacaagctcaaaaaaaccgccgccgccaccgccgacggggtctgcatcgagcttgtgggcaatatagaatccgccgaagacgtgaaaccgctgcacaacctcggcgcagacggcatcgggctgttccgcagcgagtttctttacctgaaccgcgatacgatgccgtctgaagacgagcagtacgaagtgtacagcgcgattgtcaaaaaaatgaaaggcaaaagcgtaacgatacggacagtcgatttaggtgtggacaaaaacccgcgctggttcgggaaaaacagcacgcccaacggcagcctcaaccccgcgctgggcatgaccggcatccgcctgtgccttgccgaaccggtcatgttccgcacccagatgcgcgccatcctccgtgcggcggtacacggccccgtgcggatgatgtggccgatgattacctccgtatccgaagtgcgccagtgcctcatccacctcgacaccgcgcaacgccagcttgccgaacgcggcgatgccttcggtaaagtcggcatcggctgtatgattgaaattccgtctgccgcgctgaccgtcggcagtattttgaaactggtcgatttcatctccgtcggtaccaacgacctgattcaatacatcttgtccgtcgatcgcggcgacgacagcgtcagccacctctaccagcccggccatcccgccgtgctgaaaatgctgcaacacgtcatccgtaccgccaaccgcatggacaaagacgtatccgtatgcggcgagatggcgggcgataccgcgtttacccgcgttttattgggtatggggctgcgccgtttttccatgaaccccaacaacatcctgcccgtcaaaaacatcattctgcacagcaatgtcggacagctcgaaagtgatattgtgaaagtcatccgctgcgaagacgaagagaagtcggaaaagctgatcaaacagatgaacagcgtgtctgtcgaggaagaagccgacttcaaggggcggaaataa

SEQ ID NO: 6101 - DNA, 270 bp, Neisseria meningitidis
atgctcaaacaatccatcgaaatcatcaacaaactcggactccacgcccgcgcgtccaacaagttcacccaaaccgcgtcccaattcaaaagcgaagtctgggttacgaaaaacgacagccgcgtcaacggcaaaagcattatggggctgatgatgctcgccgccgccaagggtacggtcatcgaactggagacggacggcgcggacgaggcggaagcgatgcgcgccctgaccgacttaatcaacggctacttcggcgagggcgaataa

SEQ ID NO: 6102 - DNA, 459 bp, Neisseria meningitidis
atgaggaacaggacgcataatatgatagggcttttaatcatcacacacgaaaccataggcgaagcctaccgcaagctggcgcatcatttttttccgggcggactgcctgaaaacgtccgcatactcggcgtgcagccgacggaagaccaagacgacatcaacaacaacgccattgccgcgcttcaggaatttcccgacaacgacggcgtgctgattatgaccgatattttcggtgcgaccccctgcaatgccgcccgccgcctcgtgcgcgaaaacaaatcggcgattttgaccgggctgaacgcgccgatgatggttaaggccgtccaatattcgccggcggcggaagaccttgccgcctttaccgaatgcgtcagggaggcggcggtaaaaggcattttcgccatcacgtccgcgcccgaagatttggtgtgccggcgcagcggcgatgccgtctga

SEQ ID NO: 6103 - DNA, 564 bp, Neisseria meningitidis
atgaccgatttagaaaccaaacgccttgaaacacaggcgatgcttgaaaacgccgatcttttgttcgaccaaggccaatgccgtgccgcactgcaaaaagtggcggacgagattacgcgtgatttgggcggcaaatatccgctgctgctgcccgtgatgggcggcgcggtggtgtttacggggcagttgctgccgctgttgcgttttcccttagattttgattatgttcacgtttcccgttacggcgacaagctggagggcggcgcgttcaactggaagcgtatgcccgatgcggaacaaatccggggcaggcacgtcgtcgtgctggacgatattttggacgaagggcatacgatgtccgccattcaagccaaacttttggaaatgggtgcggcaagctgccgtgcggcggtgttcgccaacaagctgattgacaaacccaagcctatccgagccgattatgtcggactggatgtgccgaaccgttatgttttcggttacggcatggatgcggcgggctgctggcgcaatctgggcgagatttacgcattgggcggaaaataa

SEQ ID NO: 6104 - DNA, 825 bp, Neisseria meningitidis
atgattaagaagacaatcggcggcatcataccgatttttacggcggttttcatccctgcatcagcaggcgcggcggatttgatgctggcgcaggaatacaaagggcaggatattgccggctgggcgatgagcgagaaactcgacggcgtgcgcgcctattgggacggaaagcacctgatgagccgtcagggctacgcgtttgctccgcccaaaggttttaccgctcagtttccgccttatcctttggacggcgaattgtatagcggacgtggtcagttcgagcagatttccgctaccgtgcgttctgtttcttcagactggcgcggcatccgcctgcacgttttcgatgtacccaaggcgcagggcaacctctaccaacgtttggcagtcgcaacgcagtggctgaaaacgcatccgaacgcgccgattaccatcatcccgcaaatcaaagtgcgcgaccggcagcacgcgatggactttttaaaacaaatcgaagcgcagggcggcgaaggcgtgatgctgcgtcagcccgaatcccgttacagcggcggcaggagcagccaattattgaagctgaaaagccaatacgacgacgaatgcacggtaacgcggcactatgagggcaaagggcgaaacgccggacggctgggcgcggtcggctgcaaaaaccggcacggcgaattccgcatcggcagcggtttcaaagataaagaccgcgacaacccgcccaaaatcggcacactgattacctaccgttaccgtggctttacgcggaaaggcacgccgaaatttgccacatttgtgcgcgtgcgtaccgaccgctga

SEQ ID NO: 6105 - DNA, 633 bp, Neisseria meningitidis
atgaccctacgttacgaaatcttccccgttacccccttccgccaaaactgcaccctgatttgggacgacgaaagcggcgaagccgtcctgaccgatgtcggcggcgacgtgccgttcctgctgcaagcgttggcaaaccgcaaacttacgctcacggcaatctggctgacgcacggccatctcgatcacgcgggcggcgtggtcgaaatgttgaaaacgcataaagtccctgtcctcgggccgcatccggacgatgaattcctgctccaatcgctgccgcaaaccaccgcgcaatacggatttcccgtctcgcccgcctttgcgccgaaccgttggctcgaagaaggcgaaacgctcacggtcggacgctatgcctttcaagtgctgcatattccgggccatacgccgggacatatcgtcttttattgtgccgaggcggaattgctgattgcgggcgacgtgctgttttacgaaaccataggcagaaccgattttccgcgcggcaaccacgccgacttaatcaataatatccgcaacaaattattcacccttcccgaaaccgtgcaagttgtcgccggacacgggcgtatgacttccatcggacacgaaaagcggcacaatccgtttttctaa

SEQ ID NO: 6106 - DNA, 1785 bp, Neisseria meningitidis
atggaactgatgactgttttgctgcctttggcggcgttggtgtcgggcgtgttgtttacatggttgctgatgaagggccggtttcagggcgagtttgccggtttgaacgcgcacctggcggaaaaggcggcaagatgtgattttgtcgaacaggcacacggcaaaaccgtgtcggaattggcggtgttggacgggaaataccggcatttgcaggacgaaaattatgctttgggcaaccgtttttccgcagccgaaaagcagattgcccatttgcaggaaaaagaggcggagtcggcgcggctgaagcagtcgtatatcgagttgcaggaaaaggcacagggtttggcggttgaaaacgaacgtttggcaacgcagctcggacaggaacggaaggcgtttgccgaccaatatgccttggaacgccaaatccgccaaagaatcgaaaccgatttggaagaaagccgccaaactgtccgcgacgtgcaaaacgacctttccgatgtcggcaaccgttttgccgcagccgaaaaacagattgcccatttgcaggaaaaagaggcggaagcggagcggttgaggcagtcgcataccgagttgcaggaaaaggcacagggtttggcggttgaaaacgaacgtttggcaacgcaaatcgaacaggaacgccttgcttctgaagagaagctgtccttgctgggcgaggcgcgcaaaagtttgagcgatcagtttcaaaatcttgccaacacgattttggaagaaaaaagccgccgttttaccgagcagaaccgcgagcagctccatcaggttttgaacccgctaaacgaacgcatccacggtttcggcgagttggtcaagcaaacctatgataaagaatcgcgcgagcggctgacgttggaaaacgaattgaaacggcttcaggggttgaacgcgcagctgcacagcgaggcaaaggccctgaccaacgcgctgaccggtacgcagaataaggttcagggcaattggggcgagatgattctggaaacggttttggaaaattccggccttcagaaagggcgggaatatgtggttcaggcggcatccgtccgaaaagaggaagacggcggcacgcgccgcctccagcccgacgttttggtcaacctgcccgacaacaagcagattgtgattgattccaaggtctcgctgacagcttatgtgcgctacacgcaggcggcggatgcggatacggcggcacgcgaactggcggcacacgttgccagcatccgtgcacacatgaaaggcttgtcgctgaaggattacaccgatttggaaggtgtgaacacattggatttcgtctttatgtttatccctgtcgaaccggcctacctgttggcgttgcagaatgacgcgggcttgttccaagagtgtttcgacaaacggattatgctggtcggccccagtacgctgctggcgactttgaggacggtggcgaatatttggcgcaacgaacagcaaaatcagaacgcactggcgattgcggacgaaggcggcaagctgtacgacaagtttgtcggcttcgtacagacgctcgaaagcgtcggcaaaggcatcgatcaggcgcaaagcagttttcagacggcattcaagcaacttgccgaagggcgcgggaatctggtcggacgcgccgagaaactgcgtctgttgggcgtgaaggcaggcaaacaacttcaacgggatttggtcgagcgttccaatgaaacaacggcgttgtcggaatctttggaatacgcggcagaagatgaagcagtctga

SEQ ID NO: 6107 - DNA, 801 bp, Neisseria meningitidis
atgagggcagcgaaaatgaaacaaactctgaaaaactggtttgctgccttattgctggcagtgcctatgagtgcagccgtcgccagcggcggcggacactacgaaaaagtcgatatcgacctgcgtgaccaagtcagcctgcagcacggtgcgcaaatctttacaaactactgtttgtcttgccactctgcaagcggtatgcgcttcaaccgtctgaaagacatcggtttgactgacgaagaaatcaagaaaaacctgatgtttaccaccgataatgtcggcgatgtcatgcattcggcgatgaacccgaaagatgcggcaaaatggtttggtgctgctccgcccgatttgacgttgattgcgcgttccaaaggtgcagactacctttacgcctatatgcgcggcttctataaagatccgacccgtccgagcggctggaacaatactgtattcgataaagtcggtatgccccacccgttgtgggagcaacaaggtgttcaagccgttgagttggatgccaaaggtcagccggttatggtaaaagacgaacacggcgagatgaagcctaagctgtattgggaatctaccggtttgcacagccgccgcctgcctaacggcaaagtgatccaaaaagagtacgacgcatatgtacgcgatttggtcaattaccttgtgtacatgggcgaacctgcacaactgcaacgcaaacgtataggctatgtcgtgatgattttcctatttgcggttatgctgcctttggcttacttcctaaataaagaatattggaaagacgtacactaa

SEQ ID NO: 6108 - DNA, 1350 bp, Neisseria meningitidis
atggcaaaccaaaccaatagcaaagcaaaagcattgttaggctgggtagatgcccgttttccattaagtaaaatgtggaaagagcatctgtctgaatactatgcgcctaaaaacttcaacttctggtatttcttcggctcattgtctatgctggtgctggtgattcaaatcgtcagcggtattttcctgaccatgaactacaaaccggacggcaaccttaacgcctaccatctgcctgctgcctttaccgcagtagagtacatcatgcgcgacgtgtccggcggctggattatccgctatatgcactctaccggcgcatctttcttcttcatcgtcgtttatctgcacatgttccgtggtctgatttacggttcgtacaaaaaaccgcgcgaattggtgtggattttcggttccctgattttcttggcattgatggcagaagcctttatgggctacctgctgccttggggtcaaatgtccttctggggtgcgcaggtaattattaacctgttctccgccatccctgttatcggtcctgatttgtccacttggatccgcggtgacttcaacgtttccgatgttactttgaaccgattcttcgccctgcacgttatcgctgtacctttggtattgctcggcttggttgtggctcatatcattgccttgcatgaagtgggttccaacaaccctgacggtgtagaaatcaaaaagctgaaagatgaaaacggtgtccctctagatggcatacctttttttccgtattatgttgtgcatgatatattggcagtaacgatattcttgattgtcttctgtgccgtgatgttctttgcacctgaaggcggcggctacttcttggaagcgccaaacttcgatgcagcgaatgcgctgaaaacacctccgcacattgcgccggtatggtacttcactccgttctacgcaattctgcgtgcgattccttcctttgccggtactcaggtatggggtgtaatcggtatgggtgcagcagttgtactgatcgccttgctgccttggttggataaaggcgaggttaaatctgtccgctatcgcggcccaatcttcaaaaccgcattggttctgttcatcattgccttcatcggtttgggtattttgggtgcaatggtagcaactgatacgcgtactttggttgcacgtatcctgtctttcgtctactttgcattcttcctgggtatgccgttctataccaaactggataccaacaaaccagttcctgaacgcgtaaccatgagcactactaaacaaaaaattatgttctttgtttacgtcggtattaccgttgttggtgcttacttgtttgcaaccaatatctga

SEQ ID NO: 6109 - DNA, 582 bp, Neisseria meningitidis
atggataatcaagaaatcaacaacggccgccgccgtttcctgacactcgcgacctgcggcgcgggcggagtggcagcattgggtgtggcaacgccgtttgtggccagttttttcccttcggaaaaagccaaggccgccggtgctgccgtcgaggtggatgtcagtaaaatcgaagcgggtcagctgctgaccgccgagtggcaaggcaaaccgatttgggtgctcaaccgtacagatcagcagcttaaagacctgaaaggcctgaacggcgaacttaccgatcccaattccgatgcggaacagcagccggagtatgctaaaaacgagacccgttcgattaagccgaacatccttgtcgccatcggtatctgcacccatttgggctgctcgcccaccttccgtcccgacattgcccccgccgatttgggtgcagactggaaaggcggcttcttctgcccctgccacggttcgaaattcgacttggccggccgcgtatataaaggtgttcctgccccgaccaacctggttgtcccgccatataaatacttgagcgacacaactatcttggtgggcgaagactaa

SEQ ID NO: 6110 - DNA, 750 bp, Neisseria meningitidis
atggtattgtgcagggattttctgacttggtgtaatgaaacattgcagacagcgttgtttaaagattacgcccctaacggtttgcaggttgaagggagggaatatatcgggaaaatcgttacgtcggtaacggcaagcagggcagcgattgattttgctgtggagcagaaggcagatttgcttttggtacatcacggtatgttctggaaaaacgagttgccgaccgttactggttggaaaaaagaacggattgccgcactgttacggcacgacatcaatatggcaggctaccatctgcccctggatgcacatcccacactgggcaacaatgcccaactcgccgacagattgggttttgcgacagaaaaacggttcggcgaacaaaacctgctcaactcgggcagcctgaaacaagccaagacactcggcgcattggcggcgcatattgaaacagttttgcaacgtaagcctgtcgttatcggcaatcccgaacgcgaaatccgacgggttgcatggtgcagcggcggggcgcaggggttttttcagacggcaatagacgaaggtgtcgatctgtatttgacgggggaaatctctgaagcccaataccaccttgccaatgaaacgggtacggctttcatttcggcagggcatcacgcgacggaacgttacggcgtacgcgcgctggcagaatcggcggcagaggttttcgggttggaagtgtgccattttgacgaaaacaatccggcttga

SEQ ID NO: 6111 - DNA, 930 bp, Neisseria meningitidis
atggattccattatcgaattgcgccacctcaaaaccctgctggcacttgaagaaaccggcagcgtctcccttgccgccaaacgggttttccttacccaatccgccctttcccaccagatccgtatgctcgaaaaccactacggcacgccgctgttcgaacgcaaatccacgcccttgcgctttaccccggtgggcgaaaggctgctgcgcctcgcccacgaacttatacctcaagttgctgttgcagaatgggatttggcgcgaatcacggaaggagaggcgggagagctgcggattgccgtcgaatgccatacctgtttcgactggctgatgcccgccatgggcgaattccgcccgatgtggccccaagtcgaattggatatcgtatcgggattccaagcggatcccgtcggactgctgctgcaacaccgtgccgaccttgccattgtttccgaagcggaaaaacaaaacggtatttctttccaaccgctgtttgcctacgaaatggtcggcatttgcgcaccagaccatccgcttgccgccaaaaacgtttggacggcggaagactttatcggggaaaccctgattacttatcccgttcccgacgagatgctggatttgcccaaaaaaatcctgattccgaaaaacatcaacccgccgcgccgacacagcgagctgaccatcgccattatccaactggttgccagcagacgtggcattgccgcccttccctattggacagtcatgccctaccttgaaaaaggctatgtcgtccaccgccaaattactgccgacggactgcaaagcaaactgtatgccgccatccgtaccgaagatacggacaagagctatctgaacaatttttgccaaatcatacgcgaacgcggttttgcagatttgcccggactgagcgaactggaaccggtctga

SEQ ID NO: 6112 - DNA, 393 bp, Neisseria meningitidis
atgaacggtaaatactactacggcacaggccgccgcaaaagttcagtggctcgtgtattcctgattaaaggtacaggtcaaatcatcgtaaacggtcgtcccgttgacgaattcttcgcacgggaaaccagccgaatggttgttcgccaacccttggttctgactgaaaacgccgaatctttcgacatcaaagtcaatgttgttggcggcggcgaaaccggccagtccggcgcaatccgccacggcattacccgtgccctgatcgacttcgatgccgcgttgaaacccgccttgtctcaagctggttttgttacccgcgatgcccgcgaagtcgaacgtaaaaaaccgggtctgcgcaaagcacgccgtgcaaaacaattctccaaacgttaa

SEQ ID NO: 6113 - DNA, 432 bp, Neisseria meningitidis
atgaaaaccttttcagcgaaaccccacgaggtgaagcgcgaatggttcgtcatcgatgcccaagacaaagtcttgggtcgcgttgcggccgaagtcgccagccgtctgcgtggcaaacacaaacctgaatacaccccccacgtcgataccggcgattacatcattgttatcaatgcggacaaactgcgtgtaaccggtgccaaattcgaagataaaaaatacttccgccattccggtttcccaggcggtatctacgaacgcaccttccgcgaaatgcaagagcaattcccgggccgcgctttggaacaagctgtaaaaggtatgctgcccaaaggtcctctgggttacgccatgattaaaaaactgaaagtgtatgcgggtgcggaacacgcccatgctgcgcaacaacccaaagttttggaactgaaataa

SEQ ID NO: 6114 - DNA, 306 bp, Neisseria meningitidis
atgaacatcgaacaagtccacatcgaagtcatgcacgcccggctgaccgtcaacacgccggcagaagaaaaagacacactgttgcaggcagtcggaatgctcaacggcaaagccgaagccatccgcgaaggcggacgcgtcgcggacagcgaaaaaatcgtcattatggccgcgctcaacgtcgtccacgacctgttgaaaacctccctgaacggcggcgatttggcaatcggcgattttgcgcgtaaaatagccgatatggacaacgcctgccaaaaagcactatcccgcttggcgcaggaataa

SEQ ID NO: 6115 - DNA, 330 bp, Neisseria meningitidis
atgaaacaaaatatcgaaaaactcgaaagcagcgtttatacgttggtacaaaaattcgaaaccctcgtcagcgaaaaccgccgcctcaaagaaaccgtcgccgaactcaaacgggcgcacgagcggcaaaaactcgaacacgaaaccgccgtcgacgaactcagcgaagccctgctcgtccaagtcggcaaactcaaagaagacctgcaaaacaaaattgacagcctgacagaagaaaatacacgataccgcagcctgctcgaacagagcagggaaaaaatcagcgcactggcagcgcgcctcccccaatggcaggaaacgcagcaataa

SEQ ID NO: 6116 - DNA, 990 bp, Neisseria meningitidis
atgaaaattaccgttatcggcgcaggttcgtggggtacggcgctcgccctgcatttttcccaacacggcaaccgcgtatccctgtggacgcgcaacgcagaccaagtccgtcaaatgcaggaagcgcgtgaaaacaaacgcggactgcccggcttttcctttcccgaaaccttggaagtgtgtgcggatttggcagacgcgctcaaagacagcggacttgtccttatcgtaacctccgttgccggattgagaagcagcgcagagctgctcaaacagtacggcgcgggacacctccccgtcctcgccgcctgcaaaggattcgagcaggataccgggctgctgacctttcaagtcttgaaagaagtattgcccgacaataagaaaatcggcgtactttccggcccgagttttgcacaggaactcgccaaacaactgccctgcgccgtcgtccttgcctccgaaaaccaagagtggattgaagaactcgtaccgcagctcaacacgaccgtcatgaggctttacggcagtaccgatgttatcggcgtggcggttggcggcgcggtaaaaaatgttatggcgattgccaccggattgtccgacggcctagagtacgggcttaacgcccgtgccgcactggttacgcgcggattagctgaaatcacccgccttgcctccgcaatgggcgcacagcccaaaaccatgatggggctggcaggcatcggcgacctcatcctcacctgcaccggcgcactttcgcgcaaccgccgcgtcggcttgggtttggcagaaggcaaggaactgcatcaggtgctggtcgaaatcggacacgtttccgaaggggtcagcacgatagaagaagtcttcaatactgcctgtaagtaccaaatcgacatgccgattacccaaactctgctgcaactcatccgcaaagaaatgaccccgcaacaggttgtcgaaagactgatggaacgcagcgcgcgttttgaataa

SEQ ID NO: 6117 - DNA, 2703 bp, Neisseria meningitidis
atgcaactgcatattctgaacaatccaaaggacgcggctttggcggcggacgcggaatttctgaaacaatccctgttcaacctcctgcacgaagaagcctcgccgttggttgtcgaaacagtcaaactcttgtccacttccgacgacagcgcggcattgattgaaaaagtattgccgcaattggacgaacaacaaacccacgatttaaccttggcctgcggcctgttcgcccagattttgaacatcgccgaagacgtgcaccacgaacgccgccgccaaatccacgaagaagccggacgcggcggcgcggaaggcagcctgacggaaaccgtccgcaggctcaaagcggggaaagccgacggcaaatcggtgcagcggcagttggacaatacgtccgttaccgccgttttgaccgcgcacccgaccgaagtgcaacgccaaaccgtcttaagcttcaaccgccgcatccgcgcactgttgccgcaacgcgaacgctgcaccaatgccgacgcgctggcacggctgcgccgcgaaatcgacactatcctgctgggcttgtggcagaccagcgaaacgcgccgccacaaactcagcgtcaacgacgaaatcaacaacggcgtgtccatcttcccgatgagctttttcgaagccctgcccaagctctaccgcaagatggaacacgactttcagacggcctatcccggcgtccgcgttccggacatcctcaaaatcggcggctggatcggcggcgaccgcgacggcaatccgtttgtttctgccgaaaccctgcgctttgccttccgccgccacgccgatgccgtgttccgcttctatcgcggcgaactcgacaaactctaccgcgaactgccgctctccatccgccgcgtcaaagtcaacggcgatgtaacggcgttgtccgacaaatcgcccgacgaagaaatcgcccgcgccgaagaaccctaccgccgcgccatcgcctacattatggcgcgcgctatgggcaaagcgcgcgcgctcggtttgggtatgggctgcaaattcggctttctcgagccttatgcttcggcacaagagtttctggatgatttgaaaaaattgcaacgttcccttatcgacaacggcagccgtctgcttgccgaaggccgtttggcagacctcatccgttccgtatccgtgttcggctttcacatgatgccgctcgacttgcgccaacacgcaggcaaacacgccgatgtggttgccgagcttttccaacacgcaggcttggaagactacaaccgcctgaacgaagagcaaaaacaaaccgccctgttgcgcgaattgagccatcaacgtcctctgtacagcccgtttatcacatacagcgaccatacccgccacgaactggcaattttcaacgaagcgcgcaaaatcaaagacgaatttggcgaagatgccgtaacacaaagcattatttccaactgcgaacaacccagcgacctgctcgccttggcattgctgctgaaagaaaccggcctgttggcggtggaaaacggcaaaccgcacagccgcatcaatatcgtgccgctgtttgaaaccattgaagcgttggaaaacgcctgtccggtcatggaaaccatgttccgcctcgactggtacgatgcactgctcgaaagccgtggaaacatccaagaaatcatgctcggctattccgactccaacaaggacggcggctacgttaccagctcatggtgcctctatcaggcggaattgggcttggtcgaactcttcaaaaaatacgatgtccgtatgcgcctgttccacggacgcggcggcagcgtaggtcgcggcggcggcccttcttaccaagccattctcgcccaaccggcgggcagcgtggcgggacaaatccgcatcaccgaacaaggcgaagtcattaccgccaaatacgccgaccccggcaatgcccaacgcaacttggaaaccttggttgccgcgactttggaagccagcatcctgccggataaaaaagaccctgatgccaaactgatgcaggcattgtcggacgtatcgttcaaatactaccgcgaactgattacccatcccgacttcatcgactactttctgcaaaccagcccgattcaggaaatcgccaccctcaacctaggcagccgtcccgccagccgcaaaaccttggcgcggattcaggacttgcgcgcgattccgtgggtattttcctggatgcagaaccgcctcatgctgccggcttggtacggtttcggcagcgcggtggaaaccttgtgcgaagacaaacccgaaacgctcgccgccctgcgcgaacacgcccaaagcaacccgttcttccaagccatgctctccaatatggaacaagtgatggcgaaaaccgacatcaccctcgcggaaaactatgccggcttgagcgaatcgcccgataaggcaaaaatcatcttcgggatgattaaggaagaataccgccgcagccgcaaagcactgctcgacctactgcaaaccgaagagcttttgcgcgacaaccgcagcctcgcccgttcgctcgctttgaggattccctacctgaacgcgctcaacggtttgcaagtcgccatgctcaaacgcctgcgtaaagaacccgacaatccgcacgcccttctgatggtgcacctgaccatcaacggcgtggcgcaaggtttgcgcaatacaggctga

SEQ ID NO: 6118 - DNA, 771 bp, Neisseria meningitidis
atgaccacgaccgaacacgacaacgacgatgcattcctgctgcggtacagccgccacatcctcttggacgaaatcggcatcgaagggcagcagaaactttccgccgcgcatattttggtcgtcggctgcggcggtttgggtgccgccgcactgccctaccttgccgcttcgggtgtcggcacgctgaccatagccgattccgacacggtcgaactgcacaacctgcaacgccaagtcgcatttgacgagggcgatgtcggcaaactcaaaaccgaagccttggcaggccgcctgaaacgcatcaaccataccgtcaacgtccgcgccgtcaacgaaaaactcgacggctgccgcctgaccggtttggttcaagccgccgacatcgttttagactgttgcgacaactacgccacgcggcaagccgtcaaccgtgcctgcgtgcaaacgaaaacaccgctggtttcaggggcggcggtacgctttgaagggcaacttgccgtgtaccgtcccgacttgcccgactcgccgtgttacgcctgcctgtttgacggcggatcggcttcagacggcatctgttctctcttcggcgtgttctcgccgctggtcggcatcatcggcagtacccaagcggcggaggctctgaaaatcctgctggatgcgggcgaaccgtcgcacggcaggctggcggtttaccgtgccttggaagggggctggcaatatttcgacctgccgcgcaaccctgaatgcccggtttgcggcacagcgcgataa

SEQ ID NO: 6119 - DNA, 225 bp, Neisseria meningitidis
atggacgcggttcaagagttggaacgccgtattgtcgaactggaaatccaatccgcgcttcaggaggacgtaatcgccggcctgaacgcgatggtggcggaattgcggcagacgctggatttgcagcaggctcagttgaggctgctgtatcaaaaaatgcaggacaggaatcccgacgcgcaagagccgtattccctgcgcgacgagattccgccgcattattga

SEQ ID NO: 6120 - DNA, 1389 bp, Neisseria meningitidis
atgaatgcagtcgtagttgccgtaatcgttatgctggtgctgtcgctgtcgcgcgtgcacgtggtattgagcctgacggtcggcgcgtttgtcggcggcgcggtggcgggtatgccgctgcaaaacattgccgatgcggcgggacaggtcagtcaggcggggattatccccgtgttcaacaaaggtttggaaggcggtgcgaagattgcgctttcttatgcgatgctcggcgcgtttgcaatggcgattacccattccggcctgccgcagcagcttgccggcgcggtcgtccgcaagctgaaccggggcggtatgcccgacagcgtgcgttcgggcgagggcgcggtcaaatggctgctgctttccatcatccttgtgatgggcatgatgagtcagaacatcatccccatccacattgcctttatcccgatgattgttccgccgctgcttttggtgttcaaccgcctgaaaatcgaccgccgcctgattgcgtgcgtcatcactttcgggctggttacgacttatatgttcctgccttacggcttcggcgcgatttttttgaacgaaatcctgttgggcaacatccattccgccgcgccgcagcttgatgtgaaaaacattaacgtgatggcggcaatggcgattcccgcgttgggaatgctggccggactcctgctggcgtttgtccattaccgcaaaccgcgcctgtaccaaagcaacaatgccgatacggcgggcaacgccgatgcggcaaaccgtccgcagccgtccgcctaccgcagcctggccgccgccgtcgccattgccgtatgctttgccatccagttgatgtatgaagactcgctggtgttgggcgcgatgctcggtttcgccgtatttatgatgttgggggtcattaaccgcgacaaggcaaacgacgtattcggcgaaggtatcaagatgatggcgatggtcggcttcattatgattgccgcgcagggttttgccgccgtgatgaatgcgaccgggcatattcagccgctggtggaaagcagtatggcgatattcggcaacagcaaaggtatggcggcattggcgatgctggtggtggggcttttggtaacgatgggcatcggttcgtccttttccactttgccgattattgccgcgatttatgtgcctttgtgtgtcggtttgggtttttcgccgcttgccaccgtcgccattgtcggcacggcgggggcgttgggcgatgccggttcgcctgcgtccgattccacgctgggcccgacgatggggctgaacgccgacgggcagcacgaccacatccgcgattccgttatcccgaccttcatccactacaacatcccgctgctgattgccggctggattgccgcgatggtgctgtaa

SEQ ID NO: 6121 - DNA, 1272 bp, Neisseria meningitidis
atgcaggaacagaatcggaaaccaagttttcccatagtgatgttgctggtgtcggttgccctgtggatagcgtctttatccaatgttgcattttatttgggcaatcatggaagcatggagggtttgaccgttttgattttggggtcgatatttgcttctttggatatcaggtattgtgcggtctatgcgaattatgtttggttggcggccattgttttgctggcgttgcggaagaaggtcgtgcctgtccatgcggcactttggggcttggcgttggtggctttcagtgtgaaagccgtatacgtcgatgaagcagggaatacatcggatattgtgcgctacggtgcaggattttatttgtggtatgccgcatttgcggttgccaccatcggtacgtttgccggaaagaataaggaaagaaaagccgcatcagcggcagacgggataaaaatgacgtttgataaatggttgggcttgtcaaaactgcctaaaaatgaagcaagaatgctgctacaatatgtttcggaatatacgcgcgtgcagttgttgacgcggggcggggaagaaatgccggacgaagtccgacagcgggcggacaggctggcgcaacgccgtctgaacggcgagccggttgcctatattttaggtgtgcgcgaattttatggcagacgctttacagtcaatccgagcgtgctgattccgcgccccgaaaccgaacatttggtcgaagccgtattggcgcgcctgcccgaaaacgggcgcgtgtgggatttggggacgggcagcggcgcggttgccgtaaccgtcgcgctcgaacgccccgatgcgtttgtgcgcgcatccgacatcagcccgcccgcccttgaaacggcgcggaaaaatgcggcggatttgggcgcgcgggtcgaatttgcacacggttcgtggttcgacaccgatatgccgtctgaagggaaatgggacatcatcgtgtccaacccgccctatatcgaaaacggcgataaacatttgttgcaaggcgatttgcggtttgagccgcaaatcgcgctgaccgacttttcagacggcctaagctgcatccgcaccttggcgcaaggcgcgcccgaccgtttggcggaaggcggttttttattgctggaacacggtttcgatcagggcgcggcggtgcgcggcgtgttggcggagaatggtttttcaggagtggaaaccctgccggatttggcgggtttggacagggttacgctggggaagtatatgaagcatttgaaataa

SEQ ID NO: 6122 - DNA, 1443 bp, Neisseria meningitidis
atgcatccgacctattccgccgtacaggcgcggctgctcgaagccaaccgcctttcccccgaactgctcgccaaaagcctgtgcatcatcggcgcgcaccacgtcgattacgccgacatctactgccagcgcaccgcttatgaaagctggcatttggaagagggcatcgtcaaatcgggcagcttccaaatcaatcagggcgtgggcgtgcgcgccgtttcgggcgacaaaaccgcctttgcctacgccgacagcctgtgcatcgattcgataaaccgttccgcccgcgccgtccgcgcgattggggcggcaggcggcaaggtgtccgccaaaatgccgtctgaaacgcgcggcaagccggtttgttccgcgtccgaccccattgccggcctcgattccgccgccaaagtcgcgctgttgaacaaagtggaagcaatcgccaaagccgccgatccgcgcatcgtgcaagtgatggccggtttgacctgcgaatacgatatggtttacctcgcccgtctggacggcaaacacgccgccgacatccgcccgatggtgcgcctgaacgttaccgttatcgccaaacagggcgaacgccgcgaacagggcagcgcgggcggcggcggacgctacgacttggcttatttcgatgaaaacttggttcatcggtttgtcgatgccgccgtcaaacaggcactcaccaacctcgaatcccgccccgcgcccgccggcgaaatgaccgtcgttttgggcaacggctggccgggcgtgttgctgcacgaagcggtcggacacggtttggaaggcgatttcaaccgcaagggaaccagcgtcttttccggcagaataggcgagcgcgtcgccgccaaaggcgttaccgtcgtcgatcagggtgatattgccggccggcgcggttcgctcaacatcgacgacgaaggcaacgaaacccgccgcaccgtattgattgaagacggcattttagtcggctatatgcaggacgaaaccaatgcccgcctgacgggtacgcagtccaccggcaacggccgccgcgaaagttacgcttccgcccctatgccgcgcatgaccaatacctttatggaaaacggcagctatgagccggaagaaatcatcgcgtccatcgacaagggcatttacgccgtcaactttggcggcggacaagtggacattaccagcggcaagttcgtgttcagtgcgtccgaagcgtggtgggtggaaggcggcaggctgcaatatcccgtcaaaggcgcgaccatcatcggcaacggccccgaagtgctgaaacacgtttccatgataggcaacgatactgcgctcgacagcggtgtcggcgtgtgcggcaaagaagggcagagcgtccccgtcggcgtggggcaaccgactttgcggattgatgccggactgaccgtcggcggcagcgcaatctga

SEQ ID NO: 6123 - DNA, 1224 bp, Neisseria meningitidis; identical to SEQ ID NO: 801

SEQ ID NO: 6124 - DNA, 1101 bp, Neisseria meningitidis; identical to SEQ ID NO: 811

SEQ ID NO: 6125 - DNA, 618 bp, Neisseria meningitidis
atgaccttcccgcccctaaaatccccgctcaaattctacgccgtcgtccccaccgccgattgggtggggcgcatggtcaaagcaggtgccgacacggtgcaactgcgctgcaaggccctgcacggcgatgaattgaaacgcgaaatcgcccgctgcgccgcagcctgtcagggcagccgtacgcagcttttcatcaacgaccactggcgcgaagcaatcgaagcgggcgcgtacggcgtgcatctcggacaagaagacatggacaccgccgaccttgccgccatcgccgccgccggtttgcgcttgggtttgagtacgcactccgttgccgaactcgaccgcgccctgtccgtacaccctagctacatcgccagcggcgcgattttcccgaccacgaccaaacaaatgcccaccgccccgcaaggcttggacaaactgcgcgaatacgtcaaacaagcaggcggcacgcccgtcgtcgccatcggcggtatcgacttgaacaacgcccgagccgtactcgccaccggcgtttcctcactcgccgccgtccgcgccgtaaccgaagcggcaaatcccgaagcggtggttaaagcgtttcaggctttgtgggatggataa

SEQ ID NO: 6126 - DNA, 195 bp, Neisseria meningitidis
atgaacatcatcttaaacggcggacccgccgaacttcacggcacgaccgttgccgacctcatcgcccaaaccgcgccgcaaaagccctttgccgtggcggtcaacaccgttttcgtccccaaaggcgcgtatgcggaaacggttttaaacgaaaacgacaaaatcgatatcgtgcggccggtggtcggcggctag

SEQ ID NO: 6127 - DNA, 789 bp, Neisseria meningitidis; identical to SEQ ID NO: 1453

SEQ ID NO: 6128 - DNA, 144 bp, Neisseria meningitidis
atggaaaaaccggccggaaaaccttgccgcccgtcccgatgccgcaaccaacgaaacactcggcctccacggtgtgcaggctgccgcgcaagccctaaatacggcaatagaagaagcgttttgttgttgtttgaatacacttaa

SEQ ID NO: 6129 - DNA, 204 bp, Neisseria meningitidis
atgacaaccctgtccgcgccaaatcggacggatgttcaaacacgggcaaccttatttccgtcaggcacgaagccctcagctatgcctgccgaccccgatttgtccgacacaatgaaagtttgccgacccgaatcacaaacatcggcggacaggttaatttgtttatttttcatcgtattacaaaaaatctgcatttatttttaa

SEQ ID NO: 6130 - DNA, 867 bp, Neisseria meningitidis
atgaaatggctatttatccttttggttgcgattaatattgccgtattcggcggtacggtaggttacaaactgacactgaaacaggccggcagaataccggaggcacagaatgccgcaaacaatttgcaggttcaaccagttgccccaactatgccggttgttcggaatattccagcatccggtcctgtcgttcaggcggcatctgaatcggatacaggcgcactgctcaaacagggcgacattctgagcgaagaacaggcggagcagttgcgcttgaaaaaagaagcggaacagaaaaaactgaaagagaaaaaacagcgtgaagaaaaagcccgccgcgaaaaactcgccgccgaaaaggcgcaggcggaacgcgaaaacggcgcggcggatgccttatgcgccgcgcaggcaagcctcacgatggacgaagatgactaccaccgcatcaaaggacttttgggcaaatggtcgcacgttgccagcaggagcgtcgaaaaacgcaccgcccaagccaaacctgccgacaaaacctaccgcgtcgtcctgcccgtttccgccgatgccgaaaatcaggcggcggagctgtctgccaaaggtttcaaccccataccgtttgacggcgcattgagtttgggtgtcggcaacagccgggaaaacgcccaagccctgcaaaaccggcttgccggcgccggattcggcggggcgcatattgtcgaacactttgccgaagccgacaggcaggacgattctttgagcgtgtcgcgtatgacggttttgtttaccggcgtgaatgccgccgatgcggacgaaattcgtaaaatcacgtccctatacggcaaactgaacctcaagtcttgcaaatag

SEQ ID NO: 6131 - DNA, 1779 bp, Neisseria meningitidis; identical to SEQ ID NO: 233

SEQ ID NO: 6132 - DNA, 507 bp, Neisseria meningitidis
atggttgacgcttggtctgtccctgattttgaatcgaaaatctgtccgcccgaggcgttggcggcgcgtttggcgttgttgccgcgcccgctggtgtttaccaacggctgtttcgacatcctccacagggggcacgttacttatctggcgcaggcgcgttcgatgggggacgcgttggtgctggcgttgaataccgatgcttcggtgcggcgtctgggcaagggcggtgaccgcccggttaatcctttggagaaccgtgccgccgttgccgccgctttggaaagtgtggatttggtaacgtggtttgacggggatacgccggcggcgttgattgaggcggtcaaacctgagattttggtcaagggcggcgattgggctgcggataagattgtcggtgcggcagaaacgttggcgcgcggcggtcaggtgttttcaattccgtttctgcaccagacttcgacaacgaagactttggcaaaaatccgtgcggcagagggcggaaaatga

SEQ ID NO: 6133 - DNA, 854 bp, Neisseria meningitidis
atgtcggcacaactgatcaatggtaaagaagtttcgcaaaaacgcctgcaggcggttgccgaagcggtggcgcaacgccaacagaacaatctgcacacccttgcctggccgtggttttggtcggaggcgaccctgccagcgcggtttatgtccgcaacaagaaaactgcctgccaaaaatgcggcatcaaatcactgtcttacgagctgcccgaatcaacatcgcaggaagaactgctggcactggtcgaccgcctgaatgccgattccgaagtggacggtattctggttcagctaccgctgccgaagcacctcgacagccaggcggttttggaacgtatttcgccggataaggacgtggacggcttccatccttacaatgtcggcaggctggcggtcaaaatgccgctgatgcgcccgtgtacgcccaagggcgtgatgacgcttttggaagcttacggcattgatccgaaggggaaaaaagcggtcgtggtcggcgcgtcgaatatcgtcggccgcccgcaggctttggaactgctgctggcgcgcgcaacggtaacggtctgccacagcgcaaccgaaaatctgacagacgaggttgccggagccgatattttggtggtcggcgtaggcattccgaactttgtcaaaggcgaatggatcaaacctggcgcggtcgttattgatgtgggcatcaaccgtttggacgatggcagcctgtgcggcgacgtggaatttgaaacggcaaaagaacgggcggcgatgattacgcccgttcccggcggcgtgggtccgatgacgattgccacattgatggaaaacaccctgcacgcggcttcactgcacgatgcttga

SEQ ID NO: 6134 - DNA, 582 bp, Neisseria meningitidis
atggaagaaaaaaacgactacaccgacgcggcatccgacaaccgcaacgggcaggaaattgaagtcggaattgccggtgcaggcgaccggatacttgccgcgctgctgaaccaattgtttacctttttggttttgttggtgccgtttgccggactgattgctttcgccatcaagaatgaaggcaggattggcagcggcgaagaaatattcgggctgcttttgggcatgacttccttttgggtaggactggcaggcattttggcgtacaccgtcatccaaatctactatatgagccgggacgggcagtcattgggtaagaaaatcatgagaatccgtgtgttgaaaaccgacggccgcaatcccggttttgtcggcacggttttggtacgcgaaatcgcatggtcggttttggttgccattattgccgccgttatcggtcttgcagtaggtgacaacggagaaaacgccatcaacctgctggcattccttgccaactttgtcctgctctttatggtcaaacgcgaccgccgcacgctttacgacatactggcggatacggttgtcgtcaagctgcccaaataa

SEQ ID NO: 6135 - DNA, 1116 bp, Neisseria meningitidis
atgaaagtaggtttcgtcggctggcgcggtatggtcggttcggttttgatgcagcgtatgaaagaagaaaacgacttcgcccacattcctgaagcgtttttctttaccacttccaacgtcggcggcgcagcccctgatttcggtcaggcggctaaaacattattagatgccaacaatgttgccgaactcgccaaaatggacatcatcgttacctgccaaggcggcgattacaccaaatccgtcttccaagccctgcgcgacagcggctggaacggctactggattgacgcggcgtcctcactgcgcatgaaagacgacgcgattatcgtcctcgaccctgtcaaccgcgatgtcctcgacaacggtctcaaaaacggcgtgaaaaactacattggcggcaactgcaccgtttccctgatgctgatggctttgggcggcctgttccaaaacgatttggtcgaatgggcaaccagcatgacctaccaagccgcttccggcgcgggcgcgaaaaacatgcgcgaactcatcagcggtatgggcgcggttcacgcccaagtggcggacgcgcttgccgatcctgccggctcgattctcgacatcgaccgcaaagtatccgatttcctgcgcagcgaagactatccgaaagccaacttcggcgtaccgctcgccggcagcctgattccgtggattgacgtggatttgggcaacggccagtccaaagaagaatggaaaggcggcgtggaaaccaacaaaatcctcggccgcagcgacaatccaaccgtgattgacggcctgtgcgtccgcgtcggcgcgatgcgctgccacagccaagccatcactctgaagttgaaaaaagacctgcctgtttccgaaatcgaaacgattttggcaggcgcgaatgactgggtgaaagtcatccccaatgaaaaagaagccagcatccacgagctgactcctgccaaagttaccggcacgctgtccgtccctgtcggacgcatccgcaaactgggcatgggcggcgaatacatcagcgcgttcaccgtcggcgaccaacttttgtggggcgctgccgaaccgctgcgccgcgtattgcgtatcgtgttgggcagcctgtga

SEQ ID NO: 6136 - DNA, 531 bp, Neisseria meningitidis
atgcagggttttgaactcgaagatttgacgctttggctgatacgcgatgccggagaggatcagatgtggatagaccgttgggcgatcagttatcccgtcgtgcagatgtccgaagcgtcggccggtcaaagcataggggaatggcaggcagggcttcagacggcatttgaacgcatacgcggcaaatacgtcgccgttgtcgcacacggtgcgggcgcggccgcatttttggcgtggctgtatcaggcagacatcctgacacggaagaaaattgccaacatcatccttgtaccgcagcgtcccgatatttttcccgacgatgcggaacacgctttccaacgcgtccgctgtccctgccgtgccgcattggttgtacccgaacacggcggcgtgccgcacggttgggcgcaaaaacaggcggatttgtggaacgcccgcctgttggtttccccgcattcgggcagtttgaacggcatgctcggcggctggcagtggggtatgaagctgatgcaggaaatgttgctggcgtga

SEQ ID NO: 6137 - DNA, 345 bp, Neisseria meningitidis
atgctgccgaataaggttttgggtaaatatgattggaatgtggacggaaaaacaggaataggcgcggcatgggtcgtcgctgcgtttatcctgcccatgttggtgtgggcgatatttatgttgtcgcggatgcaaggctggcttgcgccgaccaaggcaaacccgatatgggcgttggtgtggctgctgatttgcctgccctgcctgctgattgcgtccaaatgtttgggttggaaaggctggcggcgggtggtgaatatttttgcctgcctgaccgtctgcgccatattgagcgtacccgcttcgctgctcatcgcctttaccctccgggacctgctgaaatag

SEQ ID NO: 6138 - DNA, 780 bp, Neisseria meningitidis
atgcttaaaatcatttccgccaacgtcaacggcatccgctccgcctacaaaaaaggtttttacgaatacatcgccgcatcgggcgcggacattgtctgcgtgcaggaactcaaagcgcaggaggctgatttgtctgccgatatgaaaaatccgcacgggatgcacggtcattggcattgcgccgagaagcgcggttacagcggcgtggcggtgtacagcaaacgcaaacccgacaatgtgcaaatcggtatgggcattgaagaattcgacagggaagggcggtttgtgcgttgcgatttcggcaggttgagcgttatctcgctttatttgcccagcggcagcagcgcggaagaacgccagcaggtgaaataccgtttccttgatgcgttttaccctatgctcgaagcgatgaaaaacgaagggcgcgacattgtcgtctgcggcgactggaacatcgcccaccaaaacatcgacctgaaaaactggaaaggcaaccagaaaaattcaggtttcctgcctgaagagcgcgagtggataggcaaggttatccacaagctcggttggacggatatgtggcgcacgctttatcccgatgtgccgggctacacttggtggagcaaccgagggcaggcgtatgcgaaagatgtcgggtggcgcatcgattatcagatggttacgcccgaacttgctgccaaagccgtgtccgcacacgtttataaagatgaaaaattttctgaccatgcgccgctggtcgtggagtatgactatgctgccgaataa

SEQ ID NO: 6139 - DNA, 1422 bp, Neisseria meningitidis
atgaccaccatctacaacaccctaacccgtcaaaaagaacccttttcccccatcgaccctgaaaacgtgcgtatgtacgtctgcggtatgaccgtttacgattactgccatttgggacacgcccgcgtgatggtggtgttcgacatgattgcccgttggttgcgcgagtgcggctatccgctcacttatgtacgcaacatcaccgacatcgacgataaaatcattgcccgcgcggctgaaaacggcgagaccatcggcaaactgactgcgcgtttcatccaagccatgcacgaagatgccgatgctttgggcgtgttgcgtccggatattgagccgaaggcaacggaaaacattccgcaaatgattgccatgattgaaaccctgattcaaaacggcaaggcatatcctgccgcaaatggcgacgtttactacgccgtgcgcgagtttgccgcttacggacaattgtcgggcaaatcgttggacgacctgcgtgcgggcgaacgcgtggaagtggacggtttcaaacgcgatccgcttgattttgtgttgtggaaagccgccaaagcaggcgaaccggcgtgggaaagcccgtggggcaacggccgtccgggttggcacattgaatgctctgccatgagtgaaaacctgttcggcgataccttcgacatccacggcggcggcgcggatttgcagtttccgcaccacgaaaacgaaattgcccaaagcgtcggcgcgacggggcatacctgcggtcatcatcacgcgcaaacccaccacgggcaaagcatcgccagccacgtcaaatactggctgcacaacggctttatccgcgtggacggcgaaaagatgtccaaatcgctgggcaacttcttcaccatccgcgaagtgttgaaacaatacgatccggaagtcgtgcgcttcttcatcctgcgcgcccactaccgcagcccgttgaactattccgacgcgcatttggatgatgcaaaaggcgcgttgacgcgtttgtatacgactttgaaaaatacgccgcccgccgatccgatgccgtctgaagccggcgatgactacacgcgccgcttttatgttgcgatgaatgatgattttgatacggtgaaagcggtggcggtgttgttcgaacttgccggcgaagtgaacaaaaccaatgacgcgcaactggcaggccgtctgaaagccttgggcggcatcatcggactgctgcaacgcgatccgaccgagttcctgcaaggcggcgcggcttcagacggtctctccaacgaagaaatcgaagacttgatcgcccggcggaaacaggcgcgcgccgataaaaactgggcggaatccgaccgcatccgcgaccttctgaacgaacacaaaatcattttggaagacaacgccggcggcacgacttggcggcgcggttaa

SEQ ID NO: 6140 - skipped

SEQ ID NO: 6141 - DNA, 1050 bp, Neisseria meningitidis
atgtcatctaaccaatatatccagtcgcttgagttgacaaactttaccgttcttccaaacgatacttttgaattttctgaaaatctcaatgttattgttgccgaaaacggttgtggcaaaacacatttgttaaaaattttatacagcctgctagaagtaacatctaacaccaaaaacagattactgaaaacagaattgcaaaaaagttttgccgataaattactgaatgttttccgtcccgattccttgggtaggttgagcaaacgtttgcaggggcgcgggcgtacggaaatcgttttaaaactgcaaaacggcactacgcatagtagtctgaatttttccagtaactcatcatcgcaagtcaatgttcaaagcatcggattgaaagaaaatgaatatactccgacacctatcttcttacccagccgcgaattaattacactttgcccttggttcacttctttgtatcaaaaccaaagcatccctttcgaagaaacttggtttgatacctgtatgcaattaaatcacccgcttgccaaaggccccagagaaacaaaaattcgagaattgctcgaacctattgagaacgcgatgggcggaaaagtatctgaagaacaaggaaggttttatctatcgctgacaaatacgggcggtaagattgaagcacctttggtagcagagggtttgcggaaatttgtcatgattgcccggttaatcgcaacaggggcattgctggataaaggctatctattttgggatgaaccggaagctaatctgaatcctaaattgatcaaagtggctgcccgtattatttggtctttatctcaacagggtattcaggtttttattgcaacacactctttattcttattgagagaattggaacttttgaagcttgaaaataacacggatttacctgtacgttttttctcgttgattgcttccgatgatggaacaaaagtggagcaagggaacagtattaatgatttgaacacattgatattgttagatgaaaacattatgcaggcagacaggtatctgaatatttga

SEQ ID NO: 6142 - DNA, 1155 bp, Neisseria meningitidis
atgaaattcatcgacgaagcaaaaatcgaagtcgccgcaggcaaaggcggtaatggcgcaaccagtttccgccgcgaaaaattcgtaccgcgcggcggcccggacggcggcgacggcggcaaaggcggcagcgtctgggcagaagccgacgaaaacaccaacaccctcgtcgaataccgcttcgttaaacgctaccaagccaaaaacggcgaaaaaggccacggttccgaccgttacggcgcaggtgcggacgacatcgtcctcaaaatgcccgtcggcacccttatccgcgacctcgacaccggcgaaaccgttgccgacctcacttatcacggacagcgcgtctgcctcgccaaaggcggcaaaggcggcttgggcaacatccacttcaaatcgtccgtcaaccgcgccccgaaacaatccacccccggcgaagaaggcgaagcccgttccctgcaactcgaacttaaagtcctcgccgatgtcggcttattgggtatgcccaacgccggcaaatccaccctgattaccgccgtatccgccgcacgccccaaaatcgccaactaccccttcaccaccctgcatccaaacttaggcgtggtacgcatcgacgaaaaccacagcttcgtgatggccgacatccccggcctgattgaaggcgcggcagaaggcgcaggcctcggccatcgtttcctcaaacacttatcacgtaccggcctgctgctgcacgtcgtcgatttggcgcccttcgacgaaaccgtcaaccccgccgaagaagcactcgccatcatcaacgaattacgcaaatacgacgaagaactctacggcaaaccgcgctggctggtactgaacaaactcgatatgcttgacgaagaagaagcccaaacgcgcactgccgccttcctcgaagccgtcggctgggactaccccaaacccgacgaccgtttccaatttgacatggaaaccccgcgcctcttccaaatcagtgcgctgacccaccaaggcacgcaggaattggtacaccaaatcaaccaatacctgaccgagaaaaaacgtatcgaagctgaaaaagcagaagcggagaaagcagcggcaaatgttgaaattatcgaacagcagcctaaaacggatacaggcgtgtttaagccggagtga

SEQ ID NO: 6143 - DNA, 363 bp, Neisseria meningitidis
atggcgacgtgtccggcgacggcggcaaacagcagcaagcccaaattgccgtggaacgtgttgcccaagtttgccatccactcgattttttccggcgaacccttgcatcacttcaacgccgaacactttcaacgggccgcggccgctgccgtattggcggatcatgccgataacgggaacagcaagcatgagcagatacagaatgccgtggcctgccgccgcagccttgcagtcgctttgcggacgcttggcgcggttggcaaccgcccacacgatgcgcaatgtaatcaccgtcagcgtaaggaaaccgaaagatttgtgcaggccgaacaggctgcccacccattccgcctcttcgtatag

SEQ ID NO: 6144 - DNA, 876 bp, Neisseria meningitidis; identical to SEQ ID NO: 287

SEQ ID NO: 6145 - DNA, 348 bp, Neisseria meningitidis
atgcgcctaaaccacaaacagggcgaggcaggggaagatgccgcgcttgccttcctccaatcccaaggctgcacgctgcttgcccgcaactggcactgcgcctacggcgaaatcgacctgattgtcaaaaacggcggcatgattctgtttgttgaagtaaaataccgcaaaaatcggcaattcggcggtgtcgcatacagcatttccccatccaaattattgaaactgcaacgaagtgtagagtattatctgcaacagaacaggttgacaaacgtaccgtgccgcctcgatgcggtacttatcgaaggcagccgcccgcccgagtggatacagaatattacaggttga

SEQ ID NO: 6146 - DNA, 594 bp, Neisseria meningitidis
atgacgacattacaagaacgcgttgccgcccattttgccgaaagcatccgtgccaagcaggaagccggaaaagtattggtcgagccgaccgtacaggctgccgagctgatgctgcaatgcctgatgaatgacggcaaaatcctggcctgcggcaacggcggttcggctgccgacgcgcaacacttcgccgccgaaatgaccggccgttttgaaaaagaacgcatggaactcgccgctgtcgcgctgacaacagacacttccgcgctgacagccatcggcaacgactacggtttcgaccacgtattcagcaaacaggtgcgcgcgctcggacgtgcaggcgatgtattggtcggcatttccacctccggcaattccgccaacgtcatcgaagccgtcaaagccgcacacgaacgcgatatgcacgtcatcgccttgaccggccgcgacggcggcaaaatcgccgccatactcaaagacaccgacgttttgctcaacgttccccatccgcgcaccgcccgtattcaagaaaaccacatcctgctgatacacgccatgtgcgactgtatcgactccgtactgctggaaggaatgtaa

SEQ ID NO: 6147 - DNA, 609 bp, Neisseria meningitidis; identical to SEQ ID NO: 3865

SEQ ID NO: 6148 - DNA, 633 bp, Neisseria meningitidis
atgccgtctgaaccgccttcagacggcattgcccgacaccccaaaagcacaatcaaaatggcaaaaaaaccgaacaaacccttcaggctgacccccaaactcctgatacgcgccgtattgctcatctgtatcgccgccatcggcgcattggcaataggcatcgtcagcacattcaacccgaacggcgacaaaacccttcaagccgaaccgcaacacaccgacagcccccgcgaaaccgaattctggctgccaaacggcgtagtcggacaagatgccgcccaacccgaacaccaccacgccgcctcatccgaacccgcacagccggacggcacagacgaaagcggcagcggactgccgtcccctgccgcacccaagaaaaaccgggtcaaaccgcaacctgccgacacagctcaaaccgacaggcagccggacgacgccggaacacaagctgaaaacacactcaaagaaacccccgtactgcccacaaacgtcccccgtcccgaaccccgaaaagaaacacccgaaaaacaggcgcagcccaaagaaacgcccaaagaaaaccataccaaaccggacaccccgaaaaacacgccgcccaaaccccataaagaaattctcgacaacctcttctga

SEQ ID NO: 6149 - DNA, 780 bp, Neisseria meningitidis
atgaacggcatcatcatcaaaacccccgaagaaatcgaaaaaatgcgcgagctgggcaaactcgtcgccgaagccctcgactacatcggacaattcgtcaaacccggcgtaaccaccgacgaaatcgacaaactcgtttacgactaccacgtcaacgtccaaggcggctatcccgcccccctgcactacggcaacccgccctaccccaaatcctgctgcacctccgtcaaccacgtcatctgccacggcattcccgacgacaagccgctcaaagaaggcgacattatcaacatcgacctcaccatcaaaaaagacggcttccacggcgactccagccgtatgtttaccgtcggcaaagtctcccccatcgcccaacgcctgatcgacgtaacccacgcctccatgatggcgggcatagaagccgtcaaacccggcgcgacactgggcgacgtaggttacgcctgccaacaggttgccgaaaacgccggctattccgtcgtacaggaattctgcggacacggcatcgggcgcggtttccacgaagccccgcaagtgttgcactacggaaaaaaaggacagggccccgttctaaaaccgggtatgatttttaccgtcgaaccgatgatcaaccaaggcaaacgccacctgcgtatcctcaacgacggctggacggtggttaccaaagaccgctccctctccgcccaatgggaacacgaagtcttggtgaccgaaaccggctacgaaatcctcaccgtcagccccgcctccggcaaaccctga

SEQ ID NO: 6150 - DNA, 300 bp, Neisseria meningitidis
atgaaaatatttgaaaatatagaagatgttaaagccatccgtaaaaagaccgggctgaaccagatagacttctggggcaaggtcggcgttacccagtccggaggatcgcgctacgaaaccggccgcaaaatgcccaaacccgtacgcgaactgctccgcctcgtccatatcgaatgcatcgatttggcgaaagtcaacaaaaaagatatggaaatcgccgccctgttgaaaaaacaccatcccgacctgtatgccgagttgtccaaacagaccaagtccgaaagaaaaaaacaaagttaa

SEQ ID NO: 6151 - DNA, 375 bp, Neisseria meningitidis; identical to SEQ ID NO: 905

SEQ ID NO: 6152 - DNA, 1467 bp, Neisseria meningitidis; identical to SEQ ID NO: 1675

SEQ ID NO: 6153 - DNA, 90 bp, Neisseria meningitidis
atgcttgcaacgcattccaaccccgaaacagcatactcggacacacaccattgccggttttccctgcttttgcgattcaggcgtttgtag

SEQ ID NO: 6154 - DNA, 591 bp, Neisseria meningitidis
atgtcggaaaagataatactgccggtcttgtcgttgggcggcgttcgtctcgaaccgttggatgtgcatcatgaaacgggtttgcgcgaggcggtttgcgatggggaggtttggaagctgggggtaacgtccgcgccccatccggatagggtggcagactatatcgggacagcattggcaacgcgtttggcgtttgcggttgtcgatgaagaggcgggcagggtggtcgggacaacggcgtattatcattttgaaccgcagattccgcgtttggatatcggattcacatggtatgcggcatcggcacggcggacacggataaacacctgttgcaaaatcatgctgttggattccgcatttgatgttttggcttgccgttgcgtgggatggcgcacggatattctgaaccttgcctcgcaacgtgccatcgaacggctgggtgcggaaaaagacggcgtgctgcgtatgcatatgctccgtaaagacggcagtgtgcgcgatacggtcgtgtacagtatgctgagggaagattggtgcaaaaacagggaaatcctgaccggcaggttggcagggtatggcgtgcaggtgtga

SEQ ID NO: 6155 - DNA, 582 bp, Neisseria meningitidis; identical to SEQ ID NO: 1633

SEQ ID NO: 6156 - DNA, 234 bp, Neisseria meningitidis
atgtggcacatcgtcgccatcggctatctttttgttgccgttatgtattccgccgcgcagccgagtattgcgcgcgccttgatttatttggttttttgggcggtgctgcccaccgtgttcacggttttcaccattaccgtccgccgccgcaaccacctgatgaggcagcaggaacaggcggaatccgaacagcagcgcgcacaacggcaaaaagacagcggcacaaaaccctga

SEQ ID NO: 6157 - DNA, 729 bp, Neisseria meningitidis
atgtctcaaattactatgcgtcagatgattgaagccggtgttcacttcggccaccaaacccgtttctggaacccgaaaatggcacaatacattttcggtgcgcgcaacaaaatccatatcgtcaacctggaaaaaaccctgccgatgttccaagacgcgcaagaagccgtacgtcgtctggttgccaacaaaggtacagtattgttcgtaggtaccaaacgccaagcccgcgacatcatccgcgaagaagcgacccgcgccggtatgcctttcgtcgattaccgctggttgggcggtatgctgaccaactacaaaaccgttaagcaatccatcaaacgcctggaagaaaaaaccgcagccttggaaaatgctgccgaaagcggtttcagcaaaaaagaaattctggaaatgcaacgcgatgttgaaaaactggaacgttctttgggcggtatcaaaaacatgaaaggcctgcctgacgcgattttcgttatcgataccggctaccaaaaaggtactctggttgaagctgaaaaattgggcatccctgttatcgccgtagtcgataccaacaacagccccgacggcgtgaaatacgttatccccggcaacgacgactccgccaaagccatccgcctgtactgccgcggcatcgctgacgcagttttggaaggcaaaaaccaagcgctgcaagaaaccgtagccgctgcccaagaagccgctgccgagtaa

SEQ ID NO: 6158 - DNA, 855 bp, Neisseria meningitidis
atggcagaaattactgcaaaaatggttgccgacctgcgcgccgctaccggcctgggcatgatggaatgcaaaaaagccttggttgaagccgaaggcaacttcgacaaagccgaagaaatcctgcgtatcaaatccggtgcgaaagccggtaaactggccggccgtaccgctgccgaaggcgtattggcttacgcgatcaacggcaatgtcggcgcattggtcgaagtaaactgcgaaaccgacttcgttgctaaagacgcgggcttcgtagaatttgccaacttcgttgcgaaaactgctgccgagaaaaaaccggcttctgttgaagaactgagcgaactggttgaagcagaacgcaaagccatcatcgccaaattgggcgagaatatgtctgtccgtcgcttccaagtgatcgacactgccaaccaactggttgcctacatccacggcgcattggcgaccgaaggcgtattggttgagtacaaaggctctgaagacgtagcacgcaaaatcggtatgcatattgttgccgctaaaccacaatgcgtaagcgaagccgaagtagatgccgaaaccgttgaaaaagaacgccacatctacaccgagcaagccatcgcttccggcaaacctgccgacatcgccgctaaaatggttgaaggccgcatccgtaaattcttggctgaaatcactctgaacggccaagcattcgtgatgaaccccgatcaaactgttgcccaattctctaaagaaaacggcactgaagtgatcagcttcgtacgctacaaagtaggcgatggtattgagaaaaaagccgtcgattacgcagccgaagttgctgccgctgctaaagtgtaa

SEQ ID NO: 6159 - DNA, 720 bp, Neisseria meningitidis
atgacacagcaaatcaaatacaaacgcgtattactgaaactctccggcgaatccctgatgggttccgatccgttcggcatcaatcacgataccatcgttcaaactgtcggcgaaattgccgaagtcgttaaaatgggcgtgcaagtcggtattgttgtcggcggcggcaatattttccggggcgtatccgcccaagcaggcagcatggatcgcgccaccgccgactacatgggcatgatggcgaccgtgatgaacgcgttggcactcaaagacgcatttgaaactttaggcatcaaagcgcgcgtacaatccgcactgtctatgcagcaaatcgctgaaacctacgcccgccccaaagccatccaatatttggaagaaggcaaagtcgtgatttttgccgccggtaccggtaacccgttcttcacgaccgacactgccgccgcattgcgcggtgcggaaatgaactgcgacgtgatgctcaaagccaccaacgtcgacggtgtgtacaccgcagacccgaaaaaagacccgtccgccacgcgctacgaaaccattacttttgacgaagccttgttgaaaaacctcaaagtcatggacgcgaccgctttcgccctctgccgcgaacgcaagctcaatattgtcgtcttcggcatcgccaaagaaggctcgctcaaacgcgtcattaccggcgaagacgagggaacgctggttcactgctga

SEQ ID NO: 6160 - DNA, 964 bp, Neisseria meningitidis
atgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacaggggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttga

SEQ ID NO: 6161 - DNA, 1452 bp, Neisseria meningitidis; identical to SEQ ID NO: 165

SEQ ID NO: 6162 - DNA, 357 bp, Neisseria meningitidis
atgaatgaacacaacctgttaattttctgtttaaaagacaatgtttcaattagtgaatatactgaaatggttgattgggcttatgaaaacattcaatctgaaacagttgtagaaattacggaaaatcaaattattgaatatcaaaatcgtggattatgggggcttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaagaatgaaaaaacagtaatttttcatttttga

SEQ ID NO: 6163 - DNA, 765 bp, Neisseria meningitidis
gtcggattctcgaatccgatattttccaacagcggcatttcggaaacgatagatgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcatcaattccgccagacaatgggctgatgcccatccgaatataacagcaacagcccaaactgcccttgccgtagcagaggccgcaactacggtttggggcggtaaaaaagtagaacttaacccgaccaaatgggattgggttaaaaataccggctataaaacacctgctgttcgcaccatgcatactttggatggggaaatggccggtgggaatagaccgcctaaatctataacgtccaacagcaaagcagatgcttccacacaaccgtctttacaagcgcaactaattggagaacaaattagtagtgggcatgcttataacaagcatgtcataagacaacaagaatttacggatttaaatatcaattcaccagcagattttgctcggcatattgaaaatattgttagccatccaacaaatatgaaagagttacctcgcggtagaactgcgtattgggatgataaaacagggacaatagttatccgagataaaaattctgacgatggaggtacagcatttagaccaacatcaggtaaaaaatattatgatgatttatag

SEQ ID NO: 6164 - DNA, 207 bp, Neisseria meningitidis
atgaatatactatccataaataatcaaaactcaactatttcactaactcaagatgaagtttttgttttacgagctatcttgaatgagatatatgcgggcgtatgtgtagattcaagagaatttgaaaatgtatctggtgttagaaaacatgaagtagataatttacaacaacagtttgctggaatttataaaaaaatgacaacttaa

SEQ ID NO: 6165 - DNA, 252 bp, Neisseria meningitidis
atggataacacgcgtattatggcagcacgtgaagcaggagtaaaagtggaagcgaatgttcataattttaatgaccgattatcatcaaaagagagaatcaggtttaagcatgatggtattgagcctcaaacttggggagaagctatccagctacgaattagaaagcaagaaacacaaaaaggagttccagaagggtggagcaaaagatttcctaacggaagtatttatgatgtaaaggtacttaggaaatga

SEQ ID NO: 6166 - DNA, 372 bp, Neisseria meningitidis
atgataaaacaaaatagttttgttccgtatcctgaagcaatgcttcctaaaggatttaaatatccgcaaagttatttaaaattagctcaatccactcatgccattaactacgatgaacaatattcttttccttggtggtttgaaaatgcagaaagcaatatatcagaagtaattgacatttattttgaaataactggcattccaaacctattaccttttgctagaaaccaagagtgggctgcctgttttgatatttcagataaatcaggtaatcctaaaattatagtagttaatttagataatacaaaatattacgagacttttgaaaattttgatacttggctaaaagaagctgaaaatgatggttggtag

SEQ ID NO: 6167 - DNA, 846 bp, Neisseria meningitidis
gtcggattctcgaatccgacatttttcaacagcggcatttcggaaacgatagacgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcattaattccgccagacaatgggctgatgcccatccgaatataactgcaacagcccaaactgccctttccgtagcagaagccgcaactacggtttggggcggtaaaaaagtaaaccttaacccgaccaaatgggattgggttaaaaataccggctataaaacacctgctgcccgccctatgcagactttagatggggagatggcaggtgggaataagccaccaaaaccaagtacgcagcaacaccctacacactctgataacaatatcggcttacctgcctcatatgttaaacctgatacatctatttctccgacaggaacaattcaagaccgcatcagatggacaaagtccaagtttcctactgagaaatctttaaatggacatttcaaagctcatggaaaagaatttggcgatataaccattgaagactaccaaaaaatggcgtctgatttgttatcaaaacagacatcggacaagatattaggttatcagacggaacatagacgagtgcgctatgatatcaataacaatatctatgttttggccaatccaaaaacattcaaaatcaaaacaatgtttaaaccaaacttaggaaagaagtattatgatggagaattcaaaaaagacatgggaaattga

SEQ ID NO: 6168 - DNA, 270 bp, Neisseria meningitidis
atgatgacggaatcccatggttacctatcaaataatttacctgttaaaatcataaatgatattatttatgcaacccagttagtcgaagatttggttttaggaaaaataaaaattgttgattttttaaaatcatataacaatttttattgttggcttggttttgatgagttgcctcaatctgagaaaataaaattcctaagctatcttaatatattaagtattcataaagaaatacaagatgaaactgtgaatagggtttataccgattga

SEQ ID NO: 6169 - DNA, 303 bp, Neisseria meningitidis
atgttaaatgaaatttttgaaatttattcgagacaaggggaatctttgataggaattggaattagagaagccgcattacccgtccctattgcaatagatatattaaatttatttatcaatgagagaatacttgtattggggggagatatttatatcaagaaagataattatttttatcaaacatatgataattggtattacgagggaagtaatttatttaacagtatcgacaaagcaatgcattatttatctcaaataaaattagagaatgcatacgtatcttttgtgttgaaatttatctaa

SEQ ID NO: 6170 - DNA, 639 bp, Neisseria meningitidis
aaatgctgggttttaatccaacctacactgaccggctcagatacagccgctcagcagactctacaaggtattaatgatttaggaaatttaagtccggaagcacaacttgctgccgcgagcctattacaggacagtgcttttgcggtaaaaaacggcattaattccgccagacaatgggctgatgcccatccgaatataactgcaacagcccaaactgccctttccgtagcagaggccgcaggtacggtttggcgcggtaaaaaagtagaacttaacccgactaaatgggattgggttaaaaataccggctataaaaaacctgctgcccgccctatgcagactgtagacggggaaatggctgggggaaacaaatcattaaaaatagggacacaatctgttgaaaaatcaaccggtcgtacaatacctaataatttaaaggaacaattagcaatggaagaagttaaggcaaacccacagggcaaaactcctgcgagaatacctcctatgtccgatactaaaaatggttggttagcaaaagacggttgggttaagcgtgttcaaaacgtaaacaaaattgaaatacattacattgaaaactcaagaaccggtgagaaaacagattttaagtttaaggattag

SEQ ID NO: 6171 - DNA, 345 bp, Neisseria meningitidis
atgtttttagatgatgtaaatgtttttttagatgatttaaatgtttttttagatgatttaaatactaatccaatcactgacgaatggtatatgtccaattttgccgataaacatattaaaattttggaaagttacgaagcctttgatattctaaaacaatttgttgattacatgattgaagaatatgatgaaaaatcagaatatgaaatcatggaaatattgagacaattaaaatatcaagcagataccaacgaaaaattttatacaaatacacagaaacagaaaattgtagaattatataaacaagaaattagtcaggatattttaaatgaaatctttagataa

SEQ ID NO: 6172 - DNA, 345 bp, Neisseria meningitidis
atgataatcgaacacaatggaaatatacataaaatagccagaatgactggaaataaaaataattttttagaaataatcctatcagatattcatgaaaacataaaaatcaaaccattaactataaaagtaaaaggagagaatgttataaatatccttcctgaggaagttagtttttatgtaaaacaaggtgttgatttaatttatgaaaaatataaacggaaattctttatctccgaaatttctttttgccaatcagatagccggccttcaagtatctacgcttttcttacatttcacttgcttgaagatattattaaaaatgaatccccatccaactacacctga

SEQ ID NO: 6173 - DNA, 699 bp, Neisseria meningitidis
gtcggattctcgaatccgacattttccaacagcggcatttcggaaacgatagatgcgtcaaatatttttgtcggatacaaatatccgacctacatctctgcgcagcaaactttacaaggtattaatgatttaggaaatttaagtccgaaagcacaacttgctgccgcaagcgcattataggacagtacttttgcggtaaaagacggtatcaattccgccagacaatgggctgatgcccatccgaatataactgcaacagcccaaactgcccttgccgtagcagaggccgcaggtacggtttggagaggtaaaaaagtagaacttaacccgaccaaataggattgggttaaaaataacggctataaaacacctgctgcccgccctatgcagacgttggacggtgagatggcaggaggaaacaagccagttgttaaatctatcagaccaactacgcgagatgaattacgtcaagcattgcaagaacaaggttttagacgtactggttcagatgcggctcaatatgaaacatggaaaggtcctgatggcgtgaaaatagatattcgtccaaatggagaggttataagaacccaaagagtgccgcgaaccgatggtgtacagggaaaatatccgcaacgacaagattatgaaggcaatccattgccaaataatcatcatcattctggatattttgtcaaatga

SEQ ID NO: 6174 - DNA, 318 bp, Neisseria meningitidis
atgaaaaaaaatatttttcacaatgtaagcctttatgaaataatcttttccgataatggaaatacccttacattatcttttacagatacaattgaaggtaattatttcggatatatcaaatgcagtaatattttgaattttaaattagatacaaataatttcgtagattatgaggataaggaagatagcttgtttcccttgtttatacccgaaatagagctatataaataccaattttatagtgaaattattattgatgtagggattattataaaaatatctgctgaaacaattaattttgagccactgggaaaatag

SEQ ID NO: 6175 - DNA, 759 bp, Neisseria meningitidis
aaatacagttgctacatctctgcgcagcagactctacaaggtattaataattcaggaaaattaagcccggaagcacaacttgctgccgcgagcatattacaggacagtgcttttgcggtaaaagacggcatcaattccgccagacaatgggctgatgcccatccgaatataacagcaacagcccaaactgcccttgccgtagcagaggccgcaggtacggtttggagaggtaaaaaagtagaacttaacccgaccaaatgggattgggttaaaaataccggctataaaaaacctgctgttcgccatatgcagactaaggcgttaggtacggtagatgaaattggcgatacagtacagcaggttgggaaacaggctagcggacaaaaaaccagcggtggtaatcctgcgattgatagcgacccctatagcccgagtagtgtggcagctcgcatagaagccggtaaggcgcgcagtgatttacaaatcaaagacattttgagcaatactactcaaaggagtaaaacaaaaggtcccgctgttcagtatgataaagtgggggattacaatgacgcactaaatgattttaatagtctgaatgttcgaaatgtacaaacacgtcctaatggaacgataacgggcaatttacctgatgggcgtgcggttaatgctcgtaatgatagtagtggtggagaaccaacacttgaaataacaattagtaataaccgaaaaataaaaatcagatatggaaatacacgataa

SEQ ID NO: 6176 - DNA, 402 bp, Neisseria meningitidis
atgaaattaaaaagcttagatttcccaactggctatttctattttgataatgcagcaataaactctgataaagtagaagttatagcagttggttatagaaatacggataaaaccataaaaatttttattgaagatgttattcattttagggttgttgatgaatcgtattttatagatacttttatggatttaatttcggaagatgcagatagagctttgcttcatgaaaatggtggtcaatctttttttgaacttcttgatgagtgttatgcggaatggatattgaaagaaagttattttcctttgaatagagaattctttaaatactatatttttatgtttgagcaaacattcatagaaataattggttctagtgcaacgtattcaattattgagggctag

SEQ ID NO: 6177 - DNA, 345 bp, Neisseria meningitidis
atgaacctagaaaattatgaaaacattttaataaaattacttttttatcataacaacttagtaaatgaatattcttattttattgaaaataaaaatttatttaaaatagtatctcgaacgaaaacgagtaagggcttttttttcactatagaaaaaccattaaattttctaagcaaaaaaacttattttgagtttaattttaaatatttacactcagggaaagaacgctttggttcgtttatgtgctggataaatactaatttaatggaatttgagggggttttttttaacgacctgctccctgataatatgataataaataacttttttgaaataaatgattaa

SEQ ID NO: 6178 - DNA, 105 bp, Neisseria meningitidis
atggatgatattcgcggcatcatccaaggtgcggttaatcctttaatttacaaggtaagcaagcaaaagattatttacaacaacaaactcatatcaggaacttag

SEQ ID NO: 6179 - DNA, 357 bp, Neisseria meningitidis
atgaatgaacacaacctgttaattttctgtttaaaagacaatgtttcaattagtgaatatactgaaatgattgattgggcttataaaaacattcaatctgaaacagttgtagaaattacggaaaatcaaattattgaatatcaaaatcgtggattatggagacttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaaaaatgaaaaaacagtaatttttcatttttga

SEQ ID NO: 6180 - DNA, 129 bp, Neisseria meningitidis
atgccgcaaacatggggagaagctattcaatttagaattaaaaaacaaattgaaaatgaactagcaccaccaaattggtctacccagtttcctaatggtagtatttatgatcctaaggtaacgaaatga

SEQ ID NO: 6181 - DNA, 375 bp, Neisseria meningitidis
atgattattcaaaatgaatttaatttatatcctagtaatatgcttcctgaaaggttttgttatcctgaaaagtatgttcgtatctctaacgatacatctttaataccttatattcagccacataattttcactggtggtttgagaattatggaacagaaggggcagaagtagcttatatatttagaaattctatcctgcctgatttaaatcttatcccattcgctagtaatggagaatgggaagcttattttgatggtaatgatgtaacaggaaattctagggttattgtcattaatttagataatatagaaaaccatgaattttttaatagttttgaagattggcttgaattagcaattaaggatacttggtaa

SEQ ID NO: 6182 - DNA, 838 bp, Neisseria meningitidis
gtcagccgcgtcactatttaccgtgcacttaaagccgtaaaaggcaggttgtccccgggaggttttgtgcatcctgataccgatcggttgttgttgctcaaaggacagaaggccgctgataaacgagattacctgtttgtcgctattgacgatttttatactctgccattttgccggacaaaaccgcagacagtgctgccaagtttctgaccgaacatctgtccgacccctgcttgtacctgattgagtacgtttactctgacaatgataggtaatataaagagccgtccaacatgctttcggtgcagcttgttatgataatgggattggttggaggcttgcccgatttgcttgtccgcagaccaacggtaaggcggagcgggttatccgtaccttgatggagatgtggcatgaggaacagtcgtttgacagtccggaacatcggcaaaaggagttgtgctgctttattaatttaggggctgccctagatcactagggaaattcaaattaagttagaattatccctatgagagaaagtcgtctaagacggtataaacaaaataaactcattttgttatcgtggctatgatgtattggatgcgggcgaatttagccatttccgtatcaatcacagcacacattttgccgaacgacaaaaccatattaatggaactgagaacttttggaatcaagcaaaacgtcatttacgcaagtttaacggcattcccaaagcgcattttgagctgtatttaaaggagtgcgaatggcgttttaacaacagtgaaataaaagttcttgttccattttaaaacaattagtaaaatcgagtttatcctag

SEQ ID NO: 6183 - DNA, 987 bp, Neisseria meningitidis
atgcaataccgaatcagaagagaaaacgaagcacccgaagcaaaaaatgcgggggaaaccttatgggagcgcgacatcatgcgcgaagtgctgttgtccgcctatcaggacaggcgcagggagcggatgtggaaaaacatctggcgcgccgtcagcaccctgattctggttgccctgattgcaggcattttccgaaaagacgaagccgcattgcagttggcgggcaacacgccgcataccgcagtcgtcaatctgtacggcgaaatcggcaacggtgtagaagaccaggtcaaaaaactcaaagacggtatggaggccgcctacaaaaacccgcaggcaaaagccatcgtcatccgcgccaacagccccggcggttcgcccgtcgtgtccaacaccgcttttgaagaaatacgccgtctgaaggcgcagcaccccggcattcccgtttatctcgtggcggaagatatgtgcgcgtccggctgctactacatcgcggcggcggcggacaaaatctatgccgacccgtccagcatcgtcggcagcatcggcgttatcggcagcagtttcgacgcgaccggcctgatggaaaaaatcggcgtgaaacgcagggttaaaattgcaggcagcaacaaaggcatgggcgatccgttttcgcccgaaacgcccgaacagtcaaaaatctgggaagaaatgctgaccggcatacacggcgagttcatcaaagccgtcaaaaccggacgcggcggccgcctcaaattccgacaatatcccgacgtgttcagcggtcgcgtgtacacaggcgcggatgcgctgaaagtcgggctggtggacggactcggcaatatttacagcgtggcgcgagacgtggtcaaagcccccgatgtggtggattacactccgaaggacgatttcggcagaatcttgggcagacgcttcggcgcagaactcaaagcaagcgtgcgcgaagccctgcaggccgtccggtag

SEQ ID NO: 6184 - DNA, 801 bp, Neisseria meningitidis
atgaacgcgttcaacctcatcatcatcggcgacgaaatcttacacggcagcagccaagacaagcatttcgcctttttcaaatccctgctcgaatccaaagggctgaagctcaatcaggtgcaatacctgcccgacgaacccgatttgctggtcaggcaactgcgccgcagcttttcagacggcatgccaactttcgttaccggcggtatcggcgccacgcccgacgaccacacccgccaagccgcagccgctgctttggatttgcccgtcgtccgccattctgaagccgccaagtttatcgaaggcataacccagaaacgcggcgagccgcttgattcgccggaacacgcccaacgcctgaaaatggcagattttcccgaaggcgcggaattggtgcccaatccgtttaacaacatcgccggattttctatccgcgagcattatttcttccccggctttcctgtgatggcgcacccgatggcggaatgggtattggaaacttattacgccgaccgcttcaaccaaaccgaacgcggcagccgcagcgtgtatgtgtttgagcagcccgaatcgcgcattacgccgcttatggagcatatcgagcaaacttatcccggcgtgcgttcgtacagcctgcccagcgtcggttggacgcattcagacggcacgcaggtcaaaccgcacattgagttcggcatcaaagccgaaggagaagccgtcaaccttttggacgcggcgtgggcggaagtgttgcacagcttggacggattgggagcagagctgaaaaatcgggtaaactga

SEQ ID NO: 6185 - DNA, 1344 bp, Neisseria meningitidis
atgagccaaaaccataccattctgcaatccctccccgtcggtcagaaagtcggcatcgccttctccggcggtcttgatacctctgccgcgctgttgtggatgaaactcaaaggcgcgctgccttatgcctacactgccaacctcggccagcccgacgaagacgactacaacgccattcccaaaaaagcgatggaatacggtgcggaaaacgcccgcttaatcgactgccgcgcgcagttggcacacgaaggcatcgccgccatccaatgcggcgcgtttcacgtttccaccggcggcatcgcctatttcaacaccacgcctctgggccgcgccgtaaccggcactatgcttgtttccgcaatgaaagaagacgatgtgaatatttggggcgacggcagcacctacaaaggcaacgacatcgagcgtttctaccgctacggtttgctcaccaatcccgcgctgaaaatctacaaaccctggctcgatcagcaatttatcgacgaactcggcggccgtcacgaaatgagcgaatttctgattgccaacggcttcaactacaaaatgtcggtggaaaaagcctactccaccgattccaatatgttgggtgccacccacgaagccaaagacttggaatttttgaactcgggcatcaaaatcgtcaaacccattatgggcgttgccttttgggacgaaaacgtcgaagtcagcccggaagaagtcagcgtacgctttgaagaaggcgtgccggttgcactaaacggcaaagaatacgccgatcccgtcgaactcttcctcgaagccaaccgcatcggcggccgccacggcttgggtatgagcgaccaaatcgaaaaccgcatcatcgaagccaaatcgcgcggcatctacgaagccccgggtatggcgttgttccacatcgcctacgagcgtttggtcaccggcatccacaacgaagacaccatcgaacaataccgcatcaacggcctgcgcctcggccgcctgctctaccaaggccgctggttcgacagccaagccctgatgttgcgcgaaaccgcacaacgctgggttgccaaagccgttaccggcgaagttaccctcgaactgcggcgcggcaacgactactcaattctgaacaccgaatcgcccaacctgacctaccaacctgaacgcctgagtatggaaaaagtcgaagacgctgcgttcactccgctcgaccgcatcggacagctcacgatgcgcaacctcgacatcaccgacacccgcgtcaaactgggtatctactcgcaaagcggtttgctctcgctgggcgaaggttcggtattgccgcagttgggcaataagcaataa

SEQ ID NO: 6186 - DNA, 243 bp, Neisseria meningitidis
atgatcccttatgttaaaaggaatcctatgaaagaatacaaagtcatcatttatcaggaaagcctgttgtccagcctgtttttcggcgcggcaaaggtcaaccccatcaaattcagcgagttcctcaataaacaaacccccgaaggctggcgggttgtaacgatggaaaaagatttgcgccgtatgctgctgtttttcaaacgcgaggcctacgtcgtcattttggagcgggatcgtgtttaa

SEQ ID NO: 6187 - DNA, 216 bp, Neisseria meningitidis
gtgtttaagctcggcgtttatacctgtctcggactgtttgccggctgggtgctgctgctgatcgtgcaactctggttttcttttctcgaagcggaattgttcttcaaaatcacactgactatggcggggctgtttgtcatcatcctcgccgccttactggtatgcggtcagtatttttccgaaaagaaaatgaaagacgacgggtttatcaactga

SEQ ID NO: 6188 - DNA, 1467 bp, Neisseria meningitidis; identical to SEQ ID NO: 2183

SEQ ID NO: 6189 - DNA, 1230 bp, Neisseria meningitidis
atggcgttcggcaaatccttatttcatgcgatcggccgcgtcagcctggtcaggcagattgccgccggtttggcgttgggcatcgtaatcggttcggtttccccgcaactgggcttggcggcaggcttgttcggcagcctgtttgtcggtgcgctcaaagcggtcgcgccggttttggtatttattttggtggcggccacaatcgcgcagcaccaaaaaggcaacaaggcgcatatcaggccgattatcgtcctttacctcatcggtacgttttccgcagccctgaccgccgtcatcgccggtatggttttcccgacgcacattgttttggcgggcgcgggcgatgtgtccgccgcgccgccttccggcattgtggaagtattgaaatcgctgctgatgaacctggtcgccaacccgattaacgcgattgccaatgccaactatatcggcattttggcttgggctttggttttgggcgcggcgttgcggaatcacggttcggacgttacgcggcaggtcgttgccgatttggcggaagcggtttccaccgtcgtgaaatggattatccgttttgcccctttgggcattttcgggctggtgtcgtccacaatcgcggagacgggtttcggcgcgctggcggggtacgcgaagctgcttgcagtgctgttgggctgtatggcgtttatcgcgctggcggtcaatcccgccatcgtgtggtggaaaatccgccgcaaccctttcccgctggtgtttacctgcctgcgtgaaagtggcgtttatgccttctttacccgttcttccgccgccaatatccctgtgaacatggcattggcgaaaaagctgggtttgcacgaagacacttactccatctccattccattgggtgcaaccatcaatatggccggtgcggcaatcaccattaccgttttggcgatggctgcggcgcacacgcaaggcattacggttgacttcgccactgccctgctgctgagcctggtggctaccgttagcgcgtgcggtgcatccggtgtggccggtggctcgttgctgctgattcctttggcgtgcagcctgttcggtatcgataacgatgtggccatgcaggtggttgccgtcggcttcattatcggcgtgattcaggattcggcggaaactgcgctgaactcttcgaccgacgttttgtttaccgctgccgccgatttgggccgacagaggaaccgggcggaataa

SEQ ID NO: 6190 - DNA, 1908 bp, Neisseria meningitidis
atgccgtctgaagcgtcccgccccgtccgaacagtgttaaaatcgaaagccgccacaccgatgcacgacacccgtaccatgatgatcaaaccgaccgccctgctcctgccggctttatttttctttccgcacgcatacgcgcctgccgccgacctttccgaaaacaaggcggcgggtttcgcattgttcaaaaacaaaagccccgacaccgaatcagtcaaattaaaacccaaattccccgtcctcatcgacacgcaggacagtgaaatcaaagatatggtcgaagaacacctgccgctcatcacgcagcagcaggaagaagtattggacaaggaacagacgggcttcctcgccgaagaagcgccggacaacgttaaaacgatgctccgcagcaaaggctatttcagcagcaaagtcagcctgacggaaaaagacggagcttatacggtacacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaagcctacccgcttgccaagctcggcaatacgcaggcggccgtcaaccccgataccgccaccgccgatttgaacgtcgtcgtggacagcggccgccccatcgccttcggcgactttgaaatcaccggcacacagcgttaccccgaacaaatcgtctccggccttgcgcgtttccagcccggtatgccgtacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggttcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcgtctggtatgtgcgcgaccgcgcgggcatcgatgccaggctgggggcggaatttctcgcagaaggccggaaaatccccggctcggctgtcgatttgggcaacagccacgccacgatgctgaccgcctcttggaaacgccagctgctcaacaacgtgctgcatcccgaaaacggccattacctcgacggcaaaatcggtacgactttgggcacattcctgtcctccaccgcgctgatccgcacctctgcccgtgcaggttatttcttcacgcccgaaaacaaaaaactcggcacgttcatcatacgcggacaagcgggttacaccgttgcccgcgacaatgccgacgttccttcagggctgatgttccgcagcggcggcgcgtcttccgtgcgcggttacgaactcgacagcatcggacttgccggcccgaacggatcggtcctgcccgaacgcgccctcctggtgggcagcctggaataccaactgccgtttacgcgcaccctttccggcgcggtgttccacgatatgggcgatgccgccgccaatttcaaacgtatgaagctgaaacacggttcgggactgggcgtgcgctggttcagcccgcttgcgccgttttccttcgacatcgcctacgggcacagcgataagaaaatccgctggcacatcagcttgggaacgcgcttctaa

SEQ ID NO: 6191 - DNA, 4218 bp, Neisseria meningitidis
atggccacttcagacggcattgcagcaaaccattttgaaacagacattatgaccgataccgcaccgacagataccgatccgaccgaaaacggcacgcgcaaaatgccgtctgaacaccgccctaccccgccggcaaaaaaacgccgcccgttgctgaagctgtcggcggcactgctgtctgtcctgattttggcagtatgtttcctcggctggctcgccggtacggaagcaggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgccttgacctgaaggccgccgacacgccgtggagcagttcgtcgggggcggcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccggccgccttcgtgccttccctgcccgatgccggactgaatttcgacctgaccgccatcccgtcgttttcagacggcatcgcgctggaaggttcgctcgatttggaaaacaccaaagccggctttgccgaccgcaacggcatccccgtccgtcaggttttaggcggctttgtcatccggcaggacggcacggtgcatatcggcaatacgtccgccgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgacccagcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggtgatttggacggcggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggcggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgcaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcgggcggattaacgccgatttgggcatcgccaacgccttcggcggcaatatggcaaatgcaccgctcggcggcaggattaccgcctcccttcccgacttgggcgcattgaagccctttctgcccgccgccgcgcaaaacattaccggcagcctgaatgccgccgcgcaaatcggcggacgggtaggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtacggggcgtgggcacggtccgcgtcatcaaagggcgttataaggcatacgggcaggatttggacattaccaaaggcacggtctcctttgtcggcccgctcaacgatcccaacctcaacatccgcgccgaacgccgcctttcccccgtcggtgcgggcgtggaaatattgggcagcctcaacagcccgcgcattacgctgacggcaaacgaaccgatgagtgaaaaagacaagctctcttggctcatcctcaaccgcgccggcagcggcagcagcggcgacaatgccgccctgtctgcagccgcaggtgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacggcaaaggaaaataa

SEQ ID NO: 6192 - DNA, 1458 bp, Neisseria meningitidis
atgtcccggcatcccgcccccaccggagaaaaaacattcttcggccaccccttccagctttccaccctcttccatatcgaattgtgggaacgtttttcattttacggaatgcagggcatcctgctgatttacctctactacaccgccgacaaaggcggcttgggcatagacaaaaccctcgccggcggcattgtcggcgcatacagcggcagcgtgtacctgtccaccattttgggggcgtggtttgccgaccgagtatggggtgcggaaaaaaccctcttcctctcgggcatcgtcgtgatgctcggacacatcgtccttgccgccgccccgggcctgtacggccttttaatcgggctgatattcatcgcattgggcagcggcggcgtgaaatctacggccagttctatggtgggcgcattatacgaacaggacgaaatgcgcccgctgcgcgatgcgggattttccattttctacatcgccatcaacatcggcggcttcctaggcccgctgctgaccggcctactgcaggaaaacatcggtttccattatggtttcggcgcggcggcggtcggtatggcattcggcttgtggcgttattccctgggacgtaaaaacctgccccaccccaccgtcccccatccgctttcaaaaggacagggcaaaactgcggccgccgtcggcatcgccctcatcgccgcacttgcaaccgccatcaaaaccgggcttgtcaacctcgacaatttctccggcatcctattatctaccgtcatccttgccgtcatcgcctatttcgcccgcctgctgaccaacccccgcgtcagttccgacaacaaacggcacatcatcgcctacatcccgcttttcctgaccatctgtatgttttgggccgtctggtttcagatttacaccgtggcaaccgtctatttcgacgaaaccgtcaaccgcaccatcggttcgtttaccgtgcccgtcgcttggaaagattctatgcaaagcctgtgggtcatcctgttttccggactgatggcggcaatgtggacaaaaatggggcgcaaacagcccaaaaccccgctgaaattcgctatggcggtatttgttaccggcgcgtcgtttttgggattcgtcccctttatttcctccggtacgccgatgcctattgcggttttcgcactgatcgtcctcgccatcacgataggcgaactgatgatttccccgattgcgctgtccatctccaccaaaatcgcaccgcctttattcaaaacccaaatggtcgcccttaatttccttgccttttcattaggcttcactttgggcggcgtattgtttgaaaaaggctatcaggcgggcgacgaaatcggcttctatcggctgctgttctacatcggcgcagccacaggcttcctgctgctcctgctcgtccccaaattgaacaaaatgctcgaaggcacagactaa

SEQ ID NO: 6193 - DNA, 213 bp, Neisseria meningitidis
atgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttacctgtgctgccaaagcagccatcggcggttttgctttctgttccactttccgtcgcgttaccgcgcccggccgttaa

SEQ ID NO: 6194 - DNA, 1104 bp, Neisseria meningitidis
atggaagccgaagtaatcaaccagctcaacaataccctgaacgatttggaaaagcgcagcgaagacatccgagtttatatggattatcagggtaagaaagaccgattggaagaagttatcggtctttccgaagaccccgaactttggaacgacccgaaacgcgcccaagaaatcggcaaagagcgcaaaatcctcgaaggcatcgtgttgacgctcgacaacatcgcttcgggcatcgaagacaaccgcatgctgattgaaatgaccgtcgaagaaaacgacgaagaaggttttgccgccgtgcaggaagacgtagcggggctggaaaaacagatggcggatttggagttcaaacggatgttcaaccagcccgccgacccgaacaactgctttatcgacatcaccgcaggcgcgggcggtacggaagcggaagactgggcgggtatgctgttccgtatgtacagccgctacgccgagcgcaaaggcttcagaatcgaaatccttgaagaagacgacggcgaaatcgcaggcatcaaccgcgccaccatccgtgtggaaggcgaatacgcttatggtttgctgcgtaccgaaaccggcgttcaccgcttggtgcgttactcgccgtttgactcgaacaacaaacgccatacctcgtttgcctccgtgttcgtttaccctgaaatcgacgattccatcgaaatcgaaatcaaccccgccgatttgcgcatcgacacctatcgcgcatcgggtgcgggcggtcagcacatcaataaaaccgactccgccgtgcgcattacccacgagccgacggggattgtggtgcaatgtcaaaacgaccgttcgcaacacgccaacaaagccgctgcgatggaaatgttgaagtccaaactgtatgaattggaaatgcgcaaacgcaatgaagagaaacaggcgttggaagaaggtaaatccgatgtaggttggggcagccaaatccgttcgtatgttttggattcctcacgtatcaaagacttgcgtacaggctacgaagtcggcaacaccaaagccgtattggatggcgacttggacggcttcatcgaagccagcctgaaacagggcgtgtag

SEQ ID NO: 6195 - DNA, 894 bp, Neisseria meningitidis
atggtaacgttttcaaaaatcagaccgcttttggcaatcgccgccgccgcgttgcttgccgcctgcggcacggcgggaaataatgctgtccgcaagccggtgcaaaccgccaaacccgccgcagtggtcggtttggcactcggtggcggcgcatctaaaggatttgcccatgtaggtattattaaggttttgaaagaaaacggtattcctgtgaaggtggttaccggcacatcggcaggttcgattgtcggcagcctttttgcatcgggtatgtcgcccgaccgcctcgaattggaagccgaaattttaggcaaaaccgatttggtcgatttaaccttgtccaccagtggttttatcaaaggcgaaaagctgcaaaattacatcaaccgaaaagtcggcggcaggcagattcagcagtttcccatcaaatttgccgccgttgctactgattttgaaaccggcaaggccgtcgctttcaatcaggggaatgccgggcaggctgtgcgcgcttccgccgccattcccaatgtgttccaacccgttatcatcggcaggcatacatatgttgacggcggtctgtcgcagcccgtgcccgtcagtgccgcccggcggcagggggcgaatttcgtgattgccgtcgatatttccgcccgtccgggcaaaaacatcagccaaggtttcttctcttatctcgatcagacgctgaacgtaatgagcgtttctgcgttgcaaaatgagttggggcaggcggatgtggttatcaaaccgcaggttttggatttgggtgcagtcggcggattcgatcagaaaaaacgcgccatccggttgggtgaggaggcagcacgtgccgcattgcctgaaatcaaacgcaaactggcggcataccgttattga

SEQ ID NO: 6196 - DNA, 450 bp, Neisseria meningitidis
atgaaaatcggaacaacttggcagacggcatccgctatgctggttttgcgtctgtttgccgcatatgaatttttggaatcgggtttgcaaaaatggaacggggagaattggttttccgaaatcaacgatcagtttccattcccgttcaacttgctgccggacgcgttaaactggaatctcgccatgtatgcggagcttttgctgcccgtattgttgcttttgggtttggcaacgcgtctgtcggcattggggctgatggtcgttaccgccgtcgcttgggctgcggttcacgccggttcgggttacaatgtctgcgacaacggttataaaatggctttaatttatatcgtggtattaatcccgctgcttttccagggtgcgggcggatggtcgctggatacgctgctgaaaaaacggttttgcccccgatgccgtctgaaacaagattga

SEQ ID NO: 6197 - DNA, 309 bp, Neisseria meningitidis; identical to SEQ ID NO: 3391

SEQ ID NO: 6198 - DNA, 867 bp, Neisseria meningitidis
gtgccatccgaaccgggtaaaaatatgattcaacacgcaggcttgggctaccgccgcgacttggcggaagactttctctcgctttccgaaaacagcccgatatgctttatcgaagccgcaccggaaaactggctgaaaatgggcggctgggcgcgcaaacagtttgaccgtgtggcggaacggctgccgctggcgttgcacggattgtctatgtcgctgggcgggcaagcaccgctggatactgatttgatagacggcatcaaagaaatgatgcgccgttacgattgcacgtttttctccgaccatttgagctactgccacgacggcggtcatctttacgatttgttgccgctgccctttaccgaggaaatggtgcatcatacggcgcggcgtatccgcgaagtgcaagaccgtttgggctgccgcatcgccgtggaaaacacgtcctactatctgcattccccgcttgccgagatgaacgaggtcgagttcctcaacgccgtcgcacgtgaggccgattgcggcattcatctggatgtgaacaatatctacgtcaacgccgtcaatcacggtctgctgtcgccggaggcttttttggaaaatgtggatgcagagcgcgtgtgctatatccatattgccggacatgacgtggaaacgccggaattgttgattgatacacatggcgcggcagttttgccgactgtttgggacttgctcgaacttgcctatgccaagctgccgacgattccgcccaccctgttggaacgcgattttaatttcccgcctttttccgaactcgaagccgaagtcgccaaaatcgccgattatcaaacgcgtgccggaaaggaatgccgccgtgcagcctga

SEQ ID NO: 6199 - DNA, 747 bp, Neisseria meningitidis
gtgcagcctgaaacctccgcccaataccagcaccgtttcgcccaagccatacgcgggggcgaagccgcagacggtctgccgcaagaccgactgaacgtctatatccgcctgatacgcaacaatatctacagctttatcgaccgttgttataccgaaacgctgcaatactttgaccgcgaagaatggggccgtctgaaagaaggtttcgtccgcgacgcgtgcgcccaaacgccctattttcaagaaatccccggcgagttcctccaatattgccaaagcctgccgcttttagacggcattttggcactgatggattttgaatatacccaattgctggcagaagttgctcaaattccggatattcccgacattcattattcaaatgacagcaaatacacaccttcccctgcggcctttatccggcaatatcgatatgatgttaccgatgatttgcatgaagcggaaacagccttgttaatatggcgaaacgccgaagatgatgtgatgtaccaaacattggacggcttcgatatgatgctgctagaaataatggggttctccgcgctttcgtttgacaccctcgcccaaacccttgtcgaatttatgcctgaggacgataattggaaaaatattttgcttgggaaatggtcaggctggactgaacaaaggattatcatcccctccttgtccgccatatccgaaaatatggaagacaattccccgggccaaaaccatctatccgcataa

SEQ ID NO: 6200 - DNA, 588 bp, Neisseria meningitidis
atgccgctacccgacctgaccgatgccgaattaatagagtcgcgtaaactgcttctgcattttgcgcggcttcagttgcccgaccaccctgatttggctgaagatttagtgcaggaaacattgctgtccgcatacagcgcaggcgacagttttcaaggcagggcacttgtcaacagctggctttttgccatattgaaaaacaaaattattgacgcattacgtcaaatcggaaggcagaggaaagtctttaccacactggatgacgagctactggatgaagcatttgaaagccatttttcccaaaacgggcattggacgcaggaagggcagccgcaacattggaacactccggaaaaatcattaaacaacaacgaattccaaaaaattctgcaaagctgcctatacaacctgcctgaaaacaccgcacgggtatttaccctgaaggaaatactcggtttttcatccgacgaaatacaacaaatgtgcggtatcagcacgtccaactaccacaccattatgcaccgcgcccgagaatcattgcgccaatgcctgcaaatcaaatggttcaaccaagaaaacccgaagtaa

SEQ ID NO: 6201 - DNA, 180 bp, Neisseria meningitidis
atgaaaaaatgccgcgatatcgccctgcttctttccaaacatcaggaccgggaaaccaccccgggcgagaagatttccatatacacacacctgctgttctgtccgtattgccgtgaatataaaagacaacttcaaaccatcaaaagatcactggcaaaaacaaccagaacttcaaaataa

SEQ ID NO: 6202 - DNA, 111 bp, Neisseria meningitidis
atgtataaatacgcaaaatacgaaggctgcatcaatttgccatatttgctttatttgccttatttcacagacggcgctacccctcccgcccaacccgttctttctgaatga

SEQ ID NO: 6203 - DNA, 423 bp, Neisseria meningitidis
atgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccaagataaaaaagttgttaccaatctaaaacaagaacgttttgccaacacccccgcatacaagactgccattgccgagtgggaaatccactgcaacaacaaaacataccgcttaagttcgctacagttgtttgatacaaaaaacacggaaatttccacacaaaactacacagcctcttccctccgcccgatgagcatcctgtccgggacattaaccgaaaaacaatatgaaaccgtatgcggaaaaaaactctga

SEQ ID NO: 6204 - DNA, 966 bp, Neisseria meningitidis
atgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactag

SEQ ID NO: 6205 - DNA, 261 bp, Neisseria meningitidis
atgcgtcaaatttcgttaacagactatttttgcaaaggtctctatttgttcgatatttttgaagacatcgtttttttagggaaacgtttgtttacggtcagaaaatttcttgatttttctgaattgcttgagatggtcaatacacaaggttattttcttgagtttctgtatttgtatagtggattaaatttaaaccagtacggcgttgcctcgccttgccgtactatttgtactgtctgcggcttcgtcgccttgtcctga

SEQ ID NO: 6206 - DNA, 570 bp, Neisseria meningitidis
atgttatttccgagaattatcgcagcatcagcgcaacgtaagttaagcgtttatttgaaaaaaggtggtttggtcgcttatccgaccgaatcttgttatggcttggggtgtcttccgacattagccaaagcactcggtaagttggcgcatttgaaaaaaagaccgcaacacaagggtatgattgtcatcgggaatcaatttgaacaattgcagcctttacttcaaatgccgtctgaaaatcttcaggatatgcttagaaaagaatggcccgcccctaaaacgttcctattatccgccaaatcctgtgtcttacccgagttacgcgggaaacagcgcagcaagttggcggtcagggttcccgcccatgtaggtgcgcgccgcttgtgtcaggctttgcaaacgcctttggtctcgacttcgtgcaaccgcgcaggcaaacgcgcgtgtcggacggagagggaagtcagaaggcaattcggacgcgatgtgtggattgttggtgggagaatcggcaggcagaaatcgccgagtcagattattgacggggaaacaggtaaacgtttgcgttag

SEQ ID NO: 6207 - DNA, 1272 bp, Neisseria meningitidis
atgaaactgctggttatcggtaatggcggtcgcgaacacgcgctggcttggaaattggcgcagtcgcctaaagtggaaacagtatttgttgcgcctggtaatgccggtacagcgattgaacccaagttgcaaaacatcgacttgactgcgcatcaggatttgattgaattctgtcgtaaagaaaatattgtttttaccgtcgtcggccctgaagcgcctttggcggcaggtattgtggatgatttccgtgctgcaggactaaaaatattcggtccgacacaatatgcggcgcagttggaaagttccaaagatttcgccaaagcatttatggcgaaatacaatattccgaccgcgcaatatcaaacctttgaaaacgccgatgccgcacatgattacgtcaatcagaaaggtgcgcctatcgttatcaaagccgatggtttggcggcaggtaaaggcgtgattgtggcgatgactttggatgaagcgcatgctgcgattgatgatatgctgctggacaacaaaatgggcaatgccggcgcgcgtgttgtaattgaagatttcctgcaaggcgaagaagcgagttttatcgtcatggttgatggcaataatgtactgcctatggcaaccagccaagaccacaagcgtcttttagacggcgacaaaggtctgaatacgggcggtatgggtgcgtacagccctgcgcctgtggtaacgcctgttgtgtacgaacgcgcgatgaatgaaattattttgccgaccgtagcagggatgaaagcggaggggcatgagttcaccggtttcctgtacgcaggtttgatgattgatcaaagcggtgcaccctatacgattgagtttaactgccgtttcggcgatcctgaaacccagccgattatgagccgactgaacagcgacttatcggatttggttgaagcggcaatagacggcaaactcgatagcgtaaccgcggaatggagcccgcaaactgccgtgggcgtggtactggcggcgcaaaattaccccgaaacgcccaaaaaaggcgatattatttccggtctggatgctgccaaccaaatcggcaaagttttccatgcaggtacaacggcaaacgagaaaggtgacgtattgaccaacggcggacgcgtattgtgtgttgtgggattgggcgataatgtggcgcaagcgaaagctaaggcatatggcgcgttggaaaaaatcagtttcgacgggatgcaataccgtaaagacattgccgataaagcgattaaccgttaa

SEQ ID NO: 6208 - DNA, 318 bp, Neisseria meningitidis
atgcaaaaacgtattgatgaaatccaaagcaaataccgcgaatggtgtcatttactaccgcaactggaagaagacatccgccgttggaaacatgtcgtcactttaattcgcgacatggacaatttctatacccacgagtatcaggcgtgtcatcaggctattgaagacggggtagaactggatttgagtacggaaggcgaatacagcattatgagtgaagatgcgctatggaacgcgctgggcgaattccatcaattggcttggttatatttgcgctccagcgtcgatgccttagacaaatatacacaagaagattag

SEQ ID NO: 6209 - DNA, 612 bp, Neisseria meningitidis
atgattacgacttataaaaccattacttccttgacgcaggctgagtttaaagataaaggcagccgttttattgcatttgcctatccgattcggacattggctgatgtgaaaaaatacctcgatccgttaaaggaagagcatcataaagcacgacactggtgctatgcctatcgtttgggtgtggatggtgtgcaatttcgtgccaacgatgatggagagccatcaggaagtgctggacgaccaattttgggacagattgattcggtgggtattaccgacgttttggttgtggtcgtccgctatttcggtggtactttgttaggtgttccaggtctgatacatgcgtacaaagaggcgacggctcaagcgttggcagttgcagaagtagttgaaaagaatattgaaaaaactgtttggctgaaatgtgaatatccgtttttgaatgaagcgatacgcattgccaaacaatatcaggcggatatattggagcgggatttgcagttggattgccgattgacggtcagtttgtcgttggtaaattatgaggcctgtgttgcggcttggaagaatactcggcagattgaagtaaatacggaaaagccttttgaatga

SEQ ID NO: 6210 - DNA, 936 bp, Neisseria meningitidis
atgagtgtattgattattgtcgaacacgacaacaaacagttgaatcctaccactttgcatgctgttaccgctgccgccaaactgggcaaagtcgatttattggttgccggaaacggcgcatctgctgtagtggaattcgcgaagcaagtagcgggggtgaaaaaagttttggttgcagatgctgctcattatgccgaaggtttggctgaagagttggctccgctggttgttaaattggcggccgattaccgctatgttgcagcaacggcaaccacattcggtaaaaaccttttgccccgcgtagcagccttattagacgtaccgcaaatttctgatttgaccgaaattgtggataacacgacttttgtgcgccccatttatgcgggtaatgcatttgaaaccgtgcaagctgattcagaaaaattggtgctgaccttccgtgcgacggtttttgacgcagtggcggcgcaaggtggtaatgctgaggtaattaatgttgaagcaacccctgcccaaaacctgagtcgttttgttaaccgtcagctttcccattccgatcgtcctgaactgactcaggcaaaagtgattgtttccggtggtcgtgcgttgggtagtgcggaaaaattcaatgaagtgctgacaccgttggcggatgttttaggtgcggcaatcggtgcatcccgtgcagcagttgatgccgaatatgcgccaaacgatgctcaagtcggacaaaccggtaaagtggttgcgccgcaactctattttgcaatcggtatttcaggtgcaattcaacacgttgccggtatgcaagacagtaaggtgattgttgcaatcaataaagatgctgatgcgccgattttcaatgtagccgattacggattggttggcgatttatttgaaatcgttccacaattaacagaagtattgaaaaattga

SEQ ID NO: 6211 - DNA, 750 bp, Neisseria meningitidis
atgaaagcactggtcgcagtaaagcgcgtagtggactacaacgtcaaagttcgtgtaaaagccgatggttcggatgtggatatcggcaatgtcaaaatgtcgatgaatccgtttgacgaaatcgctgtggaagaagctgtccgtttgaaagaagccggaaaagtaagcgaaatcgtagcggtttctttgggtgagaaaaaatgcgaagaaaccttgcgtacagctttggcgatgggtgccgaccgtgccattcatgttgaaaccgatactaaactggagtctctggccgttgctaagttgctgaaagccgttgcggacaaagaaaatccgcaaattttctttttgggcaaacaagcgattgatgatgatgccaatcaagtggcgcaaatgctggcagctttgctgaatgcggcgcaaggtacgttcgcgtccaaagtacaaattgaaggcgacgaagtgcagattgtgcgggaaatcgatggcggcgaagaaaccatcgcattgaaactgcctgctgttatcagcgcggatttgcgtttgaacgagccgcgctttgtcaaactccccaatattatggcggcaaagaaaaaacctttggaaaaactgactcctgacgatttggttgccgacatttcacctcgtttgaaaacggtgaaatttgccgaacctaaggcgcgtcaggcaggcgtaaaagtagcaagcgttgccgaattggttgaaaaattgaaaaacgaagccaaagtgatttga

SEQ ID NO: 6212 - DNA, 969 bp, Neisseria meningitidis
atgaaaattttgcttgtccgcttgtctagtatgggcgatttaattcacactttgcccgcaatcgaagatttggcgcgacaatgtcctgatgtagaactgcattggctatgtgaggctggatttgcagatattgcgcgcctgcatccgtttgtaaaaaaaatccatgtgatgaaatggcggcaatggcgcaaacatctctttcgggctgaaacttggcgggaaatgggtcatctgaaacagactttgcggcaggaagtatttgatttcgtattggacagtcaaggtctgattaaaagcgcgtgtttcgctaaaatggcaaaatccccgatttgtggtttggataaaaacagtgcgcgcgagggatgggctgctttggcgtatgtaaaaacatacgctgtaccgaagggaaaaaatgccgtttggcgcaaccgtgaactgtttgcccaagtatttgggtatgtaatgccggaaacgcaggtatttggcttgactgttcctgaagcaggccgtctgaaaaatttagcgcagccgtattatgcggctttgcatgcgaccagtcgggacagtaagttatggcctgtggaaaactggcggtcgttgctgcaaaagttgaatgaagaacagcaatgcaatatttacctgccttggggaaatgaagatgaaaaaacgcgtgccaaacaaattgcagatgggctgccgtttgctattgtgtgcgacaaaataaatttattgcaggcagcgtatctgctgaaatacgcggtcggaattgtcggcgtggataccggtttgctgcatttggcaaatgccttggaaaaacctgtggtcggcatttataccgataccgatccgattaaaacaggcgttcaggtttcgccaattgcaaaaaatttgggcaatatcgggcagattccgaccgcagatttggtttatcaagcgctgatggattgtgttgcagcagataaaggctaa

SEQ ID NO: 6213 - DNA, 636 bp, Neisseria meningitidis
atgattgtttccattgatgttgatgcacaaaaaacgtttacgccactgtgtcctgacgaactgcccgtgaacgaggggcatttgattgtcgaggagttgaatgcgcaagccgctttggcggatttgcgcgtgatgacgaaagatgcgcatcatatggtagcgaaatggcttgtggataaccctgttgatatgttgaagccgacaggtttgcctgatgcggatttgacttgggtggctcatgcgatggtcggtacgcgcggctatgaattattggacgggctgccttctgctaaagaatacgattattgcgtttggaaaggtgttgatcctgaattgcatccttacggcgcgtgttttcacgatattgaggaaaaactaagcacagggctgattgaatggctgcgttgtcaaaatacggatacggttattatcggtgggttagctacggattattgtgttaaaacaacggttttgcagttactcaaaggcggtcgttggcaggttgtcgtcaatgaagcggcttgtcggggtattgcgccggaaaccatcgaaacagcatggcaggaaatgcattctgctggggcaatcatcttaaaaaacgctgatgaaataaataaatatattaataatcaataa

SEQ ID NO: 6214 - DNA, 681 bp, Neisseria meningitidis
atgacttataccattacccccatcggcaccgcccgctcgccctacaaacagaaattcggcatcgcccgccagcccggtttggtctccgccgcaaaagcctgcatcgagctgaatcccaaattcaccgcagacagcgtgcgcgggctggaagatttcgattatgtgtggataagttttatttttcacggcgtattggatgaaggctgggcgcaaatggtgcgcccgccacggctcggcggcaaacaaaaaatgggcgtgttcgccacgcgcagcccccaccgccccaaccatctcggactctcgctcctgaaactcgaacgcatcgaaaccggcaaacccgtccgcctctattgcagcggcgcagacctgctggacggcacaccgattgtggacatcaaaccttatatcccctttgtcgaatccaaacccgatgccgcatccggtttcgtcagcggcaaacccgtagagttggaagtcgtttggcaggaaaacatcggcgcggaaaatttatctgcaaacaccaaaaaccttatcagccaaagcattgcccaagatccgcgccccgcctatcagaatattcccgaacggatttatgtgatgaatattgcagattacgaagtcagatttcaaatcgaggaaaaccgtgcaaccgttattgatctttccccaaccccgctttaa

SEQ ID NO: 6215 - DNA, 1005 bp, Neisseria meningitidis
atgagcattaaagtagcgattaacggtttcggccgcatcggccgcctcgcattgcgtcaaattgaaaaagcccacgacatcgaagtcgtcgccgtcaacgacctgacccctgccgaaatgctgctgcaccttttcaaatacgacagcacacaaggccgtttccaaggtactgccgaattaaaagacgatgccatcgtggtaaacggcaaagagatcaaagtttttgccaatccgaatcccgaagaattgccttggggcgagttgggtgtggatgtcatcctcgaatgtaccggcttctttaccaataaaaccaaagccgaagcacacatcagggccggcgcgcgcaaagtcgtgatttccgcacccggcggcaatgatgtgaaaaccgtcgtatatggcgtaaaccaagacattttggacggcagcgaaaccgttatctccgccgcttcctgcaccaccaactgccttgccccgatggcggcagtcctgcaaaaagagttcggcgtagtcgaaggtctgatgaccaccatccacgcctacaccggcgaccaaaacacccttgacgcgccgcaccgcaaaggcgatttgcgccgcgcccgagccgccgcgctcaacatcgtgcccaacagcaccggtgccgccaaggccatcggtctggttatccccgaattgaacggcaaactcgacggctccgcccaacgcgtccctgttgccagcggctcgctgaccgaattggtttccatcctcgaacgccctgtaaccaaagaagaaatcaacgccgcgatgaaagccgccgccagcgaatcttacggctacaacgaagatcaaatcgtttcttccgacgttgtcggcatcgaatacggctcgctcttcgatgcgacccaaacccgcgtgatgaccgtgggcggcaaacaattggtgaaaaccgttgcctggtacgacaacgaaatgtcctacacctgccaactcgtccgcactttggaatacttcgcaggcaaaatctaa

SEQ ID NO: 6216 - DNA, 2595 bp, Neisseria meningitidis
atgtccaaatccgccgtttccccaatgatgcagcaatacctcggcatcaaagcgcaacataccgacaaactggtgttttaccgtatgggcgatttttacgagatgtttttcgacgatgcggtagaagcggcaaaacttttggatattaccctgaccacgcgcggacaggtggatggcgagccggtcaaaatggcaggcgtgccgtttcacgccgccgaacaatatctggcgcgcctggtcaagttgggcaaaagcgtggcgatttgcgaacaggtcggcgaagtcggcgcgggcaaagggcctgtggagcgcaaagtcgtgcgcatcgtaacgcccggcacgctgaccgattccgcattgctggaagacaaggaaaccaaccgcatcgttgccgtgtcccccgacaaaaaatacatcggtttggcgtgggcatcgctgcaaagcggcgaattcaaaaccaagctgacaactgtggataaattggacgacgaactggcgcgcctgcaggcggcggaaattctgttgcctgacagtaaaaacgcaccgcaacttcagacggcatcgggtgttacgcgcctgaacgcgtggcagtttgccgccgacgcgggggaaaaactgctgacggaatatttcggctgccaggatttgcgcggcttcggtttggacggcaaagaacacgccgttgcgattggcgcggcaggtgcactgttgaactatatccgtctgacgcaaaacctgatgccgcaacatttggacggcctgtcgctcgaaaccgacagccaatatatcggtatggatgccgccacgcgccgcaatctcgaaatcacgcaaaccctctccggcaaaaaatcgccgaccctgatgtccacgctcgacctttgcgctacccatatgggcagccgcctcttggctctctggctgcaccaccctttacgcaaccgcgcccacatccgagcgcgccaagaagccgttgccgcgctggaaagccaatacaaacccctccagtgccgtctgaaaagcattgccgacatcgaacgcatcgccgcccgtattgccgtgggtaacgcccgcccgcgcgacctcgccgccctgcgcgacagcctgtttgccctgtccgaaatcgaattgtccgccgagtgcagcagtctcttaggaaccctcaaagccgttttcccggaaaacctatccacagccgaacagctccgccaagccattttgcccgaaccttccgtctggctgaaagacggcaatgtcatcaaccacggttttcatcccgaactggacgaattgcgccgcattcaaaaccatggcgacgaatttttgctggatttggaagccaaggaacgcgaacgtaccggtttgtccacacttaaagtcgagttcaaccgcgttcacggcttttacattgaattgtccaaaacccaagccgaacaagcacctgccgactaccaacgccggcaaacccttaaaaacgccgaacgcttcatcacgccggaactgaaagcctttgaagacaaagtgctgactgctcaagagcaagccctcgccttagaaaaacaactctttgacggcgtattgaaaaaccttcagacggcattgccgcagcttcaaaaagccgccaaagccgccgccgcgctggacgtgttgtccacattttcagccttggcaaaagagcggaacttcgtccgccccgagtttgccgactatccggttatccacatcgaaaacggccgccatcccgttgtcgaacagcaggtacgccacttcaccgccaaccacaccgaccttgaccacaaacaccgcctcatgctgctcaccggccccaatatgggcggcaaatccacctacatgcgccaagtcgcgctgattgttttattggcacacaccggctgttttgtgcctgccgatgccgccacaatcgggcccatcgatcaaatcttcacccgcatcggcgcatcggacgacctcgcctccaaccgctccactttcatggtcgaaatgagcgaaaccgcctacatcctgcatcacgccaccgaacaaagccttgttttaatggacgaagtcggacgtggtacttccactttcgacggcctcgccctcgcgcacgccgttgccgaacacctgctgcaaaaaaacaaatccttcagcctgtttgctacccactatttcgagctgacctacctgcccgaagcccacaccgccgccgtcaatatgcacctttccgcgctcgaacagggacaggacatcgttttcctgcaccaaatccaaccgggtcccgccggtaaaagctacggcattgccgtcgccaaactcgccggcctgcctgtacgcgcattgaaatccgcccaaaagcatttgaacggactggaaaaccaagccgccgcgaaccgtccccaactggatattttcagtaccatgccgtctgaaaaaggagatgaaccgaatgtgggcaactttgtggataaagcagaggaaaaacattttgaaggtatattggcagcagccttggaaaaactcgatcccgacagcctgaccccgcgcgaagcattgtcagaactgtaccgtctgaaagatttgtgcaaatccgtatcttaa

SEQ ID NO: 6217 - protein, 163 aa, Neisseria meningitidis
MNSLFVDNTVFITRLKAGHIGRLVQALFEEWHGFEPWSSVDKIHAYYGRCLKDDELPLAFAAVDDSGILLGSAAVKRHDMESFPRYEYWLGDVFVLPEYRGKGIGRRLVAHCIGAARSLGIKFLYLYTPDVQIFYESFGWVVVGRHFHNGEWVTVMRLDVDKV

SEQ ID NO: 6218 - protein, 131 aa, Neisseria meningitidis
MPSDVGIRLQTAFKWKLKMKKIFYFLMVVFSTSVWAGDAEDNLLSIQSGYRALLQKQNNLDGKIIGMQSDLEDARRRLQTAQADIARLEAEIPAAMAQKARQAEDLRQIGVRLDHAWNAVYGAGGTKASGN

SEQ ID NO: 6219 - protein, 464 aa, Neisseria meningitidis
MTVKTRFAPSPTGYLHIGGVRTALFSWAFARHHKGEFLLRIEDTDLARSTAESVNIILDGMKWVGLNYDNADNVVYQTRRFDRYKEVIAELLEKGHAYYCYCSKEELEAMREKAEKEGSATYDRRWRPEVGKTLPEIPSDVQPVVRFKTPLDGVTKWTDLVKGEISIPNEALDDLIIARADGTPTYNFCVVVDDYDMGVTHVIRGDDHVNNTPKQINILKAIDANLPEYGHLPMILNEQGKKISKRSGDTVAITDFGAMGILPEAMLNYLARLGWAHGDDEFFTMEQFIEWFDLKDVSPSPSRMDLKKLYWINGEHIKITPNGKLAELVKPRLALRDIHETEKPALEDVLELVKDRPQDLNTLADECFYFYVKQTPAEADVQKHWDDEAAARMLRFAERLEGLEDWNAEAIHDLFKPFCDEEGIKMGKLGMPLRLAVCGTAKTPSVDAVLALIGKEEVLKRIRA

SEQ ID NO: 6220 - protein, 214 aa, Neisseria meningitidis
MNKRLFCSRNGLRYYLLGGFCLSVFPLLLVFASSVWAVYRTGGQVLPPYVRADAALVLGAAAWDKRPSPVFRERINHAIALYQSRRVGKIVFTGGRTKKGYMTEAEVGRRYALKQGVPARNILFENTSRNTYENLNNIRPVLRANGIASVVIVSDPYHLARAAEMAEDLGVRVYMSATPTTRFDAGNKKKIFMLQEGYALSLYRLEKWGRDFFN

SEQ ID NO: 6221 - protein, 117 aa, Neisseria meningitidis
MPEIKIFHNPRCSKSRAALSLLEERGIAAEVVKYLDTPPDLSELKDIFNKLGLASARGMMRVKDDLYKELGLDNPNLDNDALLRAIADHPALLERPIVLANGKAAVGRPLENIEAVL

SEQ ID NO: 6222 - protein, 160 aa, Neisseria meningitidis
MKYLNLAAITLAATFAAHTASADELAGWKDNTPQSLQSLKAPVRIVNLWATWCGPCRKEMPAMSKWYKAQKKGSVDMVGIALDTSDNIGNFLKQTPVSYPIWRYTGANSRNFMKTYGNTVGVLPFTVVEAPKCGYRQTITGEVNEKSLTDAVKLAHSKCR

SEQ ID NO: 6223 - protein, 216 aa, Neisseria meningitidis
MIRFEQVSKTYPGGFEALKNVSFQINKGEMIFIAGHSGSGKSTILKLISGITKPSRGKILFNGQDLGTLSDNQIGFMRQHIGIVFQDHKILYDRNVLQNVILPLRIIGYPPRKAEERARIAIEKVGLKGRELDDPVTLSGGEQQRLCIARAVVHQPGLLIADEPSANLDRAYALDIMELFKTFHEAGTTVIVAAHDETLMADYGHRILRLSKGRLA

SEQ ID NO: 6224 - protein, 305 aa, Neisseria meningitidis
MSIIHYLSLHVESARTALKQLLRQPFGTLLTLMMLAVAMTLPLFMHLGIQSGQSVLGKLNESPQITIYMETSAAQSDSDTVRSLLARDKRLDNIRFIGKEDGLEELQSNLDQNLISMLDGNPLPDVFIVTPDPATTPAQMQAIYRDITKLPMVESASMDTEWVQTLYQINEFIRKILWFLSLTLGMAFVLVAHNTIRLQILSRKEEIEITKLLGAPASFIRRPFLYQAMWQSILSAAVSLGLCGWLLSAVRPLVDAIFKPYGLNIGWRFFYAGELGLVFGFVIALGVFGAWLATTQHLLGFKAKK

SEQ ID NO: 6225 - protein, 82 aa, Neisseria meningitidis
MLTSEQVKAMIEGVAKCEHIEVEGDGHHFFAVIVSSEFEGKARLARHRLIKDGLKAQLESNELHALSISVAATPAEWAAKAQ

SEQ ID NO: 6226 - protein, 403 aa, Neisseria meningitidis
MAFLKLTEQNVQGKTVLIRADMNVPFKDGKISDDTRIRASLASIKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 6227 - protein, 417 aa, Neisseria meningitidis
MDKLKISANGPLNGEITVSGAKNAALPLMCAGLLTSGTLRLKNVPMLADVKTTQKLLQGMGARVLTDNISEFEINGGTVNNTCAPYELVRTMRASILVLGPTLARFGEAQVSLPGGCAIGSRPVDQHLKGLEAMGAEIVIEHGYVKAKGKLKGTRVAMDVVTVGGTENLLMAATLAEGTTVLENCAIEPEVVDLAECLVKMGAKISGIGTSTMIVEGVDELQGCEHSVVPDRIEAGTFLCAVAITGGRVVLRNAAPKTMEVVLDKLVEAGAVIEAGDDWIAIDMRQRPKAVDIRTVVHPGFPTDMQAQFMALNAVAEGSCRVVETIFENRFMHVPELNRMGANITTEGNTAFVQGVEQLSGAVVKATDLRASASLVIAGLAARGETVVEQIYHLDRGYENIEKKLGSVGAKIERVSG

SEQ ID NO: 6228 - protein, 323 aa, Neisseria meningitidis
MTEYPGIGSPLFYGVFFAAVLVMIALDMFSLKKNGSHKVGVKEALAWSGLWVAVSCLFAGWLYFELAGNPGYGAAVAKEKVLEFFTGYILEKSLAVDNIFVFLMIFGYFKVAPQFQHRVLLYGVLGALVLRTVMIFVGAALVQQFEWILYLFGAFLLYTGIHMMKPEGDEKEDLANSRLLNTVKKVVPVGTEFHGEKFFTVENGKKIATPLFLVLVMIELSDVVFAVDSIPAVFAVTTDPFIVLTSNIFAILGLRAMYFLLADVAERFIFLKYGLAFVLGFIGVKMLVMHWVHIPISVSLSVVFGALGASVLTSLVYTKKTGR

SEQ ID NO: 6229 - protein, 149 aa, Neisseria meningitidis
MSIYAVAHIVHLYCAIAFVGGVFFEVLVLSVLHTGRVSREARREVEKAMSYRAVRVMPFVVGLLFASGIVMAANRYLSILGEPFATSFGTMLTLKILLAFSVLAHFAIAVVKMARSTLTVGWSKYIHAVVFTHMLLIVFLAKAMFYISW

SEQ ID NO: 6230 - protein, 423 aa, Neisseria meningitidis
MFQWLYDVLWLLAPIWIRRYLDKRSGSAPAYRAHRDERFGKPYPNPVTGAVWIHAVSVGETRAAQSLIRELRRRFPDAPLLMTQMTPTGRETAQVLFPDAQCRYLPYDKKTWVRQFLREHRPMFGILMETEIWPNLMRECRRAGVPLFLANARLSEKSLNGYLKVRRLIRPAAASLTGCLAQTEADAARLAKLGAASVQVCGNTKYDIIPSEQMKTLAGQFEKRIGGRPVAVCGSTRVYRGEDEAEKLLAAWQQYRGDALLVVVPRHPEHFQTVFETAKRFGFKVQRRSDGLPVEPDTQVWIGDSMGELYAYYLCADVAFVGGSLVDSGCQNIIEPLSCGVPTIFGFSTYNFSEACRHALASGAAVQVESADAWREAVEKTLSSEGGGMQMQARVDGFIAQHRGAGARIAEAVREAVCGYRGR

SEQ ID NO: 6231 - protein, 482 aa, Neisseria meningitidis
MNGDIGVIGLAVMGQNLILNMNDCGFKVVAYNRTTAKVDEFLNGAAKGTNIIGAYSLQDLVDKLEKPRKIMMMVRAGSVVDEFIEQLLPLLEEGDILIDGGNANYPDTTRRTHYLAEKGILFVGAGVSGGEEGARRGPSIMPGGDKRAWDAVKPIFQAIAAKTSQGEPCCDWVGKDGAGHFVKMVHNGIEYGDMQLICEAYQFMKDGLGLSYDEMYRVFAEWNKTELDSYLIEITAAILGYKDEGGEPLVEKILDTAGQKGTGKWTGINALDLGIPLTLISEAVFARCVSSFKEQRVQTGKLFARTVTPVEGGKQEWVEALRQALLASKIISYAQGFMLIREAGESYGWDLDYGNTALLWREGCIIRSAFLSNIRDAYENNPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 6232 - protein, 78 aa, Neisseria meningitidis
MKNSFCGQFACCANGILLFFTEWLPMSLRTGILWRFERKVCLELVEMVRCRHECLISAYRQSAHPNLCISGGKNEICG

SEQ ID NO: 6233 - protein, 307 aa, Neisseria meningitidis
MLQRTLAKSISVTGVGLHSGERVALTLHPAPENSGISFRRTDLDGEMGEQIKLTPYLINDTRLSSTIVTDKGVRVGTIEHIMSALSAYGIDNALIELNAPEIPIMDGSSLPFIYLLQDAGVVDQKAQKRFLKILKPVEIKEAGKWVRFTPYDGFKVTLTIEFDHPVFNRSSPTFEIDFAGKSYIDEIARARTFGFMHEVEMMRAHNLGLGGNLNNAIVIDDTDVLNPEGLRYPDEFVRHKILDAIGDLYIVGHPIVGAFEGYKSGHAINNALLRAVLADETAYDRVEFADSDDLPDAFHELNIRTCG

SEQ ID NO: 6234 - protein, 170 aa, Neisseria meningitidis
MNTLQKGFTLIELMIVIAIVGILAAVALPAYQDYTARAQVSEAILLAEGQKSAVTEYYLNHGEWPGNNTSAGVATSSEIKGKYVKSVEVKNGVVTAQMASSNVNNEIKGKKLSLWAKRQNGSVKWFCGQPVTRDKAKAANDDVTAAAAANGKKIDTKHLPSTCRDASDAS

SEQ ID NO: 6235 - protein, 140 aa, Neisseria meningitidis
EAILLAEGQKSAVTEYYLNHGEWPGNNSSAGVATSADIKGKYVKSVEVKNGVVTAQMASSNVNNEIKGKKLSLWAKRQAGSVKWFCGLPVTRADNAKDDAVTAAATGTDKIDTKHLPSTCRDDSSVVCIETPPTAFYKNT

SEQ ID NO: 6236 - protein, 128 aa, Neisseria meningitidis
EAILLAEGQKSAVTEYYLNHGEWPGNNSSAGVATSANIKGKYVEKVEVKNGVVTATMLSSGVNKEIQGKKLSLWAKRQDGSVKWFYGQPVKRDNASADAVKADTAANGKQIDTKHLPSTASTRKSTPN

SEQ ID NO: 6237 - protein, 128 aa, Neisseria meningitidis
EAILLVEGQKSAVTEYYLNHGEWPGDNSSAGVATSSEIKGKYVKSVEVKNGVVTAQMASSNVNNEIKGKKLSLWAKRQNGSVKWFCGQPVTRDKAKDDAVTAATGKGTANINTKHLPSTAPTRKSTPN

SEQ ID NO: 6238 - protein, 88 aa, Neisseria meningitidis
GFNDAAGVASSSTIKGKYVKEVEVKNGVVTATMLSTGVNNEIKGKKLSLWAKRQAGSVKWFCGQPVTRADNAKDDVAAATGTDKIDTK

SEQ ID NO: 6239 - protein, 139 aa, Neisseria meningitidis
EAILLAEGQKSAVTEYYLNHGEWPGNNTSAGVASSSTIKGKYVKEVTVANGVITATMLSSGVNKEIQGKKLSLWAKRQDGSVKWFCGQPVTRTDAKADTVAAAAKTADNINTKHLPSTCRDASSVVCIETPPTAFYKNT

SEQ ID NO: 6240 - protein, 138 aa, Neisseria meningitidis
GFNDAAGVASSSDIKGKYVEKVEVKNGVVTATMLSSGVNKEIKGKKLSLWAKRQNGSVKWFCGQPVTRNDTATATATDVAAANGKTDDKINTKHLPSTCRDDSSTGCIETPRADFKHFQKISRYRVLPESRQMAEKLR

SEQ ID NO: 6241 - protein, 223 aa, Neisseria meningitidis
GFNDAAGVASSSKIKGKYVKEVTVANGVVTATMLSSGVNKEIQGKKLSLWAKRQNGSVKWFCGQPVTRAGTDDTVAADNTGNKKTNTKHLPSTCRDAASAVCTKTPEYYPNHGEWPKNNTSAGVASSSTIKGKYVKEVTVANGVITATMLSSGVNKEIQGKKLSLWAKRQDGSVKWFCGQPVTRNAANAKAGTDEVTAATPDTDKINTKHLPSTAPTRKSTPN

SEQ ID NO: 6242 - protein, 91 aa, Neisseria meningitidis
MASSGVNKEIKGRKLSLWAKRQAGSVKWFCGQPVERDNAKAANDDVTAAAAANGKKIDTKHLPSTCRDAASAVCTKHPSIARITANGRKTS

SEQ ID NO: 6243 - protein, 109 aa, Neisseria meningitidis
MGGLIIEDLQEGFGKEAVKGKEITVHYTGWLENGTKFDSSLDRRQPLTITLGVGQVIKGWDEGFGGMKEGGKRKLTIPSEMGYGAHGAGGVIPPHATLIFEVELLKVYE

SEQ ID NO: 6244 - protein, 72 aa, Neisseria meningitidis
MLKTLTFAALHFSVAFSVTYVLTGSIGVSGAVALVEPLINTVVFYFHEKAWNLYEKNKTVKQTQPFQLHRCS

SEQ ID NO: 6245 - protein, 317 aa, Neisseria meningitidis
MNHKKIVVLDADTLPGRVFHFDFPHELAVYGTTGADETAERVRDAHIVITNKVMISADIIAANPQLELIAVSATGVNNVDIGAAKAAGVAVCNVRAYGNESVAEHAFMLMIALMRNLPAYQRDVAAGLWEKSPFFCHYGAPIRDLNGKTLAVFGRGNIGRTLAGYAQAFGMGVVFAEHKHASAVREGYVSFEDAVRAADVLSLHCPLNAQTENMIGENELRQMKPGAVLINCGRGGLVDENALLAALKYGQIGGAGVDVLTNEPPKNGNPLLNARLPNLIVTPHTAWASREALDRLFDILLANIHAFVKGEAQNRVV

SEQ ID NO: 6246 - protein, 685 aa, Neisseria meningitidis
MTRKILVTSALPYANGSIHLGHMVEHIQTDVWVRFQKLRGHACHYCCADDTHGTPVMLAAQKQGIAPEDMIAKVREEHLADFTGFFIGYDNYYSTHSPENKQFSQDIYRALKANGKIESRVIEQLFDPEKQMFLPDRFVKGECPKCHAQDQYGDNCEVCGTTYSPTELINPYSAVSGTKPELRESEHFFFKLGECADFLKAWTSGNNPHDGKPHLQAEALNKMKEWLGEGEETTLSDWDISRDAPYFGFEIPDAPGKYFYVWLDAPVGYMASFKNLCDRIGVDFDEYFKADSQTEMYHFIGKDILYFHALFWPAMLHFSGHRAPTGVYAHGFLTVDGQKMSKSRGTFITAKSYLEQGLNPEWMRYYIAAKLNSKIEDIDLNLQDFISRVNSDLVGKYVNIAARASGFIAKRFEGRLKDVADSELLAKLTAQSEAIAECYESREYAKALRDIMALADIVNEYVDANKPWELAKQEGQDERLHEVCSELINAFTMLTAYLAPVLPQTAANAAKFLNLEAITWANTRDTLGKHAINKYEHLMQRVEQKQVDDLIEANKQSIAAAAAPAAEEGKYEKVAEQASFDDFMKIDMRVAKVLNCEAVEGSTKLLKFDLDFGFEKRIIFSGIAASYPNPAELNGRMVIAVANFAPRKMAKFGVSEGMILSAATADGKLKLLDVDTGAQPGDKVG

SEQ ID NO: 6247 - protein, 612 aa, Neisseria meningitidis
MCGIVGAIRAHHNVVDFLTDGLKRLEYRGYDSSGIAVNTDGKIKRVRRVGRVQLMEDAAREKGISGGIGIGHTRWATHGGVTEPNAHPHISGGMIAVVHNGIIENFESERKRLEGLGYRFESQTDTEVIAHSINHEYAQNGGRLFEAVQEAVKRFHGAYAIAVIAQDKPDELVVARMGCPLLVALGDDETFIASDVSAVIAFTRRVAYLEDGDIALLASDGIKRLTDKNGLPAERKVKVSELSLASLELGLYSHFMQKEIHEQPRAIADTAEVFLDGGFIPENFGKDAKSVFESIRSVKILACGTSYYAALTAKYWLESIAKIPSDVEIASEYRYRSVIADSDQLVITISQSGETLDTMEALKYAKSLGHRHSLSICNVMESALPRESSLVLYTRAGAEIGVASTKAFTTQLVALFGLAVTLAKVRGLVSEEDEARYTEELRQLPGSVQHALNLEPQIAAWAQQFAKKTSALFLGRGIHYPIALEGALKLKEITYIHAEAYPAGELKHGPLALVDENMPVVVIAPNDSLLDKVKANMQEVGARGGELFVFADLDSNFNATEGVHVIRAPRHVGKLSPVVHTIPVQLLAYHTALARGTDVDKPRNLAKSVTVE

SEQ ID NO: 6248 - protein, 175 aa, Neisseria meningitidis
MEMKQMLLAVGVVAVLAGCGKDAGGYEGYWREKSDKKEGMIAVKKEKGNYFLNKIHVVTGKEESLLLSEKDGALSINTGIGEIPIKLSDDGKELYVERRQYVKTDAAMKDKIIAHQKKCGQTAQAYRDARNALPSNQTYQQHLAAIEQLKRRFEAEFDELEKEIKCNGRSPALLL

SEQ ID NO: 6249 - protein, 441 aa, Neisseria meningitidis; identical to SEQ ID NO: 3774

SEQ ID NO: 6250 - protein, 279 aa, Neisseria meningitidis
MLVAFLIMLREGIEAALIVGIVAGFLKQSGHSKLMPKVWFGVVLASLMCLGLGYGIHSATGEIPQKQQEFVVGIIGLVAVAMLTYMILWMKKAARSMKRQLQDSVQAALNRGSGQGWALVGMAFLAVAREGLESVFFLLAVFKQSPTWQMPAGAVAGVLAAAVIGALIYQGGMRLNLAKFFRWTGAFLIVVAAGLLAGSLRALHEAGIWNALQDIVFDSSKYLHEDSPLGVLLGGFFGYTDHPTQGETLVWLLYLIPVITWFLCGSRPSETLTRKEELK

SEQ ID NO: 6251 - protein, 388 aa, Neisseria meningitidis; identical to SEQ ID NO: 2850

SEQ ID NO: 6252 - protein, 421 aa, Neisseria meningitidis; identical to SEQ ID NO: 3546

SEQ ID NO: 6253 - protein, 109 aa, Neisseria meningitidis
MSLPPCPQCASEYTYEDGGQYICPECAHEWNETESAADLAAQVRDANGAVLQNGDTVILIKDLKVKGSSMVIKQGTKVKGIRLQEGDHNIGCKIDGSAMNLKSEFVKKA

SEQ ID NO: 6254 - protein, 456 aa, Neisseria meningitidis
MPQNTLNIVILAAGKGTRMYSKMPKVLHRIGGKPMVGRVIDTAAALNPQNICVVIGHGKEQVLDTVKRDVVWVEQTEQLGTGHAVKTALPHLSAEGRTLVLYGDVPLIDVETLETLLEAAGNEVGLLTDVPNDPTGLGRIIRDSNGSVTAIVEEKDADAVQKAVKEINTGILVLPNAKLENWLNSLSSNNAQGEYYLTDLIAKAVADGIKVHPVQVRASHLAAGVNNKLQLTELERIFQTEQAQELLKAGVTLRDPARFDLRGRLKHGQDVVIDVNCIFEGDIELGDNVEIGANCVIKNAKIGANSKIAPFSHLESCEVGENNRIGPYARLRPQARLADDVHVGNFVEIKNAAIGKGTKANHLTYIGDAEVGCKTNFGAGTIIANYDGVHKHKTVIGDEVRIGSNCVLVAPVTLGNKVTTGAGSTITRNVEDNKLALARARQTVIEGWVRPEKDKQ

SEQ ID NO: 6255 - protein, 90 aa, Neisseria meningitidis; identical to SEQ ID NO: 3726

SEQ ID NO: 6256 - protein, 237 aa, Neisseria meningitidis
MQENPTVWLFDLDNTLHDADAGIFTLINRAMTRYMARRLKLSESAASDLRQDYWHRYGATLAGLQIHHPEIDIAEFLRESHPIDAILTRLHGMPETQNTLSRLKGRKAVFSNGPSFYVRAVVNALGLENRFDALFGTDDFGLLYKPNPQAYLNVCRLLDVPPECCIMVDDSADNLHQAKALGMKTVRFGAKSHALPFIDASVSDMAQLARYAETLSEHRQNHYNTPYPPKIRKKSHA

SEQ ID NO: 6257 - protein, 333 aa, Neisseria meningitidis
MKRKIWLLPLLAVSAYLQAQTEVRLAVHKSFSLPKGLIARFERANDAKVSIIQAGGANEMLNKLILSRANPIADAVYGLDNANIGKAREMGILAAAQPESAPVAVGLPSALAVDYGYVSINYDKKWFEGKKLPLPQTLQDLTRPEYKNLLVVPSPATSSPGLGFLMANISGLGEESAFKWWAQMRQNGVKVAKGWSEAYYTDFSHNGGAYPLVVGYAASPAAEVYFSKGKYSEPPTGNLFLKGGVFRQVEGAAVLKGAKQPELAAKLVQWLQSREVQQAVPSEMWVYPAVKNTRLPDVFRFAQAPTHTTAPAQRDIDANQRGWVSRWIRTVLK

SEQ ID NO: 6258 - protein, 282 aa, Neisseria meningitidis; identical to SEQ ID NO: 2752

SEQ ID NO: 6259 - protein, 161 aa, Neisseria meningitidis
MDALHTIARNLTKKRQTVSCAESCTGGMLAAAFTSVAGSSQWFDQSFVTYSNKAKEDRLGVLPETLLEHGAVSRQTVYEMARGAKAVAQADYAVGISGIAGPGGGSESKPVGTVWFGFAFPGGSCEAMRRFDGNRESVRAQAVAFALERLAGLIENGGDAV

SEQ ID NO: 6260 - protein, 522 aa, Neisseria meningitidis
MKHRTFFSLCAKFGCLLALGACSPKIVDAGAATVPHTLSTLKTADNRPASVYLKKDKPTLIKFWASWCPLCLSELGQTEKWAQDAKFSSANLITVASPGFLHEKKDGDFQKWYAGLNYPKLPVVTDNGGTIAQSLNISVYPSWALIGKDSDVQRIVKGSINEAQALALIRDPNADLGSLKHSFYKPDTQKKDSKIMNTRTIYLAGGCFWGLEAYFQRIDGVVDAVSGYANGNTKNPSYEDVSYRHTGHAETVKVTYDADKLSLDDILQYFFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKTAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSYNMRRTEVRSHAADSHLGHVFPDGPRDKGGLRYCINGASLKFIPLEQMDAAGYGALKGKVK

SEQ ID NO: 6261 - protein, 421 aa, Neisseria meningitidis
MFSFFRRKKKQETPALEEAQIQETAAKAESELAQIVENIKEDAESLAESVKGQVESAVETVSGAVEQVKETVAEMLSEAEEAAEKAAEQVEAAKEAVAETVGEAVGQVQEAVATTEEHKLGWAARLKQGLTKSRDKMAKSLAGVFGGGQIDEDLYEELETVLITSDMGMEATEYLMKDVRDRVSLKGLKDGNELRGALKEALYDLIKPLEKPLVLPETKEPFVIMLAGINGAGKTTSIGKLAKYFQAQGKSVLLAAGDTFRAAAREQLQAWGERNNVTVISQTTGDSAAVCFDAVQAAKARGIDIVLADTAGRLPTQLHLMEEIKKVKRVLQKAMPDAPHEIIVVLDANIGQNAVNQVKAFDDALGLTGLIVTKLDGTAKGGILAALASDRPVPVRYIGVGEGIDDLRPFDARAFVDALLD

SEQ ID NO: 6262 - protein, 74 aa, Neisseria meningitidis
MPSENSRPMPSFPRRRESRPWDNGNIQRLSESPRFWIPTFVGMTGCRFVGMTWCRFPYGWIRHSRAGGNLERKI

SEQ ID NO: 6263 - protein, 94 aa, Neisseria meningitidis
MQPAVYILASQRNGTLYIGVTSDLVQRIYQHREHLIEGFTSRYNVTMLVWYELHPTMESAITREKQLKKWNRAWKLQLIEENNVSWQDLWFDII

SEQ ID NO: 6264-6265 - skipped (2 entries)

SEQ ID NO: 6266 - protein, 716 aa, Neisseria meningitidis; identical to SEQ ID NO: 106

SEQ ID NO: 6267 - protein, 408 aa, Neisseria meningitidis
MNTDNLHDILDEMVQVYSQKKQSRSETPAEIGAHFHPLLDRLCETAEAQNASDILISKGFPPSLKINSALTPQPQKALTGEETAAIAASTMNAEQSEIFRRDGEINYSVQSRSGTRYRANAYHSQGSAGLVLRRINHVIPQMQELGLPEKLKDLAVAPRGLLIIVGPTGSGKSTTMATMLEHRNKTLPSHIVTIEDPIEFIYKPRRCIFTQREIGVDTINWQTAVQNAMRQSPDVVCIGEVRSRESMEYAMQLAQTGHLCIFTLHANTAPQSLERILNFYPKEQHNQILIDIALNLTGIICQRLALKQDKTGRTAVVDLLINTPAIQDFILKGDLMNISKIMETAKTDGMQTMDQNLFELYRHGIISYEEALRQSVSANNLRLHIQLHKEGKTPELLYDRVNGLNLIS

SEQ ID NO: 6268 - protein, 347 aa, Neisseria meningitidis
MQITDLLAFGAKNKASDLHLSSGISPMIRVHGDMRRINLPEMSAEEVGNMVTSVMNDHQRKIYQQNLEVDFSFELPNVARFRVNAFNIGRGPAAVFRTIPSTVLSLEELKAPSIFQKIAESPRGMVLVTGPTGSGKSTTLAAMINYINETQPAHILTIEDPIEFVHQSKKSLINQRELHQHTLSFANALRSALREDPDVILVGEMRDPETIGLALTAAETGHLVFGTLHTTGAAKTVDRIVDVFPAGEKEMVRSMLSESLTAVISQNLLKTHDGNGRVASHEILIANPAVRNLIRENKITQINSVLQTGQASGMQTMDQSLQSLVRQGLIAPEVARRRAQNSESMSF

SEQ ID NO: 6269 - protein, 228 aa, Neisseria meningitidis
MTVLQERYCEVSDRIGKLVLQAGREPHSVSLIAVGKTFPSDGIREVYAAGQRDFGENYIQEWYGKTEELADLTDIVWHVIGDVQSNKTKFVAERAHWVHTVCRLKTAVRLSGQRPSSMPPLQVCIEVNIAGEAVKHGVAPEEAVALAVEVAKLPNIVVRGLMCVAKANSSETELKVQFQTMRKLLADLNAAGVKADVLSMGMSDDMPAAIECGATHVRIGSAIFGKRG

SEQ ID NO: 6270 - protein, 135 aa, Neisseria meningitidis; identical to SEQ ID NO: 858

SEQ ID NO: 6271 - protein, 263 aa, Neisseria meningitidis
MNVYFLGGGNMAAAVAGGLVKQGGYRIYIANRGAEKRERLEKELGVETSATLPELHSDDVLILAVKPQDMEAACKNIRTNGALVLSVAAGLSVGTLSRYLGGTRRIVRVMPNTPGKIGLGVSGMYAEAEVSETDRRIADRIMKSVGLTVWLDDEEKMHGITGISGSGPAYVFYLLDALQNAAIRQGFDMAEARALSLATFKGAVALAEQTGEDFEKLQKNVTSKGGTTHEAVEAFRRHRVAEAISEGVCACVRRSQEMERQYQ

SEQ ID NO: 6272 - protein, 138 aa, Neisseria meningitidis
MAKLTEQDILNWSGPEDDYMNDDHLAFFRELLVKMQDELIENASATTGHLQEHESAPDPADRATQEEEYALELRTRDRERKLLSKIQATIRNIDEGDYGFCADTGEPIGLKRLLARPTATLSVESQERRERMKKQFAD

SEQ ID NO: 6273 - protein, 118 aa, Neisseria meningitidis
MSVMAGRHPYGVRSGLRRNGLKLWDIHFRMTRFIVARCGLLFATLKGKTMKKMFVLFCMLFSCAFSLAAVNINAASQQELEALPGIGPAVLAKLKDQASVGAPAPKGPAKPVLPADKK

SEQ ID NO: 6274 - protein, 52 aa, Neisseria meningitidis
MPSEHAFGRRFYNKNTSWRLVLCLSKFLCRAYLKISDGIGLCCLKSVFRFSL

SEQ ID NO: 6275 - protein, 373 aa, Neisseria meningitidis
MSNQDFYATLGVARTATDDEIKKAYRKLAMKYHPDRNPDNKEAEEKFKEVQKAYETLSDKEKRAMYDQYGHAAFEGGGQGGFGGFGGFGGAQGFDFGDIFSQMFGGGSGRAQPDYQGEDVQVGIEITLEEAAKGVKKRINIPTYEACDVCNGSGAKPGTSPETCPTCKGSGTVHIQQAIFRMQQTCPTCHGAGKHIKEPCVKCRGAGRNKAVKTVEVNIPAGIDDGQRIRLSGEGGPGMHGAPAGDLYVTVRIRAHKIFQRDGLDLHCELPISFATAALGGELEVPTLDGKVKLTVPKETQTGRRMRVKGKGVKSLRSSATGDLYCHIVVETPVNLTDRQKELLEEFERISTGLENQTPRKKSFLDKLRDLFD

SEQ ID NO: 6276 - protein, 672 aa, Neisseria meningitidis
MNKSLSSSVEEYRELTLRGMILGALITVIFTASNVYLGLKVGLTFASSIPAAVISMAVLKFFKGSNILENNMVQTQASAAGTLSTIIFVLPGLLMAGYWSGFPFWQTTLLCIAGGILGVIFTIPLRYAMVVKSDLPYPEGVAAAEILKVGGHEEGDNRQGGSGIKELAAGGALAGLMSFCAGGLRVIADSASYWFKSGTAIFQLPMGFSLALLGAGYLVGLTGGIAILLGISIAWGIAVPYFSSHIPQPSDMEMAAFAMKLWKEKVRFIGAGTIGIAAVWTLLMLLKPMVEGMKMSFKSFGGGAPAAERAEQDLSPKAMIFWVLAMMFVLGVSFYHFIGDSHITGGMAWLLVVVCTLLASVIGFLVAAACGYMAGLVGSSSSPISGVGIVSVVVISLVLLLVGESGGLLADEANRKFLLALTLFCGSAVICVASISNDNLQDLKTGYLLKATPWRQQVALIIGCIVGALVISPVLELLYEAYGFTGAMPREGMDAAQALAAPQATLMTTIASGIFAHNLEWVYIFTGIVIGAVLIVVDLVLKKSSGGKLALPVLAVGMGIYLPPSVNMPIVAGAVLAAVLKHIIGKKAENREGRLKNAERIGTLFSAGLIVGESLIGVIMAFIIAFSVTNGGSDAPLALNLQNWDAAASWLGLAFFVTGMFFFAQRVLKAGK

SEQ ID NO: 6277 - skipped

SEQ ID NO: 6278 - protein, 288 aa, Neisseria meningitidis
MKGIILAGGSGTRLYPITRGVSKQLLPVYDKPMIYYPLSVLMLAGIRDILVITAPEDNASFKRLLGDGSDFGISISYAVQPSPDGLAQAFIIGEEFIGNDNVCLVLGDNIFYGQSFTQTLKQAAAQTHGATVFAYQVKNPERFGVVEFNENFRAVSIEEKPQRPKSDWAVTGLYFYDNRAVEFAKQLKPSARGELEITDLNRMYLEDGSLSVQILGRGFAWLDTGTHESLHEAASFVQTVQNIQNLHIACLEEIAWRNGWLSDEKLEELARPMAKNQYGQYLLRLLKK

SEQ ID NO: 6279 - protein, 355 aa, Neisseria meningitidis
MRKILVTGGAGFIGSAVVRHIIRNTRDAVVNVDKLTYAGNLESLTEVADNPRYAFEQVDICDRAELDRVFAQYRPDAVMHLAAESHVDRSIGSAGEFIQTNIVGTFNLLEAARAYWQQMPSEQHEAFRFHHISTDEVYGDLGGTDDLFTETAPYAPSSPYSASKASSDHLVRAWLRTYGLPTIVTNCSNNYGPYHFPEKLIPLMILNALDGKPLPVYGDGMQIRDWLFVEDHARALYQVVTEGVVGETYNIGGHNEKANIEVVKTICALLEELAPEKPAGVARYEDLITFVQDRPGHDVRYAVDAAKIRRDLGWLPLETFESGLRKTVQWYLDNKTWWQNVLNGSYRLERLGTGK

SEQ ID NO: 6280 - protein, 339 aa, Neisseria meningitidis
MKKILVTGGTGFIGSHTVVSLLKSGHQVVILDNLCNSSINILPRLKTITGQEIPFYQGDIRDREILRRIFAENRIDSVIHFAGLKAVGESVAEPMKYYDNNVSGSLVLAEEMARAGVFSIVFSSSATVYGDPGKVPYTEDMPPGDTTSPYGASKSMVERILTDIQKADPRWSMILLRYFNPIGAHESGLIGEQPNGIPNNLLPYICQVAAGKLPQLAVFGDDYPTPDGTGMRDYIHVMDLAEGHVAAMQAKSNVAGTHLLNLGSGRASSVLEIIRAFEAASGLTIPYEVKPRRAGDLACFYADPSYTKAQIGWQTQRDLTQMMEDSWRWVSNNPNGYDD

SEQ ID NO: 6281 - protein, 308 aa, Neisseria meningitidis
MHQYYDAVILSVGNGLLKRFFKQNAQLNIASRPLIITLFPGVVFGDQASILSRMGADIVLYNNKHDFRIAEEYKKQYKLSCQNILYGYPIFRHASKGCHGEKIYFIDQVKIPFKKEERIYTLKKLIALAEKYPEKEFTILLRVADKDITVHQDKHSYIELAKQFQLPSNLTIERKSTAQAFQEMGYCLSYSSTMLFEAECKGIPVGVVADLGFSKSYANQHFLGSGVLVYFDQIDFTSPKIADPDWLDCYATKKVITTDEFNKLLKQVVPLQHDYQEYLSAGIRYQALANTHAIPTNSFLGIKPCSDA

SEQ ID NO: 6282 - protein, 244 aa, Neisseria meningitidis
MNEKNIKHSQNFITSKHNIDKIMTNIRLNEHDNIFEIGSGKGHFTLELVQRCNFVTAIEIDHKLCKTTENKLVDHDNFQVLNKDILQFKFPKNQSYKIFGNIPYNISTDIIRKIVFDSIADEIYLIVEYGFAKRLLNTKRSLALFLMAEVDISILSMVPREYFHPKPKVNSSLIRLNRKKSRISHKDKQKYNYFVMKWVNKEYKKIFTKNQFNNSLKHAGIDDLNNISFEQFLSLFNSYKLFNK

SEQ ID NO: 6283 - protein, 225 aa, Neisseria meningitidis
MLKKIKKALFQPKKFFQDSMWLTTSPFYLTPPRNNLFVISNLGQLNQVQSLIKIQKLTNNLLVILYTSKNLKMPKLVHQSANKNLFESIYLFELPRSPNNITPKKLLYIYRSYKKILNIIQPAHLYMLSFTGHYSYLISIAKKKNITTHLIDEGTGTYAPLLESFSYHPTKLERYLIGNNLNIKGYIDHFDILHVPFPEYAKKIFNAKKYNRFFAWRKGDVLQGD

SEQ ID NO: 6284 - protein, 349 aa, Neisseria meningitidis
MQNNNEFKIGNRSVGYNHEPLIICEIGINHEGSLKTAFEMVDAAYNAGAEVVKHQTHIVEDEMSDEAKQVIPGNADVSIYEIMERCALNEEDEIKLKEYVESKGMIFISTPFSRAAALRLQRMDIPAYKIGSGECNNYPLIKLVASFGKPIILSTGMNSIESIKKSVEIIREAGVPYALLHCTNIYPTPYEDVRLGGMNDLSEAFPDAIIGLSDHTLDNYACLGAVALGGSILERHFTDRMDRPGPDIVCSMNPDTFKELKQGAHALKLARGGKKDTIIAGEKPTKDFAFASVVADKDIKKGELLSGDNLWVKRPGNGDFSVNEYETLFGKVAACNIRKGAQIKKTDIE

SEQ ID NO: 6285 - protein, 228 aa, Neisseria meningitidis
MEKQNIAVILARQNSKGLPLKNLRKMNGISLLGHTINAAISSKCFDRIIVSTDGGLIAEEAKNFGVEVVLRPAELASDTASSISGVIHALETIGSNSGTVTLLQPTSPLRTGAHIREAFSLFDEKIKGSVVSACPMEHHPLKTLLQINNGEYAPMRHLSDLEQPRQQLPQAFRPNGAIYINDTASLIANNCFFIAPTKLYIMSHQDSIDIDTELDLQQAENILNHKES

SEQ ID NO: 6286 - protein, 377 aa, Neisseria meningitidis
MKRILCITGTRADFGKLKPLLAYIENHPDLELHLIVTGMHMMKTYGRTYKEVTRENYQHTYLFSNQIQGEPMGAVLGNTITFISRLSDEIEPDMVMIHGDRLEALAGAAVGALSSRLVCHIEGGELSGTVDDSIRHSISKLSHIHLVANEQAVTRLVQMGEKRKHIHIIGSPDLDVMASSTLPSLEEVKEYYGLPYENYGISMFHPVTTEAHLMPQYAAQYFKALELSGQNIISIYPNNDTGTESILQELLKYQSDKFIAFPSIRFEYFLVLLKHAKFMVGNSSAGIREAPLYGVPSIDVGTRQSNRHMGKSIIHTDYETKNIFDAIQQACSLGKFEADDTFNGGDTRTSTERFAEVINNPETWNVSAQKRFIDLNL

SEQ ID NO: 6287 - protein, 391 aa, Neisseria meningitidis
MFKVKFYIRHAVLLLCGSLIVGCSAIPSSGPSAKKIVSLGQQSEVQIPEVELIDVNHTVAQLLYKAQINQSFTQFGDGYASAGTLNIGDVLDIMIWEAPPAVLFGGGLSSMGSGSAHQTKLPEQLVTARGTVSVPFVGDISVVGKTPGQVQEIIKGRLKKMANQPQVMVRLVQNNAANVSVIRAGNSVRMPLTAAGERVLDAVAAVGGSTANVQDTNVQLTRGNVVRTVALEDLVANPRQNILLRRGDVVTMITNPYTFTSMGAVGRTQEIGFSARGLSLSEAIGRMGGLQDRRSDARGVFVFRYTPLVELPAERQDKWIAQGYGSEAEIPTVYRVNMADAHSLFSMQRFPVKNKDVLYVSNAPLAEVQKFLSFVFSPVTSGANSINNLTN

SEQ ID NO: 6288 - protein, 387 aa, Neisseria meningitidis
MSEQLPVAVATETKAERKKPKKKSWIKKLSPLFWVTVIIPTVISLVYFGFFASDRFTSQSSFVVRSPKSQSSLNGLGAILQGTGFARAQDDIYTVGEYMRSRSSLDELRKILPVREFYETKGDAFSRFNGFGFRGEEEAFYQYYKNQVMINFDTVSGISTLNVTSFDALESKKINEALLKQGEALINQLNDRARADTVRYAEEVVKTAAERVKEASQNLTDYRIANGVFDLKAQSEVQMGLVSKLQDELIVIQTQLDQVKAVTPENPQIPGLQAREQSLRKEIDQQLRAISGGGHSSLSNQAAEYQRVYLENQLAEQQLAAAMTSLESAKVEADRQQLYLEVISQPSLPDLAHEPKRLYNIVATLIIGLMVYGILSLLTASIREHKN

SEQ ID NO: 6289 - protein, 265 aa, Neisseria meningitidis
MKALHKTSFWESLAIQRRVIGALLMREIITRYGRNNIGFLWLFVEPLLMTFVIVLMWKFLRADRYSTLNIVAFAITGYPMLMMWRNASKRAVGSISSNASLLYHRNVRVLDTILARMILEIAGATIAQIVIMAVLIAIGWIEMPADMFYMLMAWLLMAFFAIGLGLVICSIAFNFEPFGKIWGTLTFVMMPLSGAFFFVHNLPPKVQEYALMIPMVHGTEMFRAGYFGSDVITYENPWYIVLCNLVLLLFGLAMVSKFSKGVEPQ

SEQ ID NO: 6290 - protein, 216 aa, Neisseria meningitidis
MISVEHVSKRYLTRQGWRTVLHDISFKMEKGEKIGILGRNGAGKSTLIRLISGVEPPTTGEIKRTMSISWPLAFSGAFQGSLTGMDNLRFICRIYNVDIDYVKAFTEEFSELGQYLYEPVKRYSSGMKARLAFALSLAVEFDCYLIDEVIAVGDSRFADKCKYELFEKRKDRSIILVSHSHSAMKQYCDNAMVLEKGHMYQFEDMDKAYEYYNSLP

SEQ ID NO: 6291 - protein, 757 aa, Neisseria meningitidis
MNITQILSQELSATAAQITAAVELLDDGATVPFIARYRKEATGGLDDTQLRRLAERLQYLRELEERKAVVLKSIEEQGKLSDDLRAQIEAADNKTALEDLYLPYKPKRRTKAQIAREHGLQPLADVLLAEQSQDVEAAAQGYLNENVPDAKAALDGARAILMEQFAEDAELIGTLRDKLWNEAEIHAQVVEGKETEGEKFSDYFDHREPVRTMPSHRALAVLRGRNEGVLNIALKYQPDDTPITRQSEYEQIIACRFKVSDGHKWLRDTVRLTWRAKIFLSLELEALGRLKEAADTDAITVFARNLKDLLLVAPAGRLTTLGLDPGYRNGVKCAVVDDTGKLLDTVIVYLHQENNMLATLSRLIKQHGVKLIAIGNGTASRETDKIAGELVRGMPEMGLHKIVVSEAGASIYSASELAAREFPDLDVSLRGAVSIARRLQDPLAELVKIDPKSIGVGQYQHDVNQNQLAKSLDAVVEDCVNAVGVDVNTASAPLLARISGLNQTLAQNIVAYRDENGAFDSRKKLLKVPRLGEKTFEQAAGFLRINGGKEPLDASAVHPEAYPVVAKMLAQQGISAAELIGNRERVKQIKASDFTDERFGLPTILDILSELEKPGRDPRGEFQTASFAEGIHEISDLQVGMILEGVVSNVANFGAFVDIGVHQDGLVHISALSNKFVQDPREVVKAGDVVKVKVLEVDAARKRIALTMRLDDEPGGAKHKMPSENRSRERTAGRKPQRNDRAPANSAMADAFAKLKR

SEQ ID NO: 6292 - skipped

SEQ ID NO: 6293 - protein, 116 aa, Neisseria meningitidis
MKMNKQYPKINYIGNKEKIASWICDQLPSDVDTVADVFSGGCSFAYEAKKRGYRVITNDILAINYQIALALIENNHETLNDDDVAMIFSGSPHAGFMSQRYAEKFYFHDEYQQLDL

SEQ ID NO: 6294 - protein, 218 aa, Neisseria meningitidis
MAFTLMRRAMIRKMPYTEDMRPGDTANPYGASKAMVERMLTDIQKADPRWSMILLRYFNPIGAHESGLIGEQPNGIPNNLLPYICQVAAGKLPQLAVFGDDYPTPDGTGMRDYIHVMDLAEGHVAAMQAKSNVAGTHLLNLGSGRASSVLEIIRAFEAASGLTIPYEVKPRRAGDLACFYADPSYTKAQIGWQTQRDLTQMMEDSWRWVSNNPNGYDD

SEQ ID NO: 6295 - protein, 355 aa, Neisseria meningitidis; identical to SEQ ID NO: 6279

SEQ ID NO: 6296 - protein, 288 aa, Neisseria meningitidis; identical to SEQ ID NO: 6278

SEQ ID NO: 6297 - protein, 184 aa, Neisseria meningitidis
MKDKKMNIIDTAIPDVKLLEPQVFGDARGFFMETFRDEWFKTQVCERTFVQENHSKSGKGVLRGLHYQTENTQGKLVRVVVGEVFDVAVDMRKDSPTFGKWVGEILSAENKRQLWVPEGFAHGFYVLSDEAEFVYKCTDYYNPKAEHSLIWNDPTVGIDWPLQGEPNLSPKDLAGKVLSEAVTF

SEQ ID NO: 6298 - protein, 704 aa, Neisseria meningitidis
MFLFSDGLQSINNNNRRKRIVKNAYIPSRGIRKIPHLSTLLPEFHICKDGKEAEAVVGWGLRPTTHKARAFAAEHQLPFIALEDGFLRSLGLGVAGYPPYSIVYDDIGIYYDTTRPSRLEQLILAADTMPSETLAQAQQAMDFILQHHLSKYNHAPELSDDHPLRSPSKPETVLIIDQTFGDMAIQYGGADASTFELMFQTALNENPQADIWVKTHPDVLCGKKQGYLTQLAQQHRVHLLAEDINPISLLQNVDKVYCVTSQMGFEALLCGKPLTTFGLPWYAGWGVSDDRHPEINRLVQTQRRATRNLLQLFAAAYLQYSRYLNPNTGEAGSLFDVIDYLATVKRKNDKLRGELYCVGMSLWKRAVAKPFFNVPSCRLKFISSTQKLARVKLSDDARILAWGNGKEAIVRFAEQHHIPLLRMEDGFIRSVGLGSNLVPPLSLVTDDMSIYFNAETPSRLEYILQNQNFDDQDFQTALKLQKMLTENHISKYNVGSSDFTAPSTDKTVILVPGQVEDDASIRYGSPQIYRNLDLLRTVRERNPNAYIIYKPHPDVVSGNRIGHISPEDAARYADQTAEQADILTCLQYADEIHTMTSLTGFEALLRGKKVSCYGLPFYAGWGLTQDLLPIPRRSRRLELWQLIAGTLIHYPDYIHPETHQAINAETAAQILIRQKNMQKNNNGLHRGCFAKKLGKIKQLYRSFK

SEQ ID NO: 6299 - protein, 419 aa, Neisseria meningitidis
MKQTVLKNNLQNLLESAENILLLQGPVGDFFLRLADWLTANGKTVHKFNFNAGDDYFYPPTQAHTVVFNDNYDAFPEFLQEYITQHHIQAVVCFGDTRPYHVIAKRIANENQASFWAFEEGYFRPYYITLEKDGVNAFSPLPRRADFFLEQFPKLAQQEYKAPTPVHGGFTPMAKNAIRYYIELFRNPRKYPDYIHHRAPNAGHYLKPWSLSILKRLNYYIEDIQIAKRVEAGKYGKFFIVPLQVFNDSQVRIHCDFPSVRSFLLHVLSSFAEHAPADTNIIIKHHPMDRGFIDYWRDIKRFIKEHPELKGRVIYVHDVPLPVFLRHGLGMVTINSTSGLSGLIHNMPVKVLGRAYYDIPGITDQNTLAEFWNHPTPPDKELFHAYRMYHLNVTQINGNFYSQVFFPNKKTSNSSTPVI

SEQ ID NO: 6300 - skipped

SEQ ID NO: 6301 - protein, 404 aa, Neisseria meningitidis
MEWEFNSYYTLIAATLVLLVGKFLVQKIKFLRDFNIPEPVAGGLIAAIVLFALHEAYGVSFKFEKPLQNAFMLIFFTSIGLSADFSRLKAGGLPLVVFTAIVGGFILVQNFVGVGLATALGLDPLIGLITGSVSLTGGHGTSGAWGPNFETQYGLVGATGLGIASATFGLVFGGLIGGPVARRLINKMGRKPVENKKQDQDDNADDVFEQAKRTRLITAESAVETLAMFAACLAFAEIMDGFDKEYLFDLPKFVWCLFGGVVIRNILTAAFKVNMFDRAIDVFGNASLSLFLAMALLNLKLWELTGLAGPVTVILAVQTVVMVLYATFVTYVFMGRDYDAAVLAAGHCGFGLGATPTAVANMQSVTHTFGASHKAFLIVPMVGAFFVDLINAAILTGFVNFFKG

SEQ ID NO: 6302 - protein, 338 aa, Neisseria meningitidis; identical to SEQ ID NO: 684

SEQ ID NO: 6303 - protein, 65 aa, Neisseria meningitidis
MNTVPKSRIPVKPLPEKTTDEAKVEKWRQLGAEHGLSGEWAVAVRLGENGFTEEQMENIANLFGR

SEQ ID NO: 6304 - protein, 466 aa, Neisseria meningitidis; identical to SEQ ID NO: 3970

SEQ ID NO: 6305 - protein, 490 aa, Neisseria meningitidis
MNQTSRDLTRISHNTKIVATLGPGSNNVELLEDMIRVGGLNVVRFNFSHGTPEFHQENALIVREAAKRAGQEIAIIADLQGPKIRVGKIAGGGIELNKGETLVLDAALEGEGTREAVGLDYRDLPDDVAAGDVLWLDDGLLTLTVESVEGSRIITRVENSHVLKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQVEYPEAVSTNLAVAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 6306 - skipped

SEQ ID NO: 6307 - protein, 78 aa, Neisseria meningitidis
MKELHTSELVEVSGGKFHIFAQGGGNLGKKDMVAVGKIGASYSPNNSGVEFSVSKQFGYVQGLGVQFSKPTFGISKKW

SEQ ID NO: 6308 - protein, 75 aa, Neisseria meningitidis
MVRFFVLSFLTLINLCSLSACNSHFTGNINPLGTHNKVANPNCANSANSHIRQPSRKNYDPTEYSAWLQYMHDCK

SEQ ID NO: 6309 - protein, 28 aa, Neisseria meningitidis
MSNDENLLFSQPHLTKVNIMQVLTLNEI

SEQ ID NO: 6310 - protein, 62 aa, Neisseria meningitidis
MKKYSDYFKYLIFFLILLPTNYLVSHYVVQTSMSMLSILSSSIITTCLFFVFTNLSQSKKHK

SEQ ID NO: 6311 - protein, 50 aa, Neisseria meningitidis
MSNNHSFFRPEVFVAQRNKWTGPVGWVDAMGAGIFSVAGGYNIGRGMMKP

SEQ ID NO: 6312 - protein, 56 aa, Neisseria meningitidis
MNTETIYATVFCILAATISGLLVKFNVIKIETSINSKFMLLGISILIIGIFLSIFF

SEQ ID NO: 6313-6314 - skipped (2 entries)

SEQ ID NO: 6315 - protein, 47 aa, Neisseria meningitidis
MEWAENETVKLAQKWEQEQKKQQIQQKKETEKSPKHKASRDDWEMER

SEQ ID NO: 6316 - protein, 48 aa, Neisseria meningitidis
MKFVKSGRNPLKKMEKKLNIIKNIQEFMVKFVELALMAISEKSYIVVP

SEQ ID NO: 6317 - skipped

SEQ ID NO: 6318 - protein, 172 aa, Neisseria meningitidis
MWRVLSALPIGVVFFDLIYGFVLNVLQGLDLQRAVPDSEGVLAVTPDIAFNSLQIVANGGMAAVVCFGLAVVFLLNRSVRRRQVLEIGVFRMLGLVAVLAFSAPSVWEWANALPLLLKGADVVNTGNARYVLTALCMPFPAVSCVIGLVGRFRLQTASGRAAKSGGAGKADG

SEQ ID NO: 6319 - protein, 164 aa, Neisseria meningitidis
MDFSCGAASIATLLNNFYGRHYSEAEILDKMDKTQMRASFDDMQRIMPELGFEAQGYALPFEQLVQLKIPVIVYLKYRKNNHFSVLNGINGETVLLADPSLGHVSMSKSQFLSAWKTRDGEMEGKILAIVPKNTDFVRNQMFFNKNPVRQTRFTVEQIQMRQKR

SEQ ID NO: 6320 - protein, 224 aa, Neisseria meningitidis
MLAIYSINILIYNEKSFFRVTLYFVKNFVSFSKPRKSNEMMQKHKCLIDFILTVASQIAYADLPLSLEELLTDKGKFKLESSISYINTERNQSEFANPIYVQTSATKIATVMAMMITPVMAQNLDSQVFDSQNVKAIQLSQAEMKETQGEFVPIIAAAAFGGALGAWGYHGANLYNHGKLGTAQGAATATGIGAATGVAAKQGWLLLPEADWLGIWHGDRVFMH

SEQ ID NO: 6321 - protein, 280 aa, Neisseria meningitidis
MLVCNPYEVVIHGTTSSGKIFRPSDWAERLCGILSSFTKDHRLSYSKWVRPILVDNIRCVAVDKKLETDNPQMFRFLMDFAADNDLRVIDCKALLEEREQGGQNNPADEHVMLAQAIEEKHAAEKAQEQTASGASYVLREIGADDTATAFAALSVLRSALTDINRFTEQINKVQRPQGYRLLGIFEEGKHNAVAVCGFREACTLASGRHIHIDDIVTLPQSRRKGYASRLLEEVRKIGAETGVTKIHLNVHVNHDRADAHRLYFKNGFEICAYHFRCDPK

SEQ ID NO: 6322 - protein, 306 aa, Neisseria meningitidis
MPNPLYRQHIISISDLSREQLECLLQTALKLKAHPRGDLLEGKLIGSCFFEPSTRTRLSFETAVQRLGGKVIGFSDGANTSAKKGETLADTARIISGYTDAIIQRHPKDGAARVAAEFSRVPVINAGDGTNQHPSQTLLDLVTIYETQGRLDKLKIAMAGDLKYGRTVHSLCQALKRWNCEFAFVSPPSLAMPDYITEELDEAGCRYRILGSLEEAAEWADILYMTRVQRERFDEQEFAKIQGKFNLEASMLARAKPNLRVLHPLPRVDEIHPDVDATPHAYYFEQATNGVYARMAILSLVLNEEV

SEQ ID NO: 6323 - protein, 152 aa, Neisseria meningitidis
METPKLSVEAIEKGTVIDHIPAGRGLTILRQFKLLHYGNAVTVGFNLPSKTQGSKDIIKIKGVCLDDKAADRLALFAPEAVVNTIDNFKVVQKRHLNLPDEIAEVFRCPNTNCAGHGEPVKSRFYVKKHNGQTRLKCHYCEKTYSRDSVAEA

SEQ ID NO: 6324 - protein, 221 aa, Neisseria meningitidis; identical to SEQ ID NO: 2020

SEQ ID NO: 6325 - protein, 443 aa, Neisseria meningitidis
MLKCGTFFITRHIPRGCRRFFQPNQARQTEIYQIRGTVMQRRIITLLCAAGMAFSTQTLAANLEVRPNAPERYTVKQGDTLWGISGKYLYSPWQWGRLWDANRDQIHNPDLIYPDQVLVLRHVDGEPRLGLEQTDGIPVVKMSPDKEVSGYGIPAIDVNFYRIFMRHPQIVSRKETAAAPRLLSGPEGRLLYTKGTRVYTKGLKEPGRYLTYRINKNITDPDTGKFLGQEVAFSGIVRSLDYTDSVLEQRSKQAGERPKDNEYHTRTHPLITPLRTPSIQPLVVETAISEIQQGDYLMKMPEDTDRFNMMPHEPSRPVQAKIVSVFEGTRIAGQFQTITIDKGEADGLDKGTVLSLYKRKKTMQVDLSNNFKSRDTVELISTPAEEVGLAMVYRTSEHLSSAIILENISDISVGDTAANPGRDLDNIPDQGRSRVKFGFNRSE

SEQ ID NO: 6326 - protein, 167 aa, Neisseria meningitidis
MALLNILQYPDERLHTVAKPVEQVDERIRKLIADMFETMYESRGIGLAATQVDVHERVVVMDLTEDRSEPRVFINPVIVEKDGETTYEEGCLSVPGIYDTVTRAERVKVEALNEKGEKFTLEADGLLAICVQHELDHLMGIVFVERLSQLKQGRIKTKLKKRQKHTI

SEQ ID NO: 6327 - protein, 308 aa, Neisseria meningitidis
MKVIFAGTPDFAAAALRAVAAAGFEIPLVLTQPDRPKGRGMQLTAPPVKQAALELGLRVEQPEKLRNNAEALQMLKEVEADVMVVAAYGLILPQEVLDTPKHGCLNIHASLLPRWRGAAPIQRAIEAGDAETGVCIMQMDIGLDTGDVVSEHRYAIQPTDTANEVHDALMEIGAAAVVADLQQLQSKGRLNAVKQPEEGVTYAQKLSKEEARIDWSKSAAVIERKIRAFNPVPAAWVEYQGKPMKIRRAEVVAQQGAAGEVLSCSADGLVVACGENALKITELQPAGGRRMNIAAFAAGRHIEAGAKL

SEQ ID NO: 6328 - protein, 419 aa, Neisseria meningitidis
MSMALAQKLAADSIAAVAEGRNLQDVLAQIRTAHPDLMAQENGALQDIAYGCQRYLGSLKHMLAQMLKKPIGNPQLESLLLAALYQLHYTRNAPHAVVNEAVESIAKIGRGQYRSFANAVLRRFLRERDKLVASCKKDDVAKHNLPLWWVAYLKNHYPKHWHNIAAALQSHPPMTLRVNRRHGNAESYLEKLVAEGIAAKALDEYAVTLEEAVPVNRLPGFSDGIVSVQDFGAQQAAYLLNPKDGERILDACAAPGGKTGHILELADCRVTALDIDAGRLKRVEDNIARLGFQTASTACADAQDLSAWYDGKPFDAVLADVPCTASGVARRNPDVKWLRRPTDALKTARQQEALLDALWQVLKSGGRMLIATCSVFVEENDGQLQKFLNRHADAELIESRVLLPNKHQDGFYYALIQKQ

SEQ ID NO: 6329 - protein, 180 aa, Neisseria meningitidis
MLPAFQNVAAEGIDVSRAEARITDGGQLSISSRFQTELPDQLQQALRRGVPLNFTLSWQLSAPIIASYRFKLGQLIGDDDNIDYKLSFHPLTNRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 6330 - protein, 706 aa, Neisseria meningitidis; identical to SEQ ID NO: 252

SEQ ID NO: 6331 - protein, 425 aa, Neisseria meningitidis
MRSSDILIVDDEIGIRDLLSEILQDEGYSVALAENAEEARKLRHQARPAMVLLDIWMPDCDGITLLKEWAKNGQLNMPVVMMSGHASIDTAVEATKIGAIDFLEKPISLQKLLSAVENALKYGAAQTETGPVFDKLGNSAAIQEMNREVGAAVKCASPVLLTGEAGSPFETVARYFHKNGTPWVSPARVEYLIDMPMELLQKAEGGVLYVGDIAQYSRNIQAGIAFIVGKAEHRRVRVVASGSRAAGSDGIACEEKLAELLSESVVRIPPLRMQHEDIPFLIQGIACNVAESQKIAPASFSEEALAALTRYDWPGNFDQLQSVVATLLLEADGQEIGAGAVSSLLGQNVPAEGAEDMVGGFNFNLPLRELREEVERRYFEYHIAQEGQNMSQVAQKVGLERTHLYRKLKQLGIGVSRRAGEKTEE

SEQ ID NO: 6332 - protein, 397 aa, Neisseria meningitidis
MTEDERFAWLQLAFTPYIGAESFLLLMRRFGSAQNALSAPAEQVAALIRHKQALEAWRNAEKRALARQAAEAALEWEMRDGCRLMLLQDEDFPEMLTQGLTAPPVLFLRGNVQLLHKPSAAIVGSRHATPQAMRIAKDFGKSLGGKGIPVVSGMASGIDTAAHQGALQAEGGTIAVWGTGIDRIYPPVNKNLAYEIAEKGLIVSEFPIGTRPYAGNFPRRNRLIAALSQVTLVVEAALESGSLITARLAAEMGREVMAVPGSIDNPHSKGCHKLIKDGAKLVECLDDILNECPGLLQNTGASSYSINKGIPEKRITAVQTASDQLSLPEGKMPSEKTENRPVGGSILDRMGFDPVHPDVLAGQLAMPAADLYAALLELELDGSVAAMPGGRYQRIRT

SEQ ID NO: 6333 - protein, 153 aa, Neisseria meningitidis
MTEVIAYLIEHFQDFDTCPPPEDLGMLLEEAGFDTMEIGNTLMMMEVLLNSSEFSAEPADSGALRVYSKEETDNLPQEVMGLMQYLIEEKAVSCEQREIIIHALMHIPGDEITVDTAKVLTLLLLWANKSELPVLVGDELMSALLLDNKPTMN

SEQ ID NO: 6334 - protein, 768 aa, Neisseria meningitidis
MAKNLLIVESPSKAKTLKKYLGGDFEILASYGHVRDLVPKSGAVDPDNGFAMKYQLISRNGKHVDAIVAGAKEAENIYLATDPDREGEAISWHLLEILKSKRGLKNIKPQRVVFHEITKNAVLDAVAHPREIEMDLVDAQQARRALDYLVGFNLSPLLWKKIRRGLSAGRVQSPALRLICERENEIRAFEAQEYWTVHLDSHKGRSKFTAKLAQYNGAKLEQFDLPNEAAQADVLKELEGKEAVVTAIEKKKRSRNPAAPFTTSTMQQDAVRKLGFTTDRTMRTAQQLYEGIDVGQGAIGLITYMRTDSVNLADEALTEIRHYIENKIGKEYLPSAAKQYKTKSKNAQEAHEAIRPTSVYRTPESVKPFLSADQFKLYQMIWQRTVACQMTPAKFDQTTVDITVGKGVFRVTGQVQTFAGFLSVYEESSDDEEGEDSKKLPEMSEGDKLPVDKLYGEQHFTTPPPRYNEATLVKALEEYGIGRPSTYASIISTLKDREYVTLEQKRFMPTDTGDIVNKFLTEHFAQYVDYHFTAKLEDQLDEIADGKRQWIPLMDKFWKPFIKQVEEKEGIERAKFTTQELDETCPKCGEHKLQIKFGKMGRFVACAGYPECSYTRNVNETAEEAAERIAKAEAEQAELDGRECPKCGGRLVYKYSRTGSKFIGCVNYPKCKHVEPLEKPKDTGVQCPQCKKGNLVERKSRYGKLFYSCSTYPDCNYATWNPPVAEECLNCHWPVLTIKTTKRWGVEKVCPQKECGWKEQIEPPAPKE

SEQ ID NO: 6335 - protein, 231 aa, Neisseria meningitidis
MMKDLNLSNSLFKGYNDKHGLMICGYEWGWSKADEAAYVAGEYKLPENKIDHTFANKSLYFGEQAKKWRYDNTIKNWFEMWGHPLDENGLGGAFEKSLVQTNWAATQGNTIDNPDKFTQPEHIDNFLYHIEKLRPKVILFMGSRLADFLNNQNVLPRFEQLVGKQTKPLETVQKEFDGTRFNVKFQSFEDCEVVCFPHPSASRGLSYDYIALFAPEMNRILSDFKTTRGFK

SEQ ID NO: 6336 - protein, 183 aa, Neisseria meningitidis
MEFLSLHPWWSFFIILTIILSYIGFCAHLHIQNRAVFFYSYRDVTIIFLTPVILIALSYLIKNKEILSACILCITLIAFSWAWIITYRSNTKRFFLSLLIVWGKLLLSTIVWAILAISLGLAVITGNSKRKKYERRDRHAERNEKAFIGALLVGFELSRNLLNLCCLHKDFSTPSKNIEVNRS

SEQ ID NO: 6337 - protein, 125 aa, Neisseria meningitidis; identical to SEQ ID NO: 3368

SEQ ID NO: 6338 - protein, 189 aa, Neisseria meningitidis
MAAGKHTKHSNRVRIIGGQCRGRKLSFTSADGLRPTPDSVREKLFNWLGQDLTGKTVLDLFGGSGALGIEAASRNAKRVLISDNNRQTVQTLQKNSRELGLGQVQIVFSDGIAYLKTVSEQFDVVFLDPPFAWQDWQILFDALKPCLNPRAFVYLEAGTLPNIPDWLTEYREGKSGQSTFELRVFQVAE

SEQ ID NO: 6339 - protein, 83 aa, Neisseria meningitidis
MSLFITDECINCDVCEPECPNDAISQGEEIYEINPNLCTQCVGHYDEPQCQQVCPVDCILIDEEHPETHDELMAKYEKIIQFK

SEQ ID NO: 6340 - protein, 394 aa, Neisseria meningitidis
MAKEKFERSKPHVNVGTIGHVDHGKTTLTAALTTILAKKFGGAAKAYDQIDNAPEEKARGITINTSHVEYETETRHYAHVDCPGHADYVKNMITGAAQMDGAILVCSAADGPMPQTREHILLARQVGVPYIIVFMNKCDMVDDAELLELVEMEIRDLLSSYDFPGDDCPIVQGSALKALEGDAAYEEKIFELAAALDSYIPTPERAVDKPFLLPIEDVFSISGRGTVVTGRVERGIIHVGDEIEIVGLKETQKTTCTGVEMFRKLLDEGQAGDNVGVLLRGTKREDVERGQVLAKPGTITPHTKFKAEVYVLSKEEGGRHTPFFANYRPQFYFRTTDVTGAVTLEEGVEMVMPGENVTITVELIAPIAMEEGLRFAIREGGRTVGAGVVSSVIA

SEQ ID NO: 6341 - protein, 92 aa, Neisseria meningitidis
MTEHTPEKKNVKVDQLVVQDKESASNSGKEGFFAYFSNSWSEFKKVVWPKREDAVRMTVFVIVFVAVLSIFIYAADTAISWLFFDVLLRREG

SEQ ID NO: 6342 - protein, 178 aa, Neisseria meningitidis
MSKKWYVVQAYSGFEKNVQRILEERIAREEMGDYFGQILVPVEKVVDIRNGRKTISERKSYPGYVLVEMEMTDDSWHLVKSTPRVSGFIGGRANRPTPISQREAEIILQQVQTGIEKPKPKVEFEVGQQVRVNEGPFADFNGVVEEVNYERNKLRVSVQIFGRETPVELEFSQVEKIN

SEQ ID NO: 6343 - protein, 144 aa, Neisseria meningitidis
MAKKIIGYIKLQIPAGKANPSPPVGPALGQRGLNIMEFCKAFNAATQGMEPGLPIPVVITAFADKSFTFVMKTPPASILLKKAAGLQKGSSNPLTNKVGKLTRAQLEEIAKTKDPDLTAADLDAAVRTIAGSARSMGLDVEGVV

SEQ ID NO: 6344 - protein, 231 aa, Neisseria meningitidis
MAKVSKRLKALRSSVEANKLYAIDEAIALVKKAATAKFDESVDVSFNLGVDPRKSDQVIRGSVVLPKGTGKITRVAVFTQGANAEAAKEAGADIVGFEDLAAEIKAGNLNFDVVIASPDAMRIVGQLGTILGPRGLMPNPKVGTVTPNVAEAVKNAKAGQVQYRTDKAGIVHATIGRASFAEADLKENFDALLDAIVKAKPAAAKGQYLKKVAVSSTMGLGIRVDTSSVNN

SEQ ID NO: 6345 - protein, 47 aa, Neisseria meningitidis
MSKTVGIVRFNRNCPTQTVVLKHIARLLVRCLFRLPRWWDIVLVSCL

SEQ ID NO: 6346 - protein, 166 aa, Neisseria meningitidis
MSLNIETKKVAVEEISAAIANAQTLVVAEYRGISVSSMTELRANARKEGVYLRVLKNTLARRAVQGTSFAELADQMVGPLVYAASEDAVAAAKVLHQFAKKDDKIVVKAGSYNGEVMNAAQVAELASIPSREELLSKLLFVMQAPVSGFARGLAALAEKKAGEEAA

SEQ ID NO: 6347 - protein, 123 aa, Neisseria meningitidis
MAITKEDILEAVGSLTVMELNDLVKAFEEKFGVSAAAVAVAGPAGAGAADAEEKTEFDVVLASAGDQKVGVIKVVRAITGLGLKEAKDIVDGAPKTIKEGVSKAEAEDIQKQLEEAGAKVEIK

SEQ ID NO: 6348 - protein, 1394 aa, Neisseria meningitidis
MCMNYSFTEKKRIRKSFAKRENVLEVPFLLATQIDSYAKFLQLENAFDKRTDDGLQAAFNSIFPIVSHNGYARLEFVHYTLGEPLFDIPECQLRGITYAAPLRARIRLVILDKEASKPTVKEVRENEVYMGEIPLMTPSGSFVINGTERVIVSQLHRSPGVFFEHDKGKTHSSGKLLFSARIIPYRGSWLDFEFDPKDLLYFRIDRRRKMPVTILLKALGYNNEQILDIFYDKETFYLSSNGVQTDLVADRLKGETAKVDILDKEGNVLVAKGKRITAKNIRDITNAGLTRLDVEPESLLGKALAADLIDSETGEVLASANDEITEELLAKFDINGVKEITTLYINELDQGAYISNTLRTDETAGRQAARVAIYRMMRPGEPPTEEAVEQLFNRLFFSEDSYDLSRVGRMKFNTRTYEQKLSEAQQNSWYGRLLNETFAGAADKGGYVLSVEDIVASIATLVELRNGHGEVDDIDHLGNRRVRSVGELTENQFRSGLARVERAVKERLNQAESENLMPHDLINAKPVSAAIKEFFGSSQLSQFMDQTNPLSEVTHKRRVSALGPGGLTRERAGFEVRDVHPTHYGRVCPIETPEGPNIGLINSLSVYARTNDYGFLETPYRRVIDGKVTEEIDYLSAIEEGRYVIAQANADLDSDGNLIGDLVTCREKGETIMATPDRVQYMDVATGQVVSVAASLIPFLEHDDANRALMGANMQRQAVPCLRPEKPMVGTGIERSVAVDSATAIVARRGGVVEYVDANRVVIRVHDDEATAGEVGVDIYNLVKFTRSNQSTNINQRPAVKAGDVLQRGDLVADGASTDFGELALGQNMTIAFMPWNGYNYEDSILISEKVAADDRYTSIHIEELNVVARDTKLGAEDITRDIPNLSERMQNRLDESGIVYIGAEVEAGDVLVGKVTPKGETQLTPEEKLLRAIFGEKASDVKDTSLRMPTGMSGTVIDVQVFTREGIQRDKRAQSIIDSELKRYRLDLNDQLRIFDNDAFDRIERMIVGQKANGGPMKLAKGSEITTEYLAGLPSRHDWFDIRLTDEDLAKQLELIKVSLQQKREEADELYEIKKKKLTQGDELQPGVQKMVKVFIAIKRRLQAGDKMAGRHGNKGVVSRILPVEDMPYMADGRPVDIVLNPLGVPSRMNIGQILEVHLGWAAKGIGERIDRMLKEQRKAGELREFLNRLYNGSGKKEDLDALTDEEIIELASNLRKGASFASPVFDGAKESEIREMLNLAYPSDDPEVEKLGFNDSKTQITLYDGRSGEAFDRKVTVGVMHYLKLHHLVDEKMHARSTGPYSLVTQQPLGGKAQFGGQRFGEMEVWALEAYGAAYTLQEMLTVKSDDVNGRTKMYENIVKGEHKIDAGMPESFNVLVKEIRSLGLDIDLERY

SEQ ID NO: 6349 - protein, 1391 aa, Neisseria meningitidis
MNLLNLFNPLQTAGMEEEFDAIKIGIASPETIRSWSYGEVKKPETINYRTFKPERDGLFCAKIFGPVKDYECLCGKYKRLKFKGVTCEKCGVEVTLSKVRRERMGHIELAAPVAHIWFLKSLPSRLGMVLDMTLRDIERVLYFEAFVVTDPGMTPLQRRQLLTEDDYYNKLDEYGDDFDAKMGAEGIRELLRTLNVAGEIEILRQELESTGSDTKIKKIAKRLKVLEAFHRSGMKLEWMIMDVLPVLPPDLRPLVPLDGGRFATSDLNDLYRRVINRNNRLKRLLELHAPDIIVRNEKRMLQEAVDSLLDNGRRGKAMTGANKRPLKSLADMIKGKGGRFRQNLLGKRVDYSGRSVITVGPYLRLHQCGLPKKMALELFKPFIFHKLEKQGLASTVKAAKKLVEQEVPEVWDILEEVIREHPIMLNRAPTLHRLGIQAFEPILIEGKAIQLHPLVCAAFNADFDGDQMAVHVPLSLEAQMEARTLMLASNNVLSPANGEPIIVPSQDIVLGLYYMTRDRINAKGEGSLFADVKEVHRAYHTKQVELGTKITVRLREWVKNEAGEFEPVVNRYETTVGRALLSEILPKGLPFEYVNKALKKKEISKLINASFRLCGLRDTVIFADHLMYTGFGFAAKGGISIAVDDMEIPKEKAALLAEANAEVKEIEDQYRQGLVTNGERYNKVVDIWGRAGDKIAKAMMDNLSKQKVIDRAGNEVDQESFNSIYMMADSGARGSAAQIKQLSGMRGLMAKPDGSIIETPITSNFREGLTVLQYFIATHGARKGLADTALKTANSGYLTRRLVDVTQDLVVVEDDCGTSDGFVMKAVVQGGDVIEALRDRILGRVTASDVVDPSSGETLVEAGTLLTEKLVDMIDQSGVDEVKVRTPITCKTRHGLCAHCYGRDLARGKLVNAGEAVGVIAAQSIGEPGTQLTMRTFHIGGAASRAAAASQVEAKSNGTARFSSQMRYVANNKGELVVIGRSCEVVIHDDIGRERERHKVPYGAILLVQDGMAIKAGQTLATWDPHTRPMITEHAGMVKFENVEEGVTVAKQTDDVTGLSTLVVIDGKRRSSSASKLLRPTVKLLDENGVEICIPGTSTPVSMAFPVGAVITVREGQEIGKGDVLARIPQASSKTRDITGGLPRVAELFEARVPKDAGMLAEITGTVSFGKETKGKQRLIVTDVDGVAYETLISKEKQILVHDGQVVNRGETIVDGAVDPHDILRLQGIEALARYIVQEVQEVYRLQGVKISDKHIEVIIRQMLRRVNIADAGETGFITGEQVERGDVMAANEKALEEGKEPARYENVLLGITKASLSTDSFISAASFQETTRVLTEAAIMGKQDELRGLKENVIVGRLIPAGTGLTYHRSRHQQWQEVEQETAETQVTDE

SEQ ID NO: 6350 - protein, 85 aa, Neisseria meningitidis
MKPRNLFFAGCLLTSATFAEDIGVPVELINVGNRIAMPSEGESLALLPFAEDVPPVRDAMPSEVPKSAAGGDVRGDRMRMPINIG

SEQ ID NO: 6351 - protein, 49 aa, Neisseria meningitidis
MSAALWHKKLSWKGFTPQINFRYNKINSNMPAFYSRSGKERFVSIEKTY

SEQ ID NO: 6352 - protein, 123 aa, Neisseria meningitidis
MPTINQLVRKGRQKPVYVNKVPALEACPQKRGVCTRVYTTTPKKPNSALRKVCKVRLTNGFEVISYIGGEGHNLQEHSVVLIRGGRVKDLPGVRYHTVRGSLDTAGVKDRKQARSKYGAKRPK

SEQ ID NO: 6353 - protein, 156 aa, Neisseria meningitidis
MPRRREVPKRDVLPDPKFGSVELTKFMNVLMIDGKKSVAERIVYGALEQIEKKTGKVAIEVFNEAIANAKPIVEVKSRRVGGANYQVPVEVRPSRRLALAMRWVRDAARKRGEKSMDLRLAGELIDASEGRGGALKKREEVHRMAEANKAFSHFRF

SEQ ID NO: 6354 - protein, 701 aa, Neisseria meningitidis
MARKTPISLYRNIGISAHIDAGKTTTTERILFYTGLTHKLGEVHDGAATTDYMEQEQERGITITSAAVTSYWSGMAKQFPEHRFNIIDTPGHVDFTVEVERSMRVLDGAVMVYCAVGGVQPQSETVWRQANKYQVPRLAFVNKMDRQGANFFRVVEQMKTRLRANPVPIVIPVGAEDNFSGVVDLLKMKSIIWNEVDKGTTFTYGDIPAELVETAEEWRQNMIEAAAEASEELMDKYLGGDELTEEEIVGALRQRTLAGEIQPMLCGSAFKNKGVQRMLDAVVELLPAPTDIPPVQGVNPNTEEADSRQASDEEKFSALAFKMLNDKYVGQLTFIRVYSGVVKSGDTVLNSVKGTRERIGRLVQMTAADRTEIEEVRAGDIAAAIGLKDVTTGETLCAESAPIILERMEFPEPVIHIAVEPKTKADQEKMGIALNRLAKEDPSFRVRTDEESGQTIISGMGELHLEIIVDRMKREFGVEANIGAPQVAYRETIRKAVKAEYKHAKQSGGKGQYGHVVIEMEPMEPGGEGYEFIDEIKGGVIPREFIPSVDKGIRDTLPNGIVAGYPVVDVRIRLVFGSYHDVDSSQLAFELAASQAFKEGMRQASPALLEPIMAVEVETPEEYMGDVMGDLNRRRGVVLGMDDDGIGGKKVRAEVPLAEMFGYSTDLRSATQGRATYSMEFKKYSEAPAHIAAAVTEARKG

SEQ ID NO: 6355 - protein, 394 aa, Neisseria meningitidis
MAKEKFERSKPHVNVGTIGHVDHGKTTLTAALTTILSKKFGGAAKAYDQIDNAPEEKARGITINTSHVEYETETRHYAHVDCPGHADYVKNMITGAAQMDGAILVCSAADGPMPQTREHILLARQVGVPYIIVFMNKCDMVDDAELLELVEMEIRDLLSSYDFPGDDCPIVQGSALKALEGDAAYEEKIFELAAALDSYIPTPERAVDKPFLLPIEDVFSISGRGTVVTGRVERGIIHVGDEIEIVGLKETQKTTCTGVEMFRKLLDEGQAGDNVGVLLRGTKREDVERGQVLAKPGTITPHTKFKAEVYVLSKEEGGRHTPFFANYRPQFYFRTTDVTGAVTLEEGVEMVMPGENVTITVELIAPIAMEEGLRFAIREGGRTVGAGVVSSVIA

SEQ ID NO: 6356 - protein, 103 aa, Neisseria meningitidis
MANQKIRIRLKAYDYALIDRSAQEIVETAKRTGAVVKGPIPLPTKIERFNILRSPHVNKTSREQLEIRTHLRLMDIVDWTDKTTDALMKLDLPAGVDVEIKVQ

SEQ ID NO: 6357 - protein, 121 aa, Neisseria meningitidis
MIAKHIDRFPLLKLDRVIDWQPIEQYLNRQRTRYLRDHRGRPAYPLLSMFKAVLLGQWHSLSDPELEHSLITRIDFNLFCRFDELSIPDYSHQPYSGLSEKDAYAVMTGYRPVKRVRPYAV

SEQ ID NO: 6358 - protein, 214 aa, Neisseria meningitidis
MTLGLVGRKVGMTRVFDEQGVSVPVTVLDMSANRVTQVKSKDTDGYTAVQVTFGQKKANRVNKAEAGHFAKAGVEAGRGLIEFALTEEKLAELKAGDEITVSMFEVGQLVDVTGTSKGKGFSGTIKRHNFGAQRTSHGNSRSHRVPGSIGMAQDPGRVFPGKRMAGQYGNTKATVQKLEVVRVDAERQLLLVKGAVPGAVNSDVVVRPSVKVGA

SEQ ID NO: 6359 - protein, 206 aa, Neisseria meningitidis
MELKVIDAKGQVSGSLSVSDALFAREYNEALVHQLVNAYLANARSGNRAQKTRAEVKHSTKKPWRQKGTGRARSGMTSSPLWRKGGRAFPNKPDENFTQKVNRKMYRAGMATILSQLTRDERLFAIEALTAETPKTKVFAEQVKNLGLEQVLFVTKQLDENVYLASRNLPNVLVLEAQQVDPYSLLRYKKVIITKDAVAQLEEQWV

SEQ ID NO: 6360 - protein, 104 aa, Neisseria meningitidis
MNQQRLTQVILAPIVSEKSNVLAEKRNQMTFKVLANATKPEIKAAVELLFGVQVADVTTVTIKGKVKRFGRTLGRRSDVKKAYVSLAAGQELDLEAAAAAADKE

SEQ ID NO: 6361 - protein, 277 aa, Neisseria meningitidis
MAIVKMKPTSAGRRGMVRVVTEGLYKGAPYAPLLEKKNSTAGRNNNGHITTRHKGGGHKHHYRVVDFKRNKDGIPAKVERIEYDPNRTAFIALLCYADGERRYIIAPRGIQAGAVLVSGAEAAIKVGNTLPIRNIPVGTTIHCIEMKPGKGAQIARSAGASAVLLAKEGAYAQVRLRSGEVRKINVDCRATIGEVGNEEQSLKKIGKAGANRWRGIRPTVRGVVMNPVDHPHGGGEGRTGEAREPVSPWGTPAKGYRTRNNKRTDNMIVRRRYSNKG

SEQ ID NO: 6362 - protein, 92 aa, Neisseria meningitidis
MARSLKKGPYVDLHLLKKVDAARASNDKRPIKTWSRRSTILPDFIGLTIAVHNGRTHVPVFISDNMVGHKLGEFSLTRTFKGHLADKKAKKK

SEQ ID NO: 6363 - protein, 109 aa, Neisseria meningitidis
MRVNAQHKNARISAQKARLVADLIRGKDVAQALNILAFSPKKGAELIKKVLESAIANAEHNNGADIDELKVVTIFVDKGPSLKRFQARAKGRGNRIEKQTCHINVTVGN

SEQ ID NO: 6364 - protein, 230 aa, Neisseria meningitidis
MGQKINPTGFRLAVTKDWASKWFAKSTDFSTVLKQDIDVRNYLRQKLANASVGRVVIERPAKSARITIHSARPGVVIGKKGEDIEVLKRDLQVLMGVPVHVNIEEIRRPELDAQIIADGIAQQLEKRVQFRRAMKRAMQNAMRSGAKGIKIMTSGRLNGADIARSEWYREGRVPLHTLRANVDYATSEAHTTYGVLGLKVWVYTEGNIKSSKPEHESKQRKAGRRNAAAN

SEQ ID NO: 6365 - protein, 138 aa, Neisseria meningitidis
MLQPTRLKYRKQQKGRNTGIATRGNKVSFGEFGLKAVGRGRLTARQIEAARRAMTRHIKRGGRIWIRVFPDKPITEKPIQVRMGGGKGNVEYYIAEIKPGKVLYEMDGVPEELAREAFELAAAKLPIPTTFVVRQVGQ

SEQ ID NO: 6366 - protein, 63 aa, Neisseria meningitidis
MKANELKDKSVEQLNADLLDLLKAQFGLRMQNATGQLGKPSELKRVRRDIARIKTVLTEKGAK

SEQ ID NO: 6367 - protein, 87 aa, Neisseria meningitidis
MSETKNVRTLQGKVVSDKMDKTVTVLVERKVKHPLYGKIIRLSTKIHAHDENNQYGIGDVVVISESRPLSKTKSWVVSELVEKARSI

SEQ ID NO: 6368 - protein, 122 aa, Neisseria meningitidis
MIQMQTILDVADNSGARRVMCIKVLGGSKRRYASVGDIIKVAVKDAAPRGRVKKGDVYNAVVVRTAKGVRRPDGALIKFDNNAAVLLNNKLEPLGTRIFGPVTRELRTERFMKIVSLAPEVL

SEQ ID NO: 6369 - protein, 107 aa, Neisseria meningitidis
MNKIIKGDRVVVIAGKDKGKQGQVVRVLGDKVVVEGVNVVKRHQKPNPMRGIEGGIITKEMPLDISNIAILNPETNKADRVGIKLIENEGKVKRVRFFKSNGSIIGA

SEQ ID NO: 6370 - protein, 179 aa, Neisseria meningitidis
MARLREFYKETVVPELVKQFGYKSVMEVPRIEKITLNMGVGEAVADKKVMEHAVSDLEKIAGQKPVVTVARKSIAGFKIRDNYPVGCKVTLRRDQMFEFLDRLITIALPRVRDFRGVSGKSFDGRGNYNMGVREQIIFPEIEYDKIDALRGLNITITTTAKTDEEAKALLSLFKFPFKG

SEQ ID NO: 6371 - protein, 101 aa, Neisseria meningitidis
MAKKALINRDLKRQALAKKYAAKRAAIKAVINDSNATEEERFEARLRFQSIPRNAAPVRQRRRCALTGRPRGTFRKFGLGRIKIREIAMRGEIPGVVKASW

SEQ ID NO: 6372 - protein, 130 aa, Neisseria meningitidis
MSMHDPISDMLTRIRNAQRANKAAVAMPSSKLKCAIAKVLKEEGYIEDFAVSSDVKSILEIQLKYYAGRPVIEQIKRVSRPGLRIYKASSEIPSVMNGLGIAIVSTSKGVMTDRKARSQGVGGELLCIVA

SEQ ID NO: 6373 - protein, 177 aa, Neisseria meningitidis
MSRVAKNPVTVPAGVEVKFGAEALVIKGKNGELSFPLHSDVAIEFNDGKLTFVANNSSKQANAMSGTARALVSNMVKGVSEGFEKRLQLIGVGYRAQAQGKILNLSLGFSHPIVYEMPEGVSVQTPSQTEIVLTGSDKQVVGQVAAEIRAFRAPEPYKGKGVRYVGEVVVMKEAKKK

SEQ ID NO: 6374 - protein, 117 aa, Neisseria meningitidis
MDKHTTRLRRARKTRARIADLKMVRLCVFRSNNHIYAQVISAEGDKVLAQASTLEAEVRGSLKSGSNVEAAAIVGKRIAEKAKAAGVEKVAFDRSGFQYHGRVKALAEAARENGLSF

SEQ ID NO: 6375 - protein, 172 aa, Neisseria meningitidis
MAKHEIEERGDGLIEKMVAVNRVTKVVKGGRIMAFSALTVVGDGDGRIGMGKGKSKEVPVAVQKAMDQARRSMIKVPLKNGTIHHEVIGRHGATKVFMQPAKEGSGVKAGGPMRLVFDAMGIHNISAKVHGSTNPYNIVRATLDGLSKLHTPADIAAKRGLTVEDILGVNHG

SEQ ID NO: 6376 - protein, 61 aa, Neisseria meningitidis
MAEQKKIRVTLVKSLIGTIESHRACARGLGLRRREHTVEVLDTPENRGMINKISYLLKVES

SEQ ID NO: 6377 - protein, 144 aa, Neisseria meningitidis
MFLNTIQPAVGATHAGRRVGRGIGSGLGKTGGRGHKGQKSRSGGFHKVGFEGGQMPLQRRLPKRGFKSLTASANAQLRLSELESIAVNEIDILVLKQAGLIASTVSNVKVIASGEISKAVALKGIKVTKGARAAIEAVGGKIEM

SEQ ID NO: 6378 - protein, 436 aa, Neisseria meningitidis
MANQQTSSGSSKFGDLKKRLLFLFGALIVFRIGAHIPVPGVDAVALAKLYESAGNGILGILNMFSGGSLERFSIFAIGIMPYISASIIVQLASEILPSLKALKKEGEAGRKVITKYTRYGTVLLAILQSLGVASFVFQQGIVVTSSFEFHVSTVVSLVTGTMFLMWLGEQITERGIGNGISLIITAGIASGIPSGIAKLVTLTNQGSMSMLTALFIVFGALLLIYLVVYFESAQRKIPIHYAKRQFNGRAGSQNTHMPFKLNMAGVIPPIFASSIILFPSTLLGWFGSADTNSVLHKIAGLLQHGQLLYMALFAATVIFFCYFYTALVFSPKEMAENLKKSGAFVPGIRPGEQTSRYLEKVVLRLTLFGALYITTICLIPEFLTTVLNVPFYLGGTSLLILVVVTMDFSTQINSYRLTQQYDKLMTRSEMKSFSRK

SEQ ID NO: 6379 - protein, 72 aa, Neisseria meningitidis
MAKEDTIQMQGEILETLPNATFKVKLENDHIVLGHISGKMRMHYIRISPGDKVTVELTPYDLTRARIVFRAR

SEQ ID NO: 6380 - protein, 37 aa, Neisseria meningitidis
MRVQPSVKKICRNCKIIRRNRVVRVICTDLRHKQRQG

SEQ ID NO: 6381 - protein, 120 aa, Neisseria meningitidis
MARIAGVNIPNNAHIVIGLQAIYGIGATRAKLICEAANIAPDTKAKDLDETQLDALRDQVAKYEVEGDLRREVTMSIKRLMDMGCYRGFRHRRGLPCRGQRTRTNARTRKGPRKAIAGKK

SEQ ID NO: 6382 - protein, 131 aa, Neisseria meningitidis
MAKANTASRVRKKVRKTVSEGIVHVHASFNNTIITITDRQGNALSWATSGGAGFKGSRKSTPFAAQVAAEAAGKVAQEYGVKNLEVRIKGPGPGRESSVRALNALGFKITSITDVTPLPHNGCRPPKKRRI

SEQ ID NO: 6383 - protein, 206 aa, Neisseria meningitidis
MARYIGPKCKLARREGTDLFLKSARRSLDSKCKIDSAPGQHGAKKPRLSDYGLQLREKQKIRRIYGVLERQFRRYFAEADRRKGSTGELLLQLLESRLDNVVYRMGFGSTRAEARQLVSHKAIVVNGQVVNIPSFQVKAGDVVSVREKAKKQVRIQEALGLATQIGLPGWVSVDADKLEGVFKNMPDRSELTGDINEQLVVEFYSK

SEQ ID NO: 6384 - protein, 328 aa, Neisseria meningitidis
MQNSTTEFLKPRQIDVNTFSATRAKVSMQPFERGFGHTLGNALRRILLSSMNGFAPTEVAIAGVLHEYSTVDGIQEDVVDILLNIKGIVFKLHGRSQVQLVLKKSGSGVVSAGDIELPHDVEILNPGHVICHLADNGQIEMEIKVEQGRGYQSVSGRQVVRDENRQIGAIQLDASFSPISRVSFEVEPARVEQRTDLDKLVLDIETDGSIDPEEAVRSAARILIDQMSIFADLQGTPVEEVEEKAPPIDPVLLRPVDDLELTVRSANCLKAEDIYYIGDLIQRTETELLKTPNLGRKSLNEIKEVLASKGLTLGSKLEAWPPVGLEKP

SEQ ID NO: 6385 - protein, 122 aa, Neisseria meningitidis
MRHRNGNRKLNRTSSHRAAMLRNMANSLLTHEAIVTTLPKAKELRRVVEPLITLGKKPSLANRRLAFDRTRDRDVVVKLFGDLGPRFTARNGGYVRVLKYGFRKGDNAPLALVELVDKPAAE

SEQ ID NO: 6386 - protein, 237 aa, Neisseria meningitidis
MMVYIMNAFDIKSTKMDVLSISLHTSDLFDLEDVLVKLGKKFQESGVVPFVLDVQEFDYPESLDLAALVSLFSRHGMQILGLKHSNERWAAAAMKYHLLFCLSHSENVKELGQVEVQKTEDGQKARKTVLITSPVRTGQQVYAEDGDLIVTGAVSQGAELIADGNIHIYAPMRGRALAGAKGDTSARIFIHSMQAELVSVAGIYRNFEQDLPNHLHKQPVQILLQDNRLVISAIGSE

SEQ ID NO: 6387 - protein, 271 aa, Neisseria meningitidis
MAKIIVVTSGKGGVGKTTTSASIATGLALRGYKTAVIDFDVGLRNLDLIMGCERRVVYDLINVIQGEATLNQALIKDKNCENLFILPASQTRDKDALTREGVEKVMQELSGKKMGFEYIICDSPAGIEQGALMALYFADEAIVTTNPEVSSVRDSDRILGILQSKSHKAEQGGSVKEHLLITRYSPERVAKGEMLSVQDICDILHIPLLGVIPESQNVLQASNSGEPVIHQDSVAASEAYKDVIARLLGENREMRFLEAEKKSFFKRLFGG

SEQ ID NO: 6388 - protein, 87 aa, Neisseria meningitidis
MSLIEFLFGRKQKTATVARDRLQIIIAQERAQEGQAPDYLPTLRKELMEVLSKYVNVSLDNIRISQEKQDGMDVLELNITLPEQKKV

SEQ ID NO: 6389 - protein, 306 aa, Neisseria meningitidis
MTLTELRYIVAVAQERHFGRAARRCFVSQPTLSIAIKKLEEELAVSLFDRSSNDIITTEAGERIVAQARKVLEEAELIRHLANEEQNELEGAFKLGLIFTVAPYLLPKLIVSLRRTAPKMPLMLEENYTHTLTESLKRGDVDAIIVAEPFQEPGIVTEPLYDEPFFVIVPKGHSFEELDAVSPRMLGEEQVLLLTEGNCMRDQVLSSCSELAAKQRIQGLTNTLQGSSINTIRHMVASGLAISVLPATALTENDHMLFSIIPFEGTPPSRRVVLAYRRNFVRPKALSAMKAAIMQSQLHGVSFICD

SEQ ID NO: 6390 - protein, 945 aa, Neisseria meningitidis
MLDKYNPAEIESKHYQNWEEQGYFQPDMDLTKPSFSIQLPPPNVTGTLHMGHAFNQTIMDGLTRYYRMKGCNTAWIPGTDHAGIATQIVVERQLAAQNVSRHDLGREKFLEKVWEWKEVSGGTITQQMRRVGCSADWTREYFTMDDVRAETVTEVFVRLYEQGLIYRGKRLVNWDPVLGTAVSDLEVESVEEQGSMWHIRYPLADNPAEAVIVATTRPETLLGDVAVAVNPEDERYTHLIGKELILPLTGRTIPVIADEYVEKDFGTGCVKITPAHDFNDYEVGKRHDTRLINVFNLEAKVLANAEVFNFKGEAQLGFALPEKYAGLDRFAARKQMVADLQEQGFLVEIKPHTLMTPKGDRTGSVIEPMLTSQWFVAMSATPNGGEPDSEFKGLSLADKAKKAVDSGAVRFIPENWVNTYNQWMNNIQDWCISRQLWWGHQIPAWYDNEGNVYVARNQEEAEKQAGKTGLTREEDVLDTWFSSALVPFSTLGWPSETDELKAFLPSNVLVTGYEIIFFWVARMIMMTTHFTGKVPFKDVYIHGIVRDHEGKKMSKSEGNVIDPVDLIDGIGLEKLLVKRTTGLRKPETAPKVEEATKKLFPEGIPSMGADALRFTMASYASLGRSVNFDFKRAEGYRNFCNKIWNATNFVLMNTENQDCGYGATAAEPRGYSFPDMWIVGRLNQTIEQVTQAYETYRFDLAAETLYSFVWNDYCDWYLELAKVQLQTGCASRQRATRHTLLRVLEAALRLLHPIIPFITEELWQTVAPMCDAKTADSIMLARFPEADSGEIVQTAFEQMTVLQDLIGAVRNLRGEMGIQPNVKAPLFVESTDDLADYLKYLPMMTRLTEAQQVAALPESEDAPVAVCNGARLMLKVEIDKAAETARLSKEAEKLQKALDKLNAKLSKPGYTEKAPAHLVEKDKADLAELEDKMAKVQNQLAKLKD

SEQ ID NO: 6391 - protein, 269 aa, Neisseria meningitidis
MPDFSMSNLAVAFSITLAAGLFTVLGSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELLPAAKRYSDGHETVYGLTTGMAVIAVSLVLFHF

SEQ ID NO: 6392 - protein, 418 aa, Neisseria meningitidis
MKVLVLGAGVAGVSSAWYLAEAGHEVTVIDRAEGVAMETSFANAGQLSYGYTTPWAAPGIPTKALKWLFKSHPPLLFRPDGSLYQIEWLWQMLQNCTAAHYQTNKERMVRISEYSREMFRRFEAQTGMNFEGRKKGTLQIFRQTKEVEAAKQDIAVLERYGVPYRRLKPEECAEFEPALARVTAKIAGGLHLPADATGDCRLFTENLYKLCQEKGVRFHFNQNISRIDHNGLRIKTVETETGRFEADAVVCALGCFSRTVLAQLDLNLPIYPVKGYSLTLPVTNSDGAPVSTVLDESYKVAITRFDNRIRVGGMAELSGYEIKLPEKRRETLALVVNDLFPEGGDLSQASFWSGLRPMTPDSTPLIGRTRFDNLFLNTGHGTLGWTMSLGSAKLTADIVSGKDTEIRSDDLSLSRYQA

SEQ ID NO: 6393 - protein, 463 aa, Neisseria meningitidis
MQVFLDNPKAFFETVSGWVWGPLMLMLLVGTGILLTVLLKGLQFTMLGYALKQAFMPPKKHKSGEGHEGDISHFAALMTALSATIGTGNIAGVATAVVTGGPGAVFWMWMTAIFGMATKYGEGVLAVKYRVNNSKGEMSGGPMYYIEKGLGKNWKWMAVAFALFGTFASFGIGSSVQSNSVAQAVQTSFGIEPAYTGITLTVLTAVVVLGGIKGIAKAASFIVPAMAVFYVLGGLSIIAINSDALMPAVKLIFSDAFSAQAVAGGAIGTVIRYGVARGVFSNEAGMGSAPIAAAAAKTDHPVRQALVSMTGTFLDTIVVCSITGIVLVMGLLGAGGEFVKPEVSGAALTTVTFQKMLPGIGGWIVTIGLIFFAYSTILGWCYYGEKCAVYVFGEKFAGLYRVGYVSSVMLGTVLSLDLVWLASDTFNGLMALPNLIALLLMAKVIVNETRDFKQKITNGELPH

SEQ ID NO: 6394 - protein, 258 aa, Neisseria meningitidis
MTLIHPTAVIDPKAELDSGVKVGAYTVIGPNVQIGANTEIGPHAVINGHTSIGENNRIFQFASLGEIPQDKKYRDEPTKLIIGNGNTIREFTTFNLGTVTGIGETRIGDDNWIMAYCHLAHDCVIGNHTIFANNASLAGHVTIGDYVVLGGYTLVFQFCRIGDYAMTAFAAGVHKDVPPYFMASGYRAEPAGLNSEGMRRNGFTAEQISAVKDVYKTLYHRGIPFEEAKADILRRAETQAELAVFRDFFAQSARGIIR

SEQ ID NO: 6395 - protein, 149 aa, Neisseria meningitidis
MDVQLPIEAKDIQKLIPHRYPFLQLDRITAFEPMKTLTAIKNVTINEPQFQGHFPDLPVMPGVLIIEAMAQACGTLAILSEGGRKENEFFFFAGIDEARFKRQVIPGDQLVFEVELLTSRRGIGKFNAVAKVDGQVAVEAIIMCAKRVV

SEQ ID NO: 6396 - protein, 348 aa, Neisseria meningitidis
MIPATYTLSQITARLGGEWRGEDISVTAVRPLADAQAEHISFLANPKYKAEVHDSSAGAVIVSAKAADGFEGRNLIVADDPYLYFAKVARLFSPVVKARGGIHPTAVVEPGATVPTSCEIGANVYIGANTVLGEGCRILANAVVQHDCKLGDEVVLHPNAVVYYGCTLGRRVEIHSGAVIGADGFGLAFADDSWFKIPQTGAVTLGDDVEIGSNTNIDRGAMSDTTVGNGTKIDNQVQIGHNCKIGSHTVIAAKTGISGSVTIGSYCIIGGGVGTVGHIEIADKTTIGGGTSVTHSITESGKHLAGIFPMSTHKEWARNAVYIHRLSEMNKRLKTLEQQLSDAGQDSK

SEQ ID NO: 6397 - protein, 166 aa, Neisseria meningitidis; identical to SEQ ID NO: 2686

SEQ ID NO: 6398 - protein, 797 aa, Neisseria meningitidis
MKLKQIASALMMLGISPLALADFTIQDIRVEGLQRTEPSTVFNYLPVKVGDTYNDTHGSAIIKSLYATGFFDDVRVETADGQLLLTVIERPTIGSLNITGAKMLQNDAIKKNLESFGLAQSQYFNQATLNQAVAGLKEEYLGRGKLNIQITPKVTKLARNRVDIDITIDEGKSAKITDIEFEGNQVYSDRKLMRQMSLTEGGIWTWLTRSNQFNEQKFAQDMEKVTDFYQNNGYFDFRILDTDIQTNEDKTKQTIKITVHEGGRFRWGKVSIEGDTNEVPKAELEKLLTMKPGKWYERQQMTAVLGEIQNRMGSAGYAYSEISVQPLPNAETKTVDFVLHIEPGRKIYVNEIHITGNNKTRDEVVRRELRQMESAPYDTSKLQRSKERVELLGYFDNVQFDAVPLAGTPDKVDLNMSLTERSTGSLDLSAGWVQDTGLVMSAGVSQDNLFGTGKSAALRASRSKTTLNGSLSFTDPYFTADGVSLGYDVYGKAFDPRKASTSIKQYKTTTAGAGIRMSVPVTEYDRVNFGLVAEHLTVNTYNKAPKHYADFIKKYGKTDGTDGSFKGWLYKGTVGWGRNKTDSALWPTRGYLTGVNAEIALPGSKLQYYSATHNQTWFFPLSKTFTLMLGGEVGIAGGYGRTKEIPFFENFYGGGLGSVRGYESGTLGPKVYDEYGEKISYGGNKKANVSAELLFPMPGAKDARTVRLSLFADAGSVWDGKTYDDNSSSATGGRVQNIYGAGNTHKSTFTNELRYSAGGAVTWLSPLGPMKFSYAYPLKKKPEDEIQRFQFQLGTTF

SEQ ID NO: 6399 - protein, 446 aa, Neisseria meningitidis
MHTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTIAARAGFQSGDKIQSVNGTPVADWGSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLNYERAGQTHTADIRPDTVEQSDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTAEWIRGKPLGERVQNIGLRFGLALMMLMMAVAFFNDVTRLLG

SEQ ID NO: 6400 - protein, 394 aa, Neisseria meningitidis
MTPQVLTILGSTGSIGESTLDVVSRHPEKFRVFALAGHKQVEKLAAQCQTFHPEYAVVADAEHAARLEALLKRDGTATQVLHGAQALVDVASADEVSGVMCAIVGAVGLPSALAAAQKGKTIYLANKETLVVSGALFMETARANGAAVLPVDSEHNAVFQVLPRDYAGRLNEHGIASIILTASGGPFLTADLNTFDRITPAQAVKHPNWRMGRKISVDSATMMNKGLELIEAHWLFNCPPDKLEVVIHPQSVIHSMVRYRDGSVLAQLGNPDMRTPIAYCLGLPERIDSGVGDLDFDALSALTFQKPDFDRFPCLRLAYEAMNAGGAAPCVLNAANEAAVAAFLDGQIKFTDIAKTVAHCLAQDFSDGIGDIGGLLAQDARTRAQARAFIGTLR

SEQ ID NO: 6401 - protein, 265 aa, Neisseria meningitidis; identical to SEQ ID NO: 2680

SEQ ID NO: 6402 - protein, 248 aa, Neisseria meningitidis
MKSSTQAVLEHTAIPKHIAVIMDGNGRWAKKRFLPRIMGHKRGLDALENMVKHCAKLGVQYLTVFAFSTENWRRPEDEVSFLMGLFLQALQKQVRRLHENNMRLKILGSRERFNRQILQGIEEAEALTANNTGLTLSIAADYGGRWDILQAANKLIAEGVSEITEDTLAKHLMLGDAPEPDLFIRTGGETRISNFLLWQMAYAELYFTDILWPDFDGKALDDAVASFQKRERRFGRTSEQLPIEQQRN

SEQ ID NO: 6403 - protein, 185 aa, Neisseria meningitidis
MINDIQKTAEGKMQRSVEVLKENLAKVRTGRAHTGLLDQVEVEYWGSMVPVSQVANVTLLDARTIGVKPFEGNMAAKVEKAIRDSNLGLNPAAVGDLIRVPMPMLTEERRKDLIKVVRGEAEEGRVSIRNVRRDANDHIKKLLKDKEISEDEARRGEEAVQKLTDKYITEADKLLTAKEEDLMAI

SEQ ID NO: 6404 - protein, 375 aa, Neisseria meningitidis; identical to SEQ ID NO: 632

SEQ ID NO: 6405 - protein, 140 aa, Neisseria meningitidis
MFVNEKYPYAALFAGLVFLTLPFALAVHDAFALAFGRTGLLVSVSDGGFGWRGGWDGTVWFVFGVFAFLNVVVSAGLTKLAYKKMMRRHSRYTLFLSGVAACAAAAVAWIFELLLGSGALGGLRGRRCWNMRLPCGWWRC

SEQ ID NO: 6406 - protein, 207 aa, Neisseria meningitidis
MERKERLRAGIAAMGLDISETAQDRLLVYVDLLKKWNKTYNLTALRDEEKMIVHHLLDSLTLLPHIEGVQTMLDVGSGGGQPGIPAAVCRPDVQITLLDANTKKTAFLQQAVIELGLDNVRVVSGRVEAVSDVRADVVTSRAFAELADFVSWTVHLLKDGGYWAAMKGVYPQEEIGRLPQDVCVEKVQRLDVPGLDAERHIVILSKR

SEQ ID NO: 6407 - protein, 257 aa, Neisseria meningitidis; identical to SEQ ID NO: 2668

SEQ ID NO: 6408 - protein, 194 aa, Neisseria meningitidis
MHILTAGVDEAGRGPLVGSVFAAAVILPETFDLPGLTDSKKLSEKKRDALAEMIKNQAVEWHVAAASPEEIASLNILHATMLAMKRAVDGLAVRPEKIFIDGNRIPEHLNIPAEAVVKGDSKIIEISAASVLAKTARDAEMYALAQRHPQYGFDKHKGYGTKQHLEALEKYGVLPEHRRDFAPVRNLLAQQALF

SEQ ID NO: 6409 - protein, 631 aa, Neisseria meningitidis
MTHMIYPKTYDVIVVGGGHAGTEAALAAARMGAQTLLLSHNIETLGQMSCNPSIGGIGKGHLVRELDALGGAMALATDKSGIQFRRLNASKGAAVRATRAQADRILYKAAIREMLENQENLDLFQQAVEDVTLDGERISGVITAMGVEFKARAVVLTAGTFLSGKIHIGLENYEGGRAGDPAAKSLGGRLRELKLPQGRLKTGTPPRIDGRTIDFSQLTEQPGDTPVPVMSVRGNADMHPRQVSCWITHTNTQTHDIIRSGFDRSPMFTGKIEGVGPRYCPSIEDKINRFADKDSHQIFLEPEGLTTHEYYPNGISTSLPFDIQIALVRSMKGLENAHILRPGYAIEYDYFDPRNLKASLETKTIAGLFFAGQINGTTGYEEAAAQGLLAGANAVQYVRGQDPLLLRREQAYLGVLVDDLITKGVNEPYRMFTSRAEYRLQLREDNADMRLTEDGYKIGLVSEAQWRMFNEKREAVEREIQRLKTTWYTPQKLAEGEQIRVFGQKLSREANLHDLLRRPNLDYAALMTLEGAMPSENLSAEVIEQVEIQVKYQGYIDRQNEEIDSRRDIETLKLPDGIDYGKVKGLSAEVQQKLNQHKPETVGQASRISGVTPAAVALLMVHLKRGFKDAK

SEQ ID NO: 6410 - protein, 475 aa, Neisseria meningitidis
MNENFTEWLHGWVGAINDPMWSYLVYMLLGTGLFFTVTTGFVQFRLFGRSIKEMLGGRKQGDDPHGITPFQAFVTGLASRVGVGNIAGVAIAIKVGGPGAVFWMWVTALIGMSSAFVESSLAQLFKVRDYDNHHFRGGPAYYITQGLGQKWLGVLFALSLIFCFGFVFEAVQTNTIADTVKAAWGWEPHYVGVALVILTAPIIFGGIRRISKAAEIVVPLMAVLYLFIALFIILTNIPMIPDVFGQIFSGAFKFDAAAGGLLGGLISQTMMMGIKRGLYSNEAGMGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 6411 - protein, 335 aa, Neisseria meningitidis
MFGANTMKQPVFAVTSGEPAGIGPDICLDLAFARLPCRCAVLGDKNLLRARAEALGKSVVLRDFDPESGGAAYGELEVLHIPAVEAVEAGKLNPANAAYVLQLLDTALAGISDGIFDGIVTAPLHKGIINDARASTGFFSGHTEYLAEKSGTGQVVMMLAGKGLRVALVTTHLPLKDVAAAITQPLIESVARILHHDLKHKFGIKNPKILVAGLNPHAGEGGHLGHEETDTIIPALENLRREGINLAGPYPADTLFQPFMLEGADAVLAMYHDQGLPVLKYHSFGQGVNITLGLPFIRTSVDHGTALDLAATGRADSGSLITAVETAVEMARGSL

SEQ ID NO: 6412 - protein, 919 aa, Neisseria meningitidis
MKRMLFNATQAEELRVAIVDGQNLLDLDIETLGKEQRKGNIYKGIITRIEPSLEACFVDYGTDRHGFLPFKEVSRSYFQDYEGGRARIQDVLKEGMEVIVQVEKDERGNKGAALTTFISLAGRYLVLMPNNPRGGGVSRRIEGEERQELKAAMAELDIPNGMSIIARTAGIGRSAEELEWDLNYLKQLWQAIEEAGKAHHDPYLLFMESSLLIRAIRDYFRPDIGEILVDNQEVYDQVAEFMSYVMPGNIGRLKLYEDHTPLFSRFQIEHQIESAFSRSVSLPSGGAIVIDHTEALVSIDVNSARATRGADIEDTAFKTNMEAAEEVARQMRLRDLGGLVVIDFIDMENPKHQRDVENVLRDALKKDRARVQMGKLSRFGLLELSRQRLKPALGESSHVACPRCAGTGVIRGIESTALHVLRIIQEEAMKDNTGEVRAQVPVDVATFLLNEKRAELFAMEERLDVNVVLIPNIHLENPHYEINRIRTDDVEEDGEPSYKRVAEPEEDESAKPFGGEKAKAARPEPAVKGVRHTSPAPTAAPEKKTSWWDSFKAWLKRIFGGSETQAAPAAETSEKRSTANRSGSRANNRRQNPRRSKREGSKVEVREVAGKTAGQEARADKAETRNNGNRRRNERGDRAAERANEAEIQSRNVQPAATVADAAPSETEVQTGKRRRNGSRSERGQTAPETATVAETTVQTAENTPSEPHTAEDKGSKPKSERNRRERDSRDAKERRERNNQRDRRQNGKKRNIPSAAKIEQYLNIHDTADKVRSAAAHVFGETDANAPITVSIADPVAERDLPTASPAVSNGDAPVYDAAEKIRRATAAILPEGATPKAEAQEMPSETATFTAAAEQARETAQTGGLVLIETDPAALKAWAAQPEVQAGRGLRRSEQPKPSEVATVPAEEMIQVETRQG

SEQ ID NO: 6413 - protein, 95 aa, Neisseria meningitidis
MHVPENRVRKGRIQKAIKIDAAVCLPRSERCGRKNGGRLLLVIVMPVFWAVCVWDLGPAAVLLPRRNGKINSNLITFCACRLGTGAGKMLCGVRF

SEQ ID NO: 6414 - protein, 330 aa, Neisseria meningitidis
MKTHEISKDSVSLIGVAEHEAGQRLDNYLIKILKGVPKSHIHRIIRAGEVRLNKKRCKPDSRIAEGDTVRIPPVRVAEKEMPSERRAAVPARAFDVVYEDDALLVIDKPSGVAVHGGSGVSFGVIEQLRRARPEAKYLELVHRLDKDTSGLLMVAKKRSALVKLHEAIRNDHPKKIYLALGVGKLPDDNFHVKLPLFKYTGAQGEKMVRVSADGQSAHTVFRVLSRFSDGILHGVGLSHLTLVRATLKTGRTHQIRVHLQSQGCPIAGDERYGDYQANRRLQKLGLKRMFLHASELHLNHPLTGEPLVLKAELPPDLAQFAVMLENGTKM

SEQ ID NO: 6415 - protein, 390 aa, Neisseria meningitidis
MWGQTNMADKKSPLIAVSVGEASGDLLGAHLIRAIRKRCPQARFTGIGGELMKAEGFESLYDQERLAVRGFVEVVRRLPEILRIRRGLVRDLLSLKPDVFVGIDAPDFNLGVAEKLKRSGIPTVHYVSPSVWAWRRERVGKIVHQVNRVLCLFPMEPQLYLDAGGRAEFVGHPMAQLMPLEDDRETARQTLGVDAGIPVFALLPGSRVSEIDYMAPVFFQTALLLLERYPAARFLLPAATEATKRRLAEVLQRPEFAGLPLTVIDRQSETVCRAADAVLVTSGTATLEVALCKRPMVISYKISPLTYAYVKRKIKVPHVGLPNILLGKEAVPELLQSEAKPEKLAAALADWYEHPDKVAALQQDFRALHLLLKKDTADLAARAVLEEAGC

SEQ ID NO: 6416 - protein, 129 aa, Neisseria meningitidis
MNVKIKYNLLEYCEYLGGIFGVYKNYLNMDIKDPNLKIRFFDFLEELLSDGVIELCDYRENPPKILTGSPKTQVDELRRIWPDMEEMLLYFPDNPWFYVEHFWWGATCPIELTQLPKIEIYEEQMKQGK

SEQ ID NO: 6417 - protein, 136 aa, Neisseria meningitidis
MTTYTIPKKDYQFLYIYEGTLLNYTLKNDEFHIIVQNVDYPDFPQEIPTPNYTDWVKIKFKQFSYLKFIYGYATKNQDKNIKNVLELGELKQDDEILDYGGALEVIGSRYDLPTGFSIDIVCREIELEFLDQESFN

SEQ ID NO: 6418 - protein, 57 aa, Neisseria meningitidis
MLSRQLYRISFSVETPPLGHLSFGAVESDFIWEGRNPFRIRATHRATLYVSSCVLKH

SEQ ID NO: 6419 - protein, 269 aa, Neisseria meningitidis
MTPLKIAIAGANGRMGRVLVEAVNNHPDTVLSGALEHSGSEALGLDAGYAVGLKTGIAISDDVDAVLAQSDVLIDFTRPEPTLKHLQKCVEKQVNIIIGTTGFDDTGKAAIHTAAEKTGIVFAANFSVGVNLTFHILDTVARVLNEGYDIEIIEGHHRHKVDAPSGTALRMGEVIAGALGRDLKQCAVYGREGHTGPRDPSTIGFATVRAGDIVGDHTALFATDGERVEITHKASSRMTFAAGAVRAAVWVNGKTGLYDMQDVLGLNNR

SEQ ID NO: 6420 - protein, 125 aa, Neisseria meningitidis
MNKTLILALSALLGLAACSAERVSLFPSYKLKIIQGNELEPRAVAALRPGMTKDQVLLLLGSPILRDAFHTDRWDYTFNTSRNGIIKERSNLTVYFENGVLVRTEGDVLQNAAEALKDRQNTDKP

SEQ ID NO: 6421 - protein, 144 aa, Neisseria meningitidis
MEKFNNIAQLKDSGLKVTGPRLKILDLFETHAEEHLSAEDVYRILLEEGVEIGVATIYRVLTQFEQAGILQRHHFETGKAVYELDKGDHHDHIVCVKCGEVTEFHNPEIEALQDKIAEENGYRIVDHALYMYGVCSDCQAKGKR

SEQ ID NO: 6422 - protein, 241 aa, Neisseria meningitidis
MRIPLLAPDNYAFPDPAYALARCDGLVGVSGDLDAGRLLEAYRNGVFPWFSRDGWFFWYAVGPRAVVFPDRLHIPRSLAKTLRNGSYRVAVNGCFAEVVAHCAAAARPNQDGTWIAPEFQTAYLKLHEMGYAHSFECHYPDESGETRLAGGFYGVQIGRVFYGESMFALQPDASKIAFACAVPFLADLGVELIDCQQDTEHMRRFGSELLPFADFAERLRMLNAVPLKEEIGRREVACKGL

SEQ ID NO: 6423 - protein, 343 aa, Neisseria meningitidis
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGPLKGVLGYNTLPLVSMDFNHTTEASHFDATLTKVVDGNMVKVFAWYDNEWGFSCQMLNTARRMFGLEVRPLK

SEQ ID NO: 6424 - protein, 279 aa, Neisseria meningitidis
MTATAAAIDRLLPQTQCRECGYDGCLPYAQAVATGEAYNLCAPGGETVIRDISALLGKPFVAPAKTQAKALARIDETACIGCTACIRACPADAIMGAGKLMHTVIADECTGCGLCVAPCPVDCIHMQPVADTVLPRARRFSLSADSRFAAAEHARTRYLKRNERKQREADERKAMLAEREAAVRNARPQTPDTPKKPTFNPADLIAKAMAKAQTQQDRLAAADNRKDYQAKQIAEARERAELRRAQRDMKYGSDSEKAAALEYLKQYKAKQEAAQNTAS

SEQ ID NO: 6425 - protein, 658 aa, Neisseria meningitidis
MNEFSLAPIVIVLLVSVITVILCRKFNIPSMLGYLLVGFLAGPGMLSLIPKSHATDYLGEIGIVFLMFSIGLEFSLPKLRAMRRLVFGLGGLQVGITMLSVMGILMLTGVPFNWAFAVSGALAMSSTAIVSRILSEKTELGQPHGQMAMGVLLMQDIAVVPLMILIPALAGGGDGNIWAALGLAFAKMLLTLGLLFFVGSKIMSRWFRMVAKRKSSELFMINVLLVTLGVAYLTELEGLSMALGAFVAGMLLSETEYRFQVEDDIRPFRDILLGFFFITVGMKLDIQALIGGWRQVLMLLAMLLVLKALVVFAIAFKMKHSVGDSLKTALYLAQGGEFGFVMLAIAGQLDMVSPEWEQAATAAVLLSMIIAPFLLGGSDALVGRLVKSSWDMKSLDLHSMLVETMSKSDHVLIVGFGRGGQTVGRVLAQEDIPYFALDLDIARVQVARSAGEPVSFGDAKRREVLEAAGLGRAKMVVVTLNNMHETQHVLDNVLSMYPNMPVYVRATNDDYVKTFTDIGAEEAVSDTKETGLVLAGYAMLGNGASYRHVYQTMANIRHSRYAALEGLFVGSDDEAGFGENGETVRHAFPLAAEAYAVGKTVGTLPMAAYGIKLLFVRRRTGRIENPDASFTLEGGDVLVVAGKKEEIISFENWSLQGI

SEQ ID NO: 6426 - skipped

SEQ ID NO: 6427 - protein, 461 aa, Neisseria meningitidis
MISIFDIFKIGIGPSSSHTVGPMKAAAAFAAGLDAQAVRIVIDIYGSLALTGYGHGTFDALMLGLEGSLPHDIPLAGIPERLERIRTQHILRLNGQEIRFIPDRDLNILGNQVLPKHPNSLRFTAYASDGTVLNEQVYYSVGGGFVVTEEDFDRQAETEKAVPYPYTSCAELLARCRLNRLDISEVVLANEAALAGCGEAEIRRRAAAVAEVMEGCIKRGLGADGELPSGLNVRRRAPQLAAKLKVLRETEIVNTQLWPMVYAMAVNEENAAGGRVVTAPTNGAAGIIPAVLHYFRKFNPHATQERVENFLLTAGAIGILYKTNASISGADVGCQGEVGVACSMAAGAYAEVIGGTPKQVENAAEMAMEHHLGLTCDPVGGLVQIPCIERNGIAAEKALKLGTLALLEDGTDKKVSLDEVIRTMLQTGRDMKATYKETSLAGLAATLRKKAVPVSVRVVEC

SEQ ID NO: 6428 - protein, 796 aa, Neisseria meningitidis
MTEQKHEEYGADSIQVLEGLEAVRKRPGMYIGDTQDGSGLHHMVFEVLDNAIDEALAGHCDKITVTIHADHSVSVADNGRGMPTGIHPKEGRSAAEVIMTVLHAGGKFDNNSYKISGGLHGVGVSVVNALSDWVTLTIYRDGKEHFVRFVRGETEEPLKIVGDSDKKGTTVRFLASTETFGNVEYSFDILAKRIRELSFLNNGVDIELTDERDGKHESFALSGGVAGFVQYMNRKKTPLHEKIFYAFGEKDGMSVECAMQWNDSYQESVQCFTNNIPQRDGGTHLTALRQVMTRTINNYIEANEVAKKAKVETAGDDMREGLTCVLSVKLPDPKFSSQTKDKLVSGEIGPVVNEVISQALTDFLEENPNEAKIITGKIVDAARAREAARKAREITRRKGVMDGLGLPGKLADCQEKDPALSELYLVEGDSAGGSAMQGRDRKFQAILPLKGKILNVEKARFEKMLASQEVATLITALGAGIGKEEFNAEKLRYHRIIIMTDADVDGAHIRTLLLTFFYRQMPELVERGYIYIAQPPLYKAKYGKQERYLKDELEKDQWLLGLALEKAKIISDGRTIEGAELADTAKQFLLAKTVIEQESRFVDELVLRAMLHASPIDLTSSENADKAVAELSGLLDEKEVALERIEGHEGHRFIKITRKLHGNVMVSYIEPKFLNSKAYQTLTQTAAALKGMVGEGAKLYKGENGYDADSFETALDILMSVAQKGMSIQRYKGLGEMNPEQLWETTMDPAVRRLLKVRIEDAIAADEVFVTLMGDEVEPRRAFIENNALIAQNIDA

SEQ ID NO: 6429 - protein, 328 aa, Neisseria meningitidis
MKRYVCLRHQVGDCPVKWQKRFFATKIYTLYFSDRGAEMEIWNMLDTWLGAVPIRAEAVESVAAVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRHLENVQAEKLFITPAARPRVTRVPYDDKAYRIIVRFASPVSKRLEIQQAVMDEFLRVQYRLLNHPAGSETL

SEQ ID NO: 6430 - protein, 678 aa, Neisseria meningitidis; identical to SEQ ID NO: 1472

SEQ ID NO: 6431 - protein, 188 aa, Neisseria meningitidis
MGFYALLLIALGMSMDAFAVALAKGAAVRMPPRKIAATALVFGTVEALTPLAGWVGGFYAKPFISEWDHWVAFVLLGGLGLKMMREGLSGEAEDVRESKRESLWMTVLTAFGTSIDSMIVGVGLAFMEVNIAFAAAIIGMATTVMVAVGLTAGRALGVLFGRCAEFAGGLVLIAIGTWTLLSHLGLIQ

SEQ ID NO: 6432 - protein, 504 aa, Neisseria meningitidis
MTTSKCPVTHLTMNNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPAGYRHMHGFGSHTYSFWNEAGERFWVKFHFRTQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGVGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFGNTAAAMGDAPDFIKYRHIRNCYRCDPAYGEGVAKALGLTVEDAQAARATDPALGQAGLL

SEQ ID NO: 6433 - protein, 283 aa, Neisseria meningitidis
MTLLGIKLKQTQQLNQRLQQSLRVLQMSGIELEREVENWLSDNPLLERKDTDEFSDAEFSHYTAPARQIGGDEGEDMLSNIAGEQDFKQYLHAQVCEHPLSDQEAACVHILIDFLDEQGYLTDSIEDILDHTPLEWMLDEAMLQHALTALKKFDPAGVAAADLNESLILQIERLGECAAKPAALHIVRNALDSIDGNRSQTLARIKKHLPQTDSGTLEAALDLIASLNPFPAAGFASSTPTPYSDEALANLLAFRGMEVSRRTIAKYRESFEIPAAHKRKTAE

SEQ ID NO: 6434 - protein, 376 aa, Neisseria meningitidis
MKIVFITTVASSIYGFRAPVIKKLIGKNHQVYAFVSEFSDNELDIIREMGVTPVTYRSNRSGLNPFSDIKSTFLIFKELKKISPDLVFPYFAKPVIFGTFAAKLAGVPRIVGMLEGLGFAFTPQPEGIPLKTKIIKGILIALYRIALPMLESLIVLNPDDKDELTDKYGIKIKNIHILGGIGLDLRQYPYSEADIPDEKEPVKFLFIGRFLKEKGIDDFIRAAEQVKDKYPDTVFTALGAIDKSRGGGGDLERLAARDIIRFPGFVNNVSEVIKEHHIFVLPSYYREGVPRSTQEAMAVGRAVITTDVPGCRETVADKVNGFLIEPWNPRILAEKMIYFIENREAVRLMGNASYAIAKDKFDAEKVDLKLLDILKA

SEQ ID NO: 6435 - protein, 415 aa, Neisseria meningitidis
MSQRRVVITGLGQVSPVGNTVAEAWDTLLTGKSGIGAITRFDTSDINSRVAGEVRGFDIGQYISAKEARRMDVFIHYGIAAALQAIADSGLDDVENLDKDRIGVNIGSGIGGLPGIEVTGKAVIEGGARKINPFFIPGSLINLISGHVTILKGYRGPSYGMVSACTTGAHAIGDSLRMIKYGDADIMVAGGAEGAISTLGVGGFAAMKALSTRNDDPATASRPWDKGRDGFVIGEGAGILVLEELEHAKKRGAKIYAEIVGFGMSSDAYHITAPNEEGPALAVTRALKDAGINPEDVDYVNAHGTSTPLGDANETKALKRAFGEHAYKTVVSSTKSMTGHLLGAAGGVEAVYSILAIHDGKIPPTINIFEQDVEAGCDLDYCANEARDAEIDVAISNSFGFGGTNGTLVFKRFKG

SEQ ID NO: 6436 - protein, 78 aa, Neisseria meningitidis
MSNIEQQVKKIVAEQLGVNEADVKNESSFQDDLGADSLDTVELVMALEEAFGCEIPDEDAEKITTVQLAIDYINAHNG

SEQ ID NO: 6437 - protein, 335 aa, Neisseria meningitidis
MYPLARRILFALDAEKAHHFTLDALYTVYKLGLIPVTDNRTKPVKLMGMDLPNPVGLAAGLDKNGEYIDALGALGFGFIEIGTVTPNPQPGNPQPRLFRVPEHQGIINRMGFNNHGIDTMIRNIEKSKFSGVLGINIGKNAVTPIENAADDYLICLEKAYAHASYITVNISSPNTKNLRALQGGDELSALLEALKNKQAQLASVHGKYVPLAVKIAPDLDEAQIEDIAHVVKSVEMDGIIATNTTIDKSSLGSHPLAGEQGGLSGLPVHEKSNRVLKLLADHIDGKLPIIGVGGIMEGEDSADKIRLGATAVQVYSGLIYKGPALVKECLKALAR

SEQ ID NO: 6438 - protein, 157 aa, Neisseria meningitidis
MNLDLTAQKVRLSWKDILWGYGNKYLGWADVAAYARKMTLSDHDERVFKLSLINKSNILELKPVLEDLASEMRDYSPKNWLYVLLSDVFHRKEEFEDPLGEVEKIYADFDYPEEIESFVRYMPPKDGYIPSAHTYEENIARLYSHWEHYLNNGGGQG

SEQ ID NO: 6439 - protein, 72 aa, Neisseria meningitidis
MIMGFWNGVAKAAKAVGEGMIEAGNEHKALKMEYAEKSSEELHEIVKSDGFFKNSTREKSAAYAILKERGEV

SEQ ID NO: 6440 - protein, 896 aa, Neisseria meningitidis
MSDNRLDTARRHSLFLARQLDNGKLKPEIFLPMLDKVLTEADFQAFADWGEIRAEENEEELARQLRELRRYVVSQIIVRDINRISDLNEVTRTITLFADFAVNTALDFAYAYYRDMYGTPIGRYTKSPQHLSVVAMGKAGGYELNVSSDIDLIFVYPESGDTDGRRERGNQEFFTKVGQKLIALLNDITADGQVFRVDMRLRPDGDSGALVLSETALEQYLITQGREWERYAWCKGRVVTPYPNDIKALVRPFVFRKYLDYGAYEAMRKLHRQISSEVSKKGMADNIKLGAGGIREVEFIAQIFQMIRGGQMRALQLKGTQETLKKLAELGIMLSEHVETLLAAYRFLRDVEHRLQYWDDQQTQTLPTSPEQRQLLAESMGFDSYSAFSDGLNVHRNKVNQLFNEILSEPEEQTQDNSEWQWAWQDKPDEEGRRCRLKAHGFDAETVAARLDQIRHGHKYRHLSAHAQPRFDAVVPLFVQAAAAQSNPTDTLMRLLDFLENISRRSAYLAFLNEHPQTLAQLAQIMGQSSWVAAYLNKYPILLDELISAQLLDTAFDWQALAAALSDDLKACGGDTEAQMDTLRRFQHAQVFRLAVQDLAGLWTVESLSDQLSALADTILAAALLCAWADMPKKHRDTPQFAVVGYGKLGGKELGYASDLDLVYLYDDPHPDAGDVYSRLARRLTNWLSAATGAGSLYETDLRLRPNGDAGFLAHSIAAFEKYQRENAWTWEHQSLTRARFICGTSEIQTAFDRIRTEILTAERDQTALAGEIIEMREKMFPTHPPADSNVKYARGGVVDVEFIVQYLILAHARQYPQLLDNYGNIALLNISADCGLIDKTLAGQSRTAYRFYRRQQHNTKLRDAAKTEVTGELLAHYGNVRKLWREVFGEEAATV

SEQ ID NO: 6441 - protein, 321 aa, Neisseria meningitidis
MSYTQLTQGERYHIQYLSRHCTVTEIAKQLNRHKSTISREIRRHRTQGQQYSAEKAQRQSQTIKQRKRQPYKLDSQLIQHIDTLIRRKLSPEQVCAYLCKHHQITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRALKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLIH

SEQ ID NO: 6442 - protein, 230 aa, Neisseria meningitidis
MKRFTYTLSDGLCIEIELKRSAKKNLILRPVNMQTVSINVPPFFQDHALANWLAANETILRNTLAKTPVHPVSHPNLPEWIWYRGIKTKLDTHSQSHIRITSSEILLPRKETAAQIDHLRRLLNERAREYLLPRLEKHAAETGLTPTATDLSNAKTFWGVCRPHTGIRLNWRLIGTPEYVADYVCIHELCHLRHPDHSPRFWHLVNTLTPHTDNAKSWLKAHGRELFVLG

SEQ ID NO: 6443 - protein, 397 aa, Neisseria meningitidis
MSDQKNRRNALIGAAFLMATSAIGPGFLTQTATFTQALAASFGFVILLSILLDIGAQLNIWRIVAVSEKQAQDIANQVLPGAGYFLAVLIVMGGLAFNIGNVGGAGLGLNLLTGLSPETGAVISGVIAIGVFLFKEAGKVMDKFAQVMGFVMIALTVYVAWQANPPLADAAVHTFMPEKLDAMAIVTLVGGTVGGYITFAGAHRLLDAGIKGKSALPEVSQSSVRAILIASIMRIVLFLAVLGVVSQGVQLNPDNPASTPFEYAAGYIGLLIFGVVIWAASITSVIGAAYTSVSFFSGLSPSIERNKNKWIIAFIAVSTAVFSTIGKPAQVLVFVGALNGLILPISLGLILIAAYKTKIVGDYKHPLWLTVSGVIVVGLMAVLSAITISKYIGGLFG

SEQ ID NO: 6444 - protein, 245 aa, Neisseria meningitidis
MKQVDLNADLAEGCGSDEALLQLITSANIACAQHAGSIADIRAALAYAQQNGVRIGAHPGYPDRENFGRTEMNLSEADLRACLNYQLGALQALCRDQGLEMAYVKPHGAMYNQAAKNRALADTVARIVADFDPKLKLMALSGSLLLEAGKAAGLGVISEVFADRRYMPDGTLVPRSRPDAQVDSDEEAIAQVLQMVRDGQVKAVDGSLVAVQADSICLHGDGPHAVVFAEKIRQELLAAGIKVSA

SEQ ID NO: 6445 - skipped

SEQ ID NO: 6446 - protein, 215 aa, Neisseria meningitidis
MRIEITPISESALVYRLNAPSELGKQQKLWAFAAALGQHDRIEEVVVGMNNLTVFTRFDTDLATLADELQYVWEHTAVTDHQGKLVEIPVCYGGEYGPDLAEVAAFHQTVISEIVRRHTAQTYTVFMMGFQPGFPYLGGLPEALHTPRRAVPRTSVPAGSVGIGGSQTGVYPFASPGGWQIIGRTELPLFRADLNPPTLLAAGDQVRFVAERIEP

SEQ ID NO: 6447 - protein, 34 aa, Neisseria meningitidis
MRYFNRNGLRSSEKVQRQGSTFPIDGLMMQHRRY

SEQ ID NO: 6448 - protein, 735 aa, Neisseria meningitidis
MFPDQSAPNLLQGLNPEQLSAVTWPPQSALVLAGAGSGKTRVLTTRIAWLLQSGQASVHSIMAVTFTNKAAKEMQTRLGAMIPINVRAMWLGTFHGLCHRFLRLHHRDAGLPSSFQILDGGDQLSLIKRLLKSLNIAEEIIAPRSLQGFINAQKESGLRASVLSAPDPHTRRMIECYAEYDKICQREGVVDFAELMLRSYEMLQNNEILRQHYQNRFNHILVDEFQDTNKLQYAWLKLIAGNHAAVFAVGDDDQSIYRFRGASVGNMTALMEEFHIDAPVKLEQNYRSVGNILAAANAVIENNDERLGKNLRTDAEAGDKIRYYSAFTDLEEARFILDETKALEREGWDLDEIAVLYRSNAQSRVIEQSLFRSGIPYKIYGGLRFYERQEIKHALAYLRLAVNPDDDNALLRVINFPPRGIGARTVENLQTASNEQGITLWQAACNAGAKAAKVVAFVRLIEALRNQVGQLSLSEIIVGILKDSGLTEHYRTQKGDNQDRLDNLDELVNAAIEFKPEDSNFEILPENISDDPAFPILAFLSNAALESGENQAGAGEKAVQLMTVHAAKGLEFNAVFLTGMEEGRFPSEMSLAERGGLEEERRLMYVAITRARKRLYITMAQQRMLHGQTQFGIVSRFVEEIPPEVLHYLSVKKPAYDSYGNTRQTAASKDKIIDDYKQPQTYAGFRIGQNVRHAKFGTGVIIDAADKGESARLTINFGKQGVKELDTKFAKLEEM

SEQ ID NO: 6449 - protein, 33 aa, Neisseria meningitidis
MGFFYESSPKFQTAFLAVIIVDEAHATMYTQSK

SEQ ID NO: 6450 - protein, 179 aa, Neisseria meningitidis
MSQVFKDFDLSSVWKTNSWADENYKEAPFTPEILAAVESELGYKLPQSFIELMAVQNGGIFVKNCFPTTQRNSWAENHVQICEVSGIGFEKEGSLCGAMGQKLWLEEWEYPPIGVYFANDPSGGHAMFALDYRACGKDGEPKVVFVEQESDFEIVELAPDFETFIRSLRHEDEFIDEEI

SEQ ID NO: 6451 - protein, 53 aa, Neisseria meningitidis
MNIINYKGDDIIISLTREELQLLRSLVIEIYAGVCIDAEEFEIVSGIRNPKLV

SEQ ID NO: 6452 - protein, 67 aa, Neisseria meningitidis
MLKRNLGFDTFKLITIFFLGIRRLQSKHIRAIWDDKSGAIVIRDPNSKDGGTAFRPTLGKTYFDKQK

SEQ ID NO: 6453 - protein, 119 aa, Neisseria meningitidis
MIKLDLKSINLYDIDFEKFTPEIPDNFHRWIDLDIGIEGEQGSSIFSLCICSPKWISHHCNKEGFFWSNALILEQFDHKIIKSEIDKILEYCSKETWDLTLSNLLRFFSWEFEDYNPNT

SEQ ID NO: 6454 - skipped

SEQ ID NO: 6455 - protein, 206 aa, Neisseria meningitidis
MNSTASKTLKGLSLVFFASGFCALIYQVSWQRLLFSHIGIDLSSITVIISVFMVGLGVGAYFGGRIADRFPSSIIPLFCIAEVSIGLFGLVSRGLISGLGHLLVEADLPIIAAANFLLLLLPTFMMGATLPLLTCFFNRKIHNVGESIGTLYFFNTLGAALGSLAAAEFFYVFFTLSQTIALTACFNLLIAASVWLRYRKDGYSEH

SEQ ID NO: 6456 - protein, 483 aa, Neisseria meningitidis
MLSFLSGLLSLGIEVLWVRMFSFAAQSVPQAFSFTLACFLTGIAVGAYFGKRICRSRFVDIPFIGQCFLWAGIADFLILGAAWLLTGFSGFVHHAGIFITLSAVVRGLIFPLVHHVGTDGNKSGRQVSNVYFANVAGSALGPVLIGFVILDFLSTQQIYLLICLISAAVPLFCTLFQKSLRLNAVSVAVSLMFGILMFLLPDSVFQNIADRPDRLIENKHGIVAVYHRDGDKVVYGANVYDGAYNTDVFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNTTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIQMTEPSAGAEVITDDNMIVEYKYGRGI

SEQ ID NO: 6457 - protein, 118 aa, Neisseria meningitidis
MLSAYFPVFVFILIGLAAGVLFILLGTILGPKRHYAEKDAPYECGFEAFENARMKFDVRYYLVAILFILFDLEVAFMLPWAVVFKDLGAYGFWSMLVFIVVLTVGFVYEWKKGALEWE

SEQ ID NO: 6458 - protein, 160 aa, Neisseria meningitidis
MGIEGVLKKGFITTSADTVLNYMRTGSLWPVTFGLACCAVEMMHAGMARYDLDRFGIIFRPSPRQADLMIVAGTLTNKMAPALRRVYDQLAEPRWVLSMGSCANGGGYYHYSYSVVRGADRVVPVDVYVPGCPPTAEALIYGLIQLQQKIKRTSTIARDE

SEQ ID NO: 6459 - protein, 197 aa, Neisseria meningitidis
MASIQDLYETVSRVLGNQAGKVISALGEITVECLPEHYISVMTALRDHEELHFELLVDLCGVDYSTYKNEAWQGKRFAVVSQLLSVKNNQRIRVRVWVSDDDFPVVESVVDIYNSADWYEREAFDMYGIMFNNHPDLRRILTDYGFVGHPFRKDFPISGYVEMRYDEEQKRVIYQPVTIEPREITPRIVREENYGGQ

SEQ ID NO: 6460 - protein, 418 aa, Neisseria meningitidis
MANKLRNYTINFGPQHPAAHGVLRMILELDGEQIVRADPHIGLLHRGTEKLAETKTYLQALPYMDRLDYVSMMVNEQAYCLAVEKLVGIDVPIRAQYIRVMFAEVTRILNHLMGIGSHAFDIGAMTAILYAFRDREELMDLYEAVSGARMHAAYFRPGGVYRDLPDFMPKYEGSKFRNAKVLKQLNESREGTMLDFIDAFCERFPKNIDTLETLLTDNRIWKQRTVGIGVVSPERAMQKGFTGVMLRGSGVEWDVRKTQPYEVYDKMDFDIPVGVNGDCYDRYLCRMEEMRQSVRIIKQCSEWLRVNPGPVITTNHKFAPPKRTEMKTGMEDLIHHFKLFTEGMHVPEGETYTAVEHPKGEFGVYIISDGANKPYRLKIRAPGFAHLQGMDEMAKGHMLADVVAIIGTQDIVFGEVDR

SEQ ID NO: 6461 - protein, 157 aa, Neisseria meningitidis
MLSAESLKQIDIELAKYPADQRRSAIMGALRIAQTEKGWLAPETIAFVADYIGITPAQAYEVATFYNMYDLEPVGKYKLTVCTNLPCALRGGMATGEYLKQKLGIGYGETTPDGKFTLVEGECMGACGDAPVMLVNNHSMCSFMTEEAIEKKLAELE

SEQ ID NO: 6462 - protein, 433 aa, Neisseria meningitidis
MAIYQSGVIFDQVDTANPDCWTLDEYVKRGGYTALRKILSENISQTDVIDEVKTSGLRGRGGAGFPTGLKWSFMPRSFPGEKYVVCNTDEGEPGTFKDRDIIMFNPHALIEGMIIAGYAMGAKAGYNYIHGEIFEGYQRFEAALEQARAAGFLGKNILGSDFEFELFAHHGYGAYICGEETALLESLEGKKGQPRFKPPFPASFGLYGKPTTINNTETFSSVPFIIRDGGQAFADKGIPNAGGTKLFCISGHVERPGNYEVPLGTPFAEVLKMAGGMRGGKKLKAVIPGGSSAPVLPADIMMQTNMDYDSISKAGSMLGSGAIIVMDEDVCMVKALERLSYFYYDESCGQCTPCREGTGWLYRIVHRIVEGKGKMEDLDLLDSVGNQMAGRTICALADAAVFPVRSFTKHFRDEFVHYIEHGGPMKEHKWGGW

SEQ ID NO: 6463 - protein, 145 aa, Neisseria meningitidis
MVEAKIFILYGAANKGKSTTLNTLFNQICRKFSKFLVFFERHGNGLDFVAVFDHEGQRIGFYSSGDNEYEVRGNLYKLYSHNCDFIFGTSRTRGGSCDAVGCYAELLHGDVNIINWCEKFEPTDEDNERAVKELFKSFKNIINEL

SEQ ID NO: 6464 - protein, 79 aa, Neisseria meningitidis
MANGKNGTLYIGVTMNLPERVWQHKNHVNIDGFTARYDVHDLVWYQFFENMPEAVAKEKTMKKWRREWKIKLIEEQNTE

SEQ ID NO: 6465 - protein, 753 aa, Neisseria meningitidis
MLQIEIDGKQVSVEQGATVIEAAHKLGTYIPHFCYHKKLSIAANCRMCLVNVEKAPKPLPACATPVTDGMIVRTHSAKAREAQEGVMEFLLINHPLDCPTCDQGGECQLQDLAVGYGKTTSRYTEEKRSVVGKDMGSLVSAEEMSRCIHCTRCVRFTEEIAGLQEIAMVNRGEHSEIMPFIGKTVETELSGNVIDLCPVGALTSKPFRFNARTWELNRRKSVSAHDALGSNLIVQTKDHTVRRVLPLENEAINECWLSDRDRFAYEGLYHESRLKNPKIKQGGEWMDVDWKTALEYVRSAIECIAKDGKQNQVGVWANPMNTVEELYLAKKLADGLGVKNFATRLRQQDKRLSDGLKGAQWLGQSIESLADNDAVLVVGANLRKEQPLLTARLRRAAKDRMALSVLASSKEELFMPLLSQEAAHPDEWAGRLKNLSVNAEHAVTASLKNAEKAAVILGAEVQNHPDYAAVYAAAQELADATGAVLGILPQAANSVGADVLNVNSGKSVVEMVNAPKQAVLLLNVEPEIDTADGAKAVAALKQAKSVMAFTPFVSETLLDVCDVLLPIAPFTETSGSFINMEGRLQSFHGVVQGFGDSRPLWKVLRVLGNLFDLKGFEYHDTAAILKDALDVESLPSKLDNRNAWTGEGVQTTSDRLVRVGGVGIYHTDSIVRRSAPLQETSHAAVPAARVNPNTLARLGLQDGQTAVAKQNGASVSVAVKADAGLPENVVHLPLHTENAALGALMDTIELAGA

SEQ ID NO: 6466 - protein, 358 aa, Neisseria meningitidis
MQEWFQNLFAATLGLGDLGITVGLVVSVIVKIVIILIPLILTVAYLTYFERKVIGFMQLRVGPNVTGPWGLIQPFADVFKLLFKEVTRPKLSNKALFYIGPIMSLAPSFAAWAVIPFNEEWVLTNINIGLLYILMITSLSVYGVIIAGWASNSKYSFLGAMRASAQSISYEIAMSAALVCVVMVSGSMNFSDIVAAQAKGIAGGSVFSWNWLPLFPIFIVYLISAVAETNRAPFDVAEGESEIVAGHHVEYSGFAFALFFLAEYIFMILIAALTSLMFLGGWLSPFPQSWGIVGTPSAFWMFAKMAAVLYWYLWIRATFPRYRYDQIMRLGWKVLIPIGFAYIVILGVWMISPLNLWK

SEQ ID NO: 6467 - protein, 159 aa, Neisseria meningitidis
MANLVKTFLLGELVKGMGVTLKNFFARKDTIYFPEEKTPQSVRFRGLHAQRRYPNGEERCIACKLCEAVCPAMAINIESEEREDGTRRTKRYDIDLTKCIFCGFCEEACPTDAIVETHIFEYHGEKKGDLHMTKPILLAIGDKYEAEIAKRKAADAPYR

SEQ ID NO: 6468 - protein, 235 aa, Neisseria meningitidis
MEGLINALKYLAEHEPIDNFEEIRTRNSPIELPSGLSNFEQNIFLKENLSPKLQNDDSLKTHYWIIREWGGIKSFKQSAENSQLIRQFLSELNSGKLSSGLLKISSLSKLASFIDCERFAIYDSRAIFSLNWLLFKFTNADLFFQPQGRNRELEIRNMNVLFHFSDIKPNYRKPDVSFHQYCGLLQDLAKQVYGKQAKPYHIEMLLFKIATTWICADMDQLIKFDCLRNQDFQTA

SEQ ID NO: 6469 - protein, 223 aa, Neisseria meningitidis
MTFQLILFYIFAVIILYGALKTVTAKNPVHAALHLVLTFCVSAMLWMLMQAEFLGVTLVVVYVGAVMVLFLFVVMMLNIDIEEMRAGFWRHAPVAGVVGTLLAVALILILVNPKTDLAAFGLMKDIPADYNNIRDLGSRIYTDYLLPFELAAVLLLLGMVAAIALVHRKTVNPKRMDPADQVKVRADQGRMRLVKMEAVKPQVESAEESEVSDDLKPKEEGKA

SEQ ID NO: 6470 - protein, 101 aa, Neisseria meningitidis
MITLTHYLVLGALLFGISAMGIFMNRKNVLVLLMSIELMLLAVNFNFIAFSQHLGDTAGQIFVFFVLTVAAAESAIGLAIMVLVYRNRQTINVADLDELKG

SEQ ID NO: 6471 - protein, 191 aa, Neisseria meningitidis
MPSENPIGKTMKSIDEQSLHNARRLFESGDIDRIEVGTTAGLQQIHRYLFGGLYDFAGQIREDNISKGGFRFANAMYLKEALVKIEQMPERTFEEIIAKYVEMNIAHPFLEGNGRSTRIWLDLVLKKNLKKVVNWQNVSKTLYLQAMERSPVNDLELRFLLKDNLTDDVDNREIIFKGIEQSYYYEGYEKG

SEQ ID NO: 6472 - protein, 113 aa, Neisseria meningitidis
MMDKNQLEQEFHKAMLNIYQEALNLPQPYKATRFLQIVNEFGGKEAADKLLSTGEKKTQTGFTELILSGGGVHALKYSMEYLVLQKPWCDLFTEEQLAVARKRLERVGFVFPK

SEQ ID NO: 6473 - protein, 674 aa, Neisseria meningitidis
MNDMTLYLIIALVPLAGSLIAGLFGNKIGRAGAHTVTILGVAVSAVLSAYVLWGFIDGSRAKFDENVYTWLTMGGLDFSVGFLVDTMTAMMMVVVTGVSLMVHIYTIGYMHDEKVGYQRFFSYISLFTFSMLMLIMSNNFIQLFFGWEAVGLVSYLLIGFYFKRPSATFANLKAFLINRVGDFGFLLGIGLVLAYFGGSLRYQDVFAYLPNVQNATIQLFPGVEWSLITVTCLLLFVGAMGKSAQFPLHVWLPDSMEGPTPISALIHAATMVTAGLFMVSRMSPIYEMSSTALSVIMVIGAITALFMGFLGVIQNDIKRVVAYSTLSQLGYMTVALGASAYSVAMFHVMTHAFFKALLFLAAGSAIIGMHHDQDMRHMGNLKKYMPVTWLTMLIGNLSLIGTPFFSGFYSKDSIIEAAKYSTLPGSGFAYFAVLASVFVTAFYAFRQYFMVFHGEEKWRSLPEHHSDGHGEEHHGLGKNDNPHESPLVVTLPLILLAVPSVIIGYIAIEPMLYGDFFKDVIFVNADAHPTIHIMKEEFHGALAMVSHSLHSPVLYLAIAGVLSAWLLYVKLPHLPAKIAQTFRPIYVLFENKYYLDALYFNVFAKGTRALGTFFWKVGDTAIIDNGIVNGSAKLVGAIAAQVRKAQTGFIYTYAAAMVFGVLVLLGMTFWGLFR

SEQ ID NO: 6474 - protein, 498 aa, Neisseria meningitidis
MFSNYLLSLAIWIPIAAGVLVLATGSDSRAPFARVLAFMGALAGFLVTLPLFTGFDRLSGGYQFTEFHEWIPLLKINYALGVDGISVLFIILNAFITLLVVLAGWEVIQKRPAQYMAAFLIMSGLINGAFAAQDAILFYVFFEGMLIPLYLIIGVWGGPRRVYASVKLFLYTLMGSLLMLVAMVYLYYQTGSFSIVDFQNIEQIPLGVQQLLFVAFFLSFAVKVPMFPVHTWLPDAHVEAPTGGSMVLAAITLKLGAYGFLRFILPIMPDAARYFAPVIIVLSLIAVIYIGMVALVQTDMKKLVAYSSISHMGFVTLGMFLFVDGQLDDWALKGAIIQMISHGFVSAAMFMCIGVMYDRLHTRNIADYGGVVNVMPKFAAFMMLFGMANAGLPATSGFVGEFMVIMGAVKVNFWVGALAAMTLIYGASYTLWMYKRVIFGAIHNPHVAEMQDINCREFAILAILAVAVLGMGLYPNAFIEVVHQAANDLIAHVAQSKI

SEQ ID NO: 6475 - protein, 480 aa, Neisseria meningitidis
MNWSDLNLMPAMPEIVLLSLLVLLLLADLWVSDDKRPWTHYGALATVAVTAVVQLAVWEQGSTSSFNGMYIADGMSRLAKMVLYALTFALFVYAKPYNQVRGIFKGEFYTLSLFALLGMSVMVSAGHFLTAYIGLELLSLALYALIALRRDSGFAAEAALKYFVLGALASGLLLYGISMVYGATGSLEFAGVLASSFNEEANEWLLKLGLVFIVVAVAFKLGAVPFHMWVPDVYHGAPTSVTALVGTAPKIAAVVFTFRILVTGLGTVHHDWSLMFALLAAASLLVGNLAAIMQTNIKRMFAYSTVSHMGFILLAFMAGAVGFAAGLYYAITYALMAAAGFGVLMVLSDGDNECENISDLAGLNQHRVWLAFLMLLVMFSMAGIPPLMGFYAKFGVIMALLKQGHVWLSVFAVIMSLIGAFYYLRVVKVIYFDVPDHDQPVGSNYAAKFVLTVNAFLLLLWGIMPQTVIDWCAKALENTL

SEQ ID NO: 6476 - protein, 128 aa, Neisseria meningitidis
MPFRNAVQTASPPTTPKQKAHHDRIHVHPFGLGTHLCQRPLPHDQTVRRGRTQAQTFRTPHDRAGGRFRADRRSCLHPRIPCRIGTRSGLGVLCHSRLPVPDFCVSMFCVAVFLAHAQQGIDKHRNAV

SEQ ID NO: 6477 - protein, 259 aa, Neisseria meningitidis
MRYAALDGGKRLRPMLVLAASELGEAVHEAVEQAMAAIEMIHVYSLVHDDMPAMDNDSLRRGKPTCHIKYGEATALLTGDALQTQAFDVLSRPTELPAARQLAMLSVLAKAGGSRGMAGGQAIDLANVGKQMVQADLEQMHSLKTGALIRAAVLLGATACPDLSDAELSVLDAYAAKLGLAFQVIDDVLDCEADTATLGKTAGKDADNDKPTYVKLMGLEAARSYAHKLVAEAVALLEPFGDKALRLRQLAEFAVARKY

SEQ ID NO: 6478 - protein, 74 aa, Neisseria meningitidis
MKKNAPKSFEEALSRLESLTQSMQGEMPLEDALAAYQEGNELVRYCQTKLAQVEQKLQVLDTDGLKELNLESDE

SEQ ID NO: 6479 - protein, 307 aa, Neisseria meningitidis
MPSEHPFSDGIPTPNPKETMNDTAQITASYGRRYIVRTPDGTTYEASTRKKRVDFACGDRVRISPVNAEQVVIEDFLPRQSLLYRQDAWKTKLIAANVTQLLIVTAAVPSPSVRLLQRALLAAEAAGIEAVIVLNKADLPETALWREKLKFYETLGYPVIETRALENAGSLRPALQGHSNILLGQSGMGKSTLTNALLGSQTARTGDISAALDSGKHTTTHARLYDLNGETQLIDSPGLQEFGLHHLQAADLPRYFPDFRHLVGQCRFHNCTHRAEPGCAFKAAAQTGAASPERLAFLQGITDELPG

SEQ ID NO: 6480 - protein, 618 aa, Neisseria meningitidis
MLNKIFSWFESRIDPYPEAAPKTPEKGLWRFVWSSMAGVRKWIAALAALTAGIGIMEALVFQFMGKIVEWLGKYAPAELFAEKSWELAAMAAMMVFSVAWAFAASNVRLQTLQGVFPMRLRWNFHRLMLNQSLGFYQDEFAGRVSAKVMQTALALRDAVMTVADMVVYVSVYFITSGVILASLDSWLLLPFIGWIVGFASVMRLLIPKLGQTAAWQADARSLMTGRITDAYSNIATVKLFSHGAREAAYAKQSMEEFMVTVRAQMRLATLLHSCSFIVNTSLTLSTAALGIWLWHNGQVGVGAVATATAMALRVNGLSQYIMWESARLFENIGTVGDGMATLSKPHTILDKPRALPLNVPQGAIKFEHVDFSYEAGKPLLNGFNLTIRPGEKVGLIGRSGAGKSTIVNLLLRFYEPQSGTVSIDGQDISGVTQESLRAQIGLVTQDTSLLHRSVRDNIIYGRPDATDAEMVSAAERAEAAGFIPDLSDAKGRRGYDAHVGERGVKLSGGQRQRIAIARVMLKDAPILLLDEATSALDSEVEAAIQESLDKMMDGKTVIAIAHRLSTIAAMDRLVVLDKGRIIEEGTHAELLEKRGLYAKLWAHQSGGFLNEHVEWQHD

SEQ ID NO: 6481 - protein, 194 aa, Neisseria meningitidis
MISRLTGKLVEKNPPQIVIDVNGVGYEADVSMQTFYNLPPVGESVQLFTQLIIREDAHLLFGFATAEERKTFRQLIKVGGIGAKTALGILSAMTADELARAVAEEDVKRLSSAPGIGKKTAERMVLELRGKLVAHTVTDGLFAAAPAADETEDIVSTLLALGYSEREAKAAVKGVPEGTDVGEGVRLALKNLLK

SEQ ID NO: 6482 - protein, 108 aa, Neisseria meningitidis; identical to SEQ ID NO: 3494

SEQ ID NO: 6483 - protein, 239 aa, Neisseria meningitidis
MTLTRKTLFLLTAAFGTHSLQTASADAVVKAEKLHASANRSYKVAGKRYTPKNQVAEFTQTGNASWYGGRFHGRKTSGGERYDMNAFTAAHKTLPIPSYVRVTNTKNGKSVIVRVNDRGPFHGNRIIDVSKAAAQKLGFVNQGTAHVKIEQIVPGQSAPVAENKDIFIDLKSFGTEHEAQAYLNQAAQNFAVSSSGTNLSVEKRRYEYVVKMGPFTSQERAAEAEAQARGMVRAVLTAG

SEQ ID NO: 6484 - protein, 154 aa, Neisseria meningitidis
MFTIVLYQPEIPPNTGNIIRLCANTGADLHLVKPLGFPLDSAKMKRAGLDYHEFASLTVHENFDDCLKALAGRRIFALTTKGTARPDETAFQKGDVLLFGPETRGLPADILDSLPAAQKIRLPMQPGSRSMNLSNTVAVILFEAWRQHGYAGGV

SEQ ID NO: 6485 - protein, 241 aa, Neisseria meningitidis
MDFLSRWRRIADAPTIRRCVLCHGSSGVSDGICAGCRDDLAAYRTDAANSCPLCFRHIQGGSVCGGCQKKPPAFDRMWASLHYEPPVSNMIHALKHLADLSMVQPLADLMMQNPPDRLADECFDFVLPVPLSRERLLQRGFNQSESIVGLLAQRYGWQILPRHTVFRHHRPPQSTLKGGERRRNIKNAFEIRTPIPENCNILLIDDVFTTGATLDELAKTLKKSGANRICCWTLARTPMKK

SEQ ID NO: 6486 - protein, 249 aa, Neisseria meningitidis
MPDAVKKVYLIHGWGANRHMFDDLMPRLPATWPVSAVDLPGHGDAPFVRPFDIAAAADGIAAQIDAPADILGWSLGGLVALYLAARHPDKVRSLCLTASFARLTADEDYPEGLAAPALGKMVGAFRSDYAKHIKQFLQLQLLHTPDADGIIGRILPDLARCGTPQALQEALDAAERADARHLLDKIDVPVLLVFGGKDAITPPRMGEYLHRRLKGSRLVVMEKAAHAPFLSHAEAFAALYRDFVEGGLR

SEQ ID NO: 6487 - protein, 262 aa, Neisseria meningitidis
MNHQDARWQVHRHLAEHTDQRLTLVRNAPKHILLAGADADISRSLLAKRYPQAVFEEYDSRADFLAAAAAARKGGFWQRFTGKGVVQHCQSPIAPLPEACADMLWSNLGLLAAEQILPVLHNWARALKTDGLLFFTCFGRDTLAELKCRLKENGIESRSALFPDMHDLGDMLAENGFYDPVTDTAKLVLDYKKAETFWADMDTLGVWRAMAWNDENAARSCVGTIFEREGGLGITLETVYGHAVKKLMLPQGENVVQFFPKR

SEQ ID NO: 6488 - protein, 98 aa, Neisseria meningitidis
MNKKLNYIFMLDCLGLVILFTCIIATFERDYGFKIFTNSKRPEFYYWIGMFYYGIISCWFDYQLISTKANSYKRKVKQYKIFSVIFSVLIFISTIVKL

SEQ ID NO: 6489 - protein, 141 aa, Neisseria meningitidis
MYWERGLHMYKASAVVPTGYVRVGNTAPLVGEDTQRYASFWGDGYDVYRQLRWQQIPEKQRKAFKKAAKSKKTVMFAGREYGISKQNLSDVWDDFEDAMELKAFPCLSSLFLTKWHKNLYDSGLTKTSTALPRLSSKRTIL

SEQ ID NO: 6490 - protein, 766 aa, Neisseria meningitidis
MHRPTAKQILHEVFGYPEFRGRQEAVINTLAGGGSLTVLMPTGGGKSLCYQIPALMREGVAVVVSPLIALMNDQVANLHAAGIEAAAVNSGTSADEAREIADRLAQGRLKLLYVAPERLVTDRFLRFLDQQTVSLFAIDEAHCVSQWGHDFRPEYQQLGMLAERYPNVPRIALTATADAATRADIKHYLHLDDAPEFVSSFDRPNIYYQVIEKNNGKKQLLDFIRKEMTGQSGIVYCLSRKKVEDVAQFLRENGLNAIPYHAGLSMDVREENQRRFTHEDNIIVVATVAFGMGIDKPDVRFVAHLDMPQSVEHFYQESGRAGRDGLPAASWLCYGLNDWVLLRERIAEGNSDEVQKQIEMQKLDAMLAVCETAACRRVLLLKHFGEASEPCGHCDNCLHPPVRFDGTVLVQKLLSCVYRAGQRFAAGYITNILRGKSDDWIRGNRHEQLSTFGIGTELSDKEWRSVIRQCISLGYLTVNITRYQALQLTEAAKKVLKGETEVMLRPLKRDKPAARTLKDNWLRTEREERLWQALRVWRMKQAEAEGIPAYMIFGDKTLRDLVEKMPQDLNGLHDIYGLGEAKIDRFGHGILEVCRNAAGFSRDAVIRPQTEREQQLRQKLEAWRYEQARAENCALHAVLSDESLADMLADTPETETDLEGVYGLGSVRAAKYGRDILAVCRPFSDGIDETAKRKRRLMRALIQWCGETAKHEQSEPYRILSKAALRAIAAKQPEGLAELAAVYGVGEEKAARYGAAVLAVLERNAV

SEQ ID NO: 6491 - protein, 260 aa, Neisseria meningitidis
MTDILNKILATKAQEVAAQKAAVNAEHIRTLAAEAAPVRSFIDSIRGKHRLNLPAVIAEIKKASPSKGLIRPDFRPAEIARAYENAGAACLSVLTDEPYFQGSPEYLKQAREAVSLPVLRKDFIIDEYQVYQARAWGADAVLLIAAALEQEQLERFEAVAHELGMTVLLELHDETELEKCRNLTTPLWGVNNRNLRTFEVSLDQTLSLLPALEGKTVVTESGITGKADVEFMQSRGVHTFLIGETFMRADDIEAEVGKLF

SEQ ID NO: 6492 - protein, 318 aa, Neisseria meningitidis; identical to SEQ ID NO: 1996

SEQ ID NO: 6493 - protein, 513 aa, Neisseria meningitidis
MMNMLGALAKVGSLTMVSRVLGFVRDTVIARAFGAGMATDAFFVAFKLPNLLRRVFAEGAFAQAFVPILAEYKETRSKEAAEAFIRHVAGMLSFVLVIVTALGILAAPWVIYVSAPGFAQDADKFQLSIDLLRITFPYILLISLSSFVGSVLNSYHKFGIPAFTPTFLNVSFIVFALFFVPYFDPPVTALAWAVFVGGILQLGFQLPWLAKLGFLKLPKLSFKDAAVNRVMKQMAPAILGVSVAQVSLVINTIFASYLQSGSVSWMYYADRMMELPSGVLGAALGTILLPTLSKHSANQDTEQFSALLDWGLRLCMLLTLPAAVGLAVLSFPLVATLFMYREFTLFDAQMTQHALIAYSFGLIGLIMIKVLAPGFYARQNIKTPVKIAIFTLICTQLMNLAFIGPLKHVGLSLAIGLGACINAGLLFYLLRRHGIYQPGKGWAAFLAKMLLSLAVMCGGLWAAQAYLPFEWAHAGGMRKAGQLCILIAVGGGLYFASLAALGFRPRHFKRVEN

SEQ ID NO: 6494 - protein, 232 aa, Neisseria meningitidis; identical to SEQ ID NO: 3264

SEQ ID NO: 6495 - protein, 334 aa, Neisseria meningitidis
MQRQIKLKNWLQTVYPERDFDLTFAAADADFRRYFRATFSDGSSVVCMDAPPDKMSVAPYLKVQKLFDMVNVPQVLHADTDLGFVVLNDLGNTTFLTAMLQEQGETAHKALLLEAIGELVELQKASREGVLPEYDRETMLREINLFPEWFVAKELGRELTFKQRQLWQQTVDTLLPPLLAQPKVYVHRDFIVRNLMLTRGRPGVLDFQDALYGPISYDLVSLLRDAFIEWEEEFVLDLVIRYWEKARAAGLPVPEAFDEFYRWFEWMGVQRHLKVAGIFARLYYRDGKDKYRPEIPRFLNYLRRVSRRYAELAPLYALLVELVGDEELETGFTF

SEQ ID NO: 6496 - protein, 758 aa, Neisseria meningitidis
MSEPIQPTSLSLGSTCLFCSNESGSPERTEAAVQGSGEASIPEDYTRIVADRMEGQSQVQVRAEGNVVVERNRTTLNTDWADYDQSGDTVTAGDRFALQQDGTLIRGETLTYNLEQQTGEAHNVRMEIEQGGRRLQSVSRTAEMLGEGHYKLTETQFNTCSAGDAGWYVKAASVEADREKGIGVAKHAAFVFGGVPIFYTPWADFPLDGNRKSGLLVPSLSAGSDGVSLSVPYYFNLAPNLDATFAPSVIGERGAVFDGQVRYLRPDYAGQSDLTWLPHDKKSGRNNRYQAKWQHRHDISDTLQAGVDFNQVSDSGYYRDFYGNKEIAGNVNLNRRVWLDYGGRAAGGSLNAGLSVLKYQTLANQSGYKDKPYALMPRLSVEWRKNTGRAQIGVSAQFTRFSHDSRQDGSRLVVYPDIKWDFSNSWGYVRPKLGLHATYYSLNRFGSQEARRVSRTLPIVNIDSGATFERNTRMFGGEVLQTLEPRLFYNYIPAKSQNDLPNFDSSESSFGYGQLFRENLYYGNDRINTANSLSAAVQSRILDGATGEERFRAGIGQKFYFKDDAVMLDGSVGKKPRNRSDWVAFASGSIGSRFILDSSIHYNQNDKRAENYAVGASYRPAQGKVLNARYKYGRNEKIYLKSDGSYFYDKLSQLDLSAQWPLTRNLSAVVRYNYGFEAKKPIEVLAGAEYKSSCGCWGAGVYAQRYVTGENTYKNAVFFSLQLKDLSSVGRNPADRMDVAVPGYITAHSLSAGRNKRP

SEQ ID NO: 6497 - protein, 348 aa, Neisseria meningitidis
MMKIKALMIAAALLAAADVHAAPQKAKTASAKAAKAAKAAKVAKVAKVAKVAATAQKEAAPAQQQGGIRFSDGIAAVADNEVITRRRLAEAVAEAKANLPKDAQISESELSRQVLMQLVNQSLIVQAGKRRNIQASEAEIDAVVAKNPALKNLSPAQRRDFADNIIAEKVRQQAVMQNSRVSEAEIDAFLEQAQKQGITLPEGAPLRQYRAQHILIKADSENAAVGAESTIRKIYGEARSGTDFSSLARQYSQDASAGNGGDLGWFADGVMVPAFEEAVHALKPGQVGAPVRTQFGWHIIKLNEVRDAGTPQERIRNSVRQYIFQQKAEQATVNLLRDLHSGAYVDIR

SEQ ID NO: 6498 - protein, 626 aa, Neisseria meningitidis
MNIFYEESGQFKIAAIIQKNDATYQVDTPHGKRTKVKANNVFAEFDGDMAAFLENAQAQAADIDTDLLWEVCGEEEFTAEAIAEEYYGHAPTKTELAATLIALYAAPMYFYKKAKGVFKAAPEETLKQALAAIERKKQQDAQIDAWAEALKRGEMPSEIAADLKTILHAPDKQSLTYKAFTKAADALKTSAYELAKKTGGITSIPQYLQDGFEIKYFPKGTGFPDLALPEMPDLPKADVTAFSIDDESTTEVDDALSLTDLDNGTKRVGIHIAAPSLAVKPGDKMEKNIMERLSTVYFPGGKITMLPENWIAAFSLDAGAHRPAVSIYFDVDGEFNVGAPTCKIEAVNIATNLRIQAIEPHFNAETGLDEAGEMMFAHHQDLIWFYQFATALQKARGKYEPDRAPQYDYSIELDEEGKVSVVRRERGSPIDTLVSEMMILANSTWAQMLHDNDLPGLFRVQPTGKVRMSTKSEPHIGMGVQHYGWFTSPLRRAADYINQKQLISLIDDTAEPLYQNSDAELFAALRDFDAAYTAYADFQRQMEAYWSLVYLQQQGTSELTATILKEDLVRIEGLPLVTRATGIPFDALPKSQALFKITELDAEKQFVSLNYIKAVAPAGTTAGNAV

SEQ ID NO: 6499 - protein, 210 aa, Neisseria meningitidis
MENTNRVPEQARYDAERRQADEALAGVFPAVSIFGSARTPQNHADYAFACRLARRLSDSGIAVISGGGPGIMEAANKGAFAGKSVSVGLNIVLPHEQKPNPYQDIALRFSRFAERKAVFFRYSQAYVVMPGGFGTLDELFEILTLVQTGKVPPRPIVLVGKAFWSGLAEWINAQLLARGLISEGAVSLFAISDDEDEIVAYLSEHGLQTA

SEQ ID NO: 6500 - protein, 456 aa, Neisseria meningitidis
MINPIASLSPLDGRYAQSVEALRPIFSEYGLMKARVKVELNWLKALAAEPKIAEVPPFSAETLAEIDTVIENFSLEDAAAVKAIEATTNHDVKAIEYWLKKRFAEVPEVAAVSEFIHFACTSEDINNLSHALMLQEAREAVLLPKLAEIIEKLTAMAHDLAAVPMMSRTHGQPATPTTLGKETANVVYRLQRQFKNLQAQEFLGKINGAVGNYNAHMVAYPDVDWETHCRNFVEISLGLTFNPYTIQIEPHDYMAEFFQTLSRINTILIDFNRDVWGYISLGYFKQKVKAGEVGSSTMPHKVNPIDFENSEGNLGMANAVLGFLSEKLPISRWQRDLTDSTVLRNMGVGVGYAVLGFAAHLRGLNKLEPNPAALAADLDATWELLAEPIQTVMRRYGVANPYEKLKDLTRGKGGITPEVLKGFIGLLEIPAEAKAKLLELTPALYVGKAEALAKRI

SEQ ID NO: 6501 - skipped

SEQ ID NO: 6502 - protein, 204 aa, Neisseria meningitidis
MNFTRLLNQVLSTVQKKGNTFSDSPLNSFGGGALVAGVASMLLNGKNRKTITKIGSTAALGYLAYRGYQMWQQNKGRATVTQSDFQPAGETEETYSRTVLRTMIAAAASDGMIDEAERRTIEQESGTDPETAAWLAAEYRLPASIEDIAAAVGNDEALAAEAYLAARLVCADLSRKETVFLARLSQALKLDDNLVESLERQLGF

SEQ ID NO: 6503 - protein, 716 aa, Neisseria meningitidis
MLTDLEKNAIRDHYQNIGKNLPGFRPRASQREMIAAVANAFSRTLAREEGGEPPKREGESIAVIEGPTGVGKSLAYLLAGGIMAQTRGKRLIVSSATVALQEQLVDRDLPFLVEKSGLELTFALAKGRGRYLCPYKLYRLTQSNAQQNLLGFEAPAVLWDSKPKPEELKLLRDIADEFSARRFNGDRDTWPEKIDDAIWLKVTNDRHGCLKTACPNRPECPFYLARDVLETVDVVVANHDLLLADISMGGGVILPAPENSFYCIDEAHHLPKKALSRFAAEHSWNIAVWTLEKLPQLTGKIAALTDKAELANLADEAAASLLDSLHEWQFHLAEEPSLSLGVSENDRRTNSEPTWLWEDGKIPEGLETTVSNTAIAARSLLKHVIGLNDALSAARREKEQDGALLDRLTSEFGLFIARIEQISAVWDLLSTVPLEGEEPLAKWITRRADDKNDYIFNASPISSASHLANSLWRRAAGAVLTSATLQSLGNFNLMLRQTGLQWLPETTTLALKSPFDFEKQGELYIPPIYASPKDPEAHTAAVIEWLPKLISPTEAIGTLVLFSSRKQMQDVALRLPGDYLPLLLVQGELPKAVLLQKHHRAIEEGKASIIFGLDSFAEGLDLPGTACVQVIIAKLPFAMPDNPIEKTQNRWIEQRGGNPFIEITVPEAGIKLIQAVGRLIRTEQDYGRVTILDNRIKTQRYGQQLLAGLPPFKRIG

SEQ ID NO: 6504 - protein, 76 aa, Neisseria meningitidis
MGGEVNRADVVGFLVAAFEIPVVALDCGYVAVPVVGRRGNRMRPLPCAADDGLAAFFAGDGNGVGLGGGDLGIPDD

SEQ ID NO: 6505 - skipped

SEQ ID NO: 6506 - protein, 303 aa, Neisseria meningitidis
MDTLFSLKVFRQVVQSGGFTRAADALGISTAMASKHVSHLENTVQAKLLHRNSRNLSLTEAGEEYYRQCSYALDTLDDAAQKAAGGTEKPQGLLRVTMPLWFAGSQICNWLAEYRERYPEVALELILDNRHVDLIAEGVDLALRVSQTLSPSLIARPLAEIEFALLASPDFLRRNGVPETPEEVAGLPAVLPTYTNQQKLDLTRKSDGKKYRLELTPVIRTDNTLMMREMIKAGACIGYQPLWAAEHDLRCGTLVRLLPGYAVPTDRLNAVYADRAFLSAKVRSFIDFLNEKIASRKGCRNAV

SEQ ID NO: 6507 - protein, 132 aa, Neisseria meningitidis
MSDCCNRIQPVLLSVLRIVTAYLFLLHGTSKIFAFPIEMGSGSPGGLLLLAGILEIVGGILLVLGLFARPAAFVLSGQMAVAYFMAHASGNALFPIANGGESAVLFCFVFLYIAAAGGGAWSLDRLFFKRKA

SEQ ID NO: 6508 - protein, 201 aa, Neisseria meningitidis
MTRQSLQQAAESRRSIYSLNKNLPVGKDEVVQIVEHAVLHTPSSFNSQSARVVVLFGEEHDKVWQFVEDALRAVVPADSFEPTAQKLNLFKAGAATILFYEDQNVVKGLQEQFPAYAANFPVWADQANAMVQYAVWTTLAAVGVGANLQHYNPLPDAAIAKAWNIPENWLLRAQMVIGGIEGAAGEKTFEPVAERLKVFGA

SEQ ID NO: 6509 - protein, 703 aa, Neisseria meningitidis; identical to SEQ ID NO: 3590

SEQ ID NO: 6510 - protein, 231 aa, Neisseria meningitidis
MKLKTLALTSLTLLALAACSKQAETSVPADSAQSSSSAPAAPAELNEGVNYTVLSTPIPQQQAGKIEVLEFFGYFCPHCAHLEPVLSEHIKTFKDDTYMRREHVVWGDEMKPLARLAAAVEMAGESDKANSHIFDAMVNQKINLADTDTLKKWLSEQTAFDGKKVLAAFEAPESQARAAQMEELTNKFQISGTPTVIVGGKYQVEFKDWQSGMTTIDQLVDKVREEQKKPQ

SEQ ID NO: 6511 - protein, 456 aa, Neisseria meningitidis
MLDNLTGRFSNVFKNIRGQAKLTEDNIKEALREVRLALLEADVALPVVKEFINNVKEKALGQEVAGSLTPDQAFIGVVNKALTELMGRENKTLDLSVAPPAVVLMAGLQGAGKTTTVGKLARLLKNDQKKKVLVVSADVYRPAAIEQLRLLAEQVGVDFFPSDTNQKPVEIATAAVDYAKKHFYDVLMVDTAGRLAIDEEMMNEIKALHAAVNPVETLFVIDAMLGQDAVNTAQAFNEALPLTGVVLTKMDGDSRGGAALSVRHVTGKPIKFIGVGEKINGLEPFHPDRLAGRILGMGDVLTLIEDVQKGIDEEAAAKMAKKLHKGKGFDLNDFKEQIQQMRNMGGLENLMSKMPGELGQISKQIPEGTAEKAMGKVEAIINSMTPKERANPALLKASRKRRIAMGAGTTVQEVNKLLKQFEQMQQMMKMFSGNGLGKLMRMAKGMRGIKGMFPGL

SEQ ID NO: 6512 - protein, 268 aa, Neisseria meningitidis
MPTVFIFLTAVYAGLGAFAWHCQQQGCGRDYPWKTELPVLGAALTVHGAALLMPVIQDKIIIMGFGYSGSLIVWMMLFIYFAGSFFYPLRGVQLLLYPCAALMLLSGLVFPGKFSGYEITDLPFMLHIGTSLLAYGLFGIATLLSVLTLLLNRSLHRRSFSKLAGFLPSLLSLEKLMFQAMWAGFILLTYSVVSGTFFAEAVFGKPMTFTHKTVFGILSWLIYGGLLLKHSMTAWRGKKAAVWTIIGFVSLMIAYMGSKFVLEIILKR

SEQ ID NO: 6513 - protein, 32 aa, Neisseria meningitidis
MPSESPSFRQHIHKGAPAGGGRGKDCWRRRSI

SEQ ID NO: 6514 - protein, 61 aa, Neisseria meningitidis
MTNFPKKIPLKALTVFPCGRIVRFFAAAEVADELKSIAQNVGDIERYLDRRKEYFIIRNAL

SEQ ID NO: 6515 - protein, 148 aa, Neisseria meningitidis
MSVMAGRHPYGVRSGLRRNGLKLWDIHFRMTRFIVARCGLLFATLKGKTMKKMFVLFCMLFSCAFSLAAVNINAASQQELEALPGIGPAKAKAIAEYRAQNGAFKSVDDLTKVKGIGPAVLAKLKDQASVGAPAPKAPAKPVLPADKK

SEQ ID NO: 6516 - skipped

SEQ ID NO: 6517 - protein, 68 aa, Neisseria meningitidis
MFDGAKVVRRVEGNLWVFGMVALEKTCFKGQMPSENRFQTAFSVYLKQTGKGSNILQSSYSHKRFIVN

SEQ ID NO: 6518-6519 - skipped (2 entries)

SEQ ID NO: 6520 - protein, 85 aa, Neisseria meningitidis
MTTQMGASRDVSKSAKGWSVGIGLNVGKQLTDSVGLEFDPYYRHKTIYKPREIVLDGDKTKMGRSKSNEYGFRVAATFYSQLKSK

SEQ ID NO: 6521 - protein, 52 aa, Neisseria meningitidis
MLKTKRTHCLKKDLMGMRVFPTLFPFIYPHYRKKNMKKPCLHSHLQPCPPLR

SEQ ID NO: 6522 - protein, 64 aa, Neisseria meningitidis
MLLQRSLLVYEILPDVKAESAAGVFCTGLSWKWENGCSVQVCPNEWRVLFLSICFFLFEIKFLK

SEQ ID NO: 6523 - protein, 351 aa, Neisseria meningitidis
MTHHYPTDDIKIKEVKELLPPIAHLYELPISKEASGLVHRTRQEISDLVHGRDKRLLVIIGPCSIHDPKAALEYAERLLKLRKQYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAEHVSEAAEQLRAAGVTDKLMIDCSHANSRKDYTRQMEVAQDIAAQLEQDGGNIMGVMVESHLVEGRQDKPEVYGKSITDACIGWGATEELLALLAGANKKRMARAS

SEQ ID NO: 6524 - protein, 162 aa, Neisseria meningitidis
MLKITLIAACAENLCIGAGNAMPWHIPEDFAFFKAYTLGKPVIMGRKTWESLPVKPLPGRRNIVISRQADYCAAGAETAASLEAALALCAGAEEAVIMGGAQIYGQAMPLATDLRITEVDLSVEGDAFFPAIDRTHWKEAERTERRVSSKGTRYAFVHYLRY

SEQ ID NO: 6525 - protein, 158 aa, Neisseria meningitidis
MPIEIERRFLIGNDNWRQYADEPLLLRQGYLSVEKERTVRVRIAGKQAWLTLKGYISEISRSEFEYEIPLADAEKMMETMCPFKMEKWRYPVRWGGSLFEIDVFLGDNAPLVVAEIELPDENADFDRPDWLGREITADGMFTNAYLSRHPFSSWKNAV

SEQ ID NO: 6526 - protein, 142 aa, Neisseria meningitidis; identical to SEQ ID NO: 760

SEQ ID NO: 6527 - protein, 81 aa, Neisseria meningitidis
MLKSIELNSHIRNRLAEYLKGRGMDFQTAMQEEKGNKEIAAIVHSGLPTLVRKLYSEQKMQKFFWEKRDLIADYISRRMQG

SEQ ID NO: 6528 - skipped

SEQ ID NO: 6529 - protein, 488 aa, Neisseria meningitidis
MVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIAAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 6530 - protein, 322 aa, Neisseria meningitidis
MKLTLAIPSLNLDEDEIRIPLCLHAFNKILQYGSLHRQSCTASAFYARYLWCGRLVERAAQSLNMPSEAVALATPVWQKMGMHQANVLTAEYLNVGTDEAERICRDLSAFYGDIPWRFVPVLPELWLVSLPCAYRWGAKPVLDLGGLLGADDQPDGEDALEWLRVQTEIQMWLAAHPVNHNRKKRGLPELNGLWLWDGTNGGAQGGTLFADTVWSRFHSDRRALPDNFRAYEETAAHLPDTHHILFMDDLRLTALTGDRERYAAILQQWEERWFAPIYEAVRTGKIKRLDITTDGQHGGTLTFKPADRWKFWRGAKTFDGIW

SEQ ID NO: 6531 - protein, 430 aa, Neisseria meningitidis; identical to SEQ ID NO: 2220

SEQ ID NO: 6532 - protein, 228 aa, Neisseria meningitidis; identical to SEQ ID NO: 262

SEQ ID NO: 6533 - protein, 157 aa, Neisseria meningitidis
MSRNNEELQGISLLGNQKTQYPTGYAPEILEAFDNKHPDNDYFVKFVCPEFTSLCPMTGQPDFATIYIRYIPHIKMVESKSLKLYLFSFRNHGDFHEDCVNIIMKDLIALMDPKYIEVFGEFTPRGGIAIHPFANYGKAGTEFETLARKRLFEHDAQ

SEQ ID NO: 6534 - protein, 384 aa, Neisseria meningitidis
MDTHTDETKLQNTQAKRKRRLTALTLLFALAAAAAGSAFFLWWQHEEETEDAYVAGRVVQVTPQKGGTVRKVLHDDTDAVKKGDVLAVLDDDNDVLAYERAKNELVQAVRQNRRQNAATSQAGAQVALRRADLARAQDDLRRRSALAESGAVSAEELAHARAAVSQAQAAVKAALAEESSARAALGGQVSLREQPAVQTAIGRLKDAWLNLQRTQIRAPADGQVAKRSVQVGQQVAAGAPLMAVVPLSDVWVDANFKETQLRHMKIGQPAELVSDLYGKQIVYRGRVAGFSAGTGSAFSLIPAQNATGNWIKVVQRVPVRIVLNREDVDRHPLRIGLSMTVKVDTSAAGAPVSKTPGAALPEMESTDWSEVDRTVDEILGQSAP

SEQ ID NO: 6535 - protein, 508 aa, Neisseria meningitidis
MDYPPLKGAALAWVTLSLGLAVFMEVLDTTIANVAVPVIAGNLGAATTQGTWVITSFSVANAVSVPLTGFLAKRIGEVKLFTAAAVGFVITSWLCGIAPNLQSLVVFRILQGFIAGPLIPLSQSLLMASYPPAKRTLALALWAMTVVVAPVLGPILGGWISGNWHWGWIFFINIPIGIISAWITWKHLKYRETETVKMPTDYVGLTLMVVGIGALQMMLDRGKELDWFASGEIITLGVVALVCLSYFIVWELGEKYPIVDLSLFKDRNFTVGVIATSLGFMVYMGTLTLLPLVLQTNLGYTSTWAGLAAAPVGILPVFLSPLIGRFGNKIDMRLFVTASFLTFAFTFYWRTDFYADMDIGNVIWPQFWQGVGVAMFFLPLTTITLSHMKGGQIAAAGSLSNFLRVLMGGVGVSVVSTLWERREALHHTRFAEHITPYSATLHETAAHLSQHGVSDIQTLGIINNTITQQGFIIGSNEIFMAGSLLFIIMIPVIWLAKPPFHNGGGGGH

SEQ ID NO: 6536 - protein, 49 aa, Neisseria meningitidis
MQQFPKSAIIAPHLFRTCKRSTDATIGRIIRAKQPFFFKTLELTLFFVV

SEQ ID NO: 6537 - protein, 77 aa, Neisseria meningitidis
MARVCKVTGKRPMSGNNVSHANNKTKRRFLPNLQSRRFWVESENRWVRLRVSNAALRTIDKVGIDVVLADLRARGEA

SEQ ID NO: 6538 - protein, 51 aa, Neisseria meningitidis
MRDKIKLESSAGTGHFYTTTKNKRTMPGKLEIKKFDPVARKHVVYKETKLK

SEQ ID NO: 6539 - protein, 394 aa, Neisseria meningitidis
MSLHSDILVVGAGPAGLSFAAELAGSGLKVTLIERSPLTVLQNPPYDGREIALTHFSREIMQRLGMWDKIPENEIYPLRDAKVLNGRSDYQLHFPQPTEARGEPADCLGYLISNHNIRRAAYEVVSQLDNVSILTDTVVKEVKTSDNEAQVILENGKILTARLLLAADSRFSQTRRQLGISSDMHDYSRTMFVCRMKHTLSNQHTAYECFHYGRTIALLPLEEHLTNTVITVDTDKINSVQNLSPEELAASVKEQLKGRLGDMELVSSIHHYPLVGMIAKRFYGKRSALIGDAAVGMHPVTAHGFNLGLSSADILAKLILEAEQRGQDIGASSLLEKYSSKHMLHAHPLYHGTNMMLKLFTNETAPAKLLRGLVLRASNNFPPLKKLITKQLTG

SEQ ID NO: 6540 - protein, 90 aa, Neisseria meningitidis
MASKKAGGSTRNGRDSEAKRLGVKAYGNELIPAGSIIVRQRGTKFHAGDNVGMGKDHTLFAKVDGYVEFKTKGALNRKTVSIRPYTGSEE

SEQ ID NO: 6541 - protein, 102 aa, Neisseria meningitidis
MYAVVKTGGKQYKVSVGEKLKVEQIPAELDSQIELTEVLMIADGESVKVGAPFIEGAKVTAKVVAHGRGEKVRIFKMRRRKHYQKRQGHRQNFTQIEIVAIA

SEQ ID NO: 6542 - protein, 324 aa, Neisseria meningitidis
MLENLPYFQRHLPEDLAKVNEVINRAVQSDVALISQIGTYIISAGGKRLRPIMTILAGKAVGYDDEKLYSLAAMVEFIHTSTLLHDDVVDESDLRRGRATANNLFGNAAAVLVGDFLYTRAFQLMVASGSMRVLEVMADATNIIAEGEVMQLMNIGNTDITEEQYIQVIQYKTAKLFEAAAQVGAILGKASPEHERALKDYGMYVGTAFQIIDDVLDYSGETEETGKNVGDDLAEGKPTLPLIYLMRQGSEQVANDVRTALENADRSYFEKIHDYVVRSDALAYSIGEARKAVDCAVTALDALPDSEVKDAMIQLAKESLVRVS

SEQ ID NO: 6543 - skipped

SEQ ID NO: 6544 - protein, 34 aa, Neisseria meningitidis
MLREVSDIRPFSVGGLFCHLKTFSSCLKNRPLGR

SEQ ID NO: 6545 - protein, 558 aa, Neisseria meningitidis
MSVGLLRILVQNQVVTVEQAEHYYNESQAGKEVLPMLFSDGVISPKSLAALIARVFSYSILDLRHYPRHRVLMGVLTEEQMVEFHCVPVFRRGDKVFFAVSDPTQMPQIQKTVSAAGIEVELVIVEDDQLAGLLDWVGSRSTSLLQELGEGQEEEESHTLYIDNEEAEDGPVPRFIHKTLSDALRSGASDIHFEFYEHNARIRFRVDGQLREVVQPPIAVRGQLASRIKVMSRLDISEKRIPQDGRMQLTFQKGGKPVDFRVSTLPTLFGEKVVMRILNSDAASLNIDQLGFEPFQKKLLLEAIHRPYGMVLVTGPTGSGKTVSLYTCLNILNTESVNIATAEDPAEINLPGINQVNVNDKQGLTFAAALKSFLRQDPDIIMVGEIRDLETADIAIKAAQTGHMVFSTLHTNNAPATLSRMLNMGVAPFNIASSVSLIMAQRLLRRLCSSCKQEVERPSASALKEVGFTDEDLAKDWKLYRAVGCDRCRGQGYKGRAGVYEVMPISEEMQRVIMNNGTEVDILDVAYKEGMVDLRRAGILKVMQGITSLEEVTANTND

SEQ ID NO: 6546 - protein, 69 aa, Neisseria meningitidis
MTESRQTRLQVKCPTCQTAVVWKPENAFRPFCSQRCKLIDLGGWADGKYTVSGQTESLPEISEPDMAYR

SEQ ID NO: 6547 - protein, 210 aa, Neisseria meningitidis
MTVWVGLTGGIGSGKSAAAQCFADLGVPRIDADAAAHSLTASDGIALPEIRRLFGDTVFDTQGLLRRDILRKEVFASPSRKALLESVMLPLIFSEIKKQQETFTDAAYGIVEIPLLTEKRQFISLIRRVLTISAPVEKRIGRVMARSGLTRGEVAAVISHQASESERLLLADDVLLNDGSLKSLREKTMRLHAFYSGIFASKPTQGKHND

SEQ ID NO: 6548 - protein, 286 aa, Neisseria meningitidis
MSDLSVLSPFAVPLAAVFGLLVGSFLNVVIYRVPVMMERGWTVFAKEYLNLPLTEEESRTFNLMKPDSCCPKCRVPIRAWQNIPIVSYLLLRGKCASCQTKISIRYPLIELLTGVLFGLVAWQYGWSWITLGGLVLTAFLISLTFIDADTQYLPDSMTLPLIWLGLIFNLDGGFVPLQSAVLGAVAGYGSLWLLCAVYKLLTGKTGMGNGDFKLIAALGAWLGISALPVLIFVSSLIGLVAAIVMRVAKGQHFAFGPALTVSGWIIFTANDSVWRAVNWWLTHPVL

SEQ ID NO: 6549 - protein, 410 aa, Neisseria meningitidis
MAKNGGFSLFAKKEKRFIFEGRHSASDKLVNGEVSAFTEEEARKKLAKRGIRPLQITRVKTSSKRKITQEDITVFTRQLSTMIKAGLPLMQAFEIVARGHGNPSMTEMLMEIRGEVEQGSSLSRAFSNHPKYFDRFYCNLVAAGETGGVLESLLDKLAIYKEKTQAIRKKVKTALTYPVSVIAVAIGLVFVMMIFVLPAFKEVYANMGAELPALTQTVMDMSDFFVSYGWMVLIALGFAIYGFLKLKARSIKIQRRMDAILLRMPIFGDIVRKGTIARWGRTTATLIAAGVPLVDVLDSTAGAAGNLIYEEATREIRTRVIQGLSMTSGMRATELFPNMMLQMSSIGEESGSLDDMLNKAAEFYEDEVDNAVGRLSAMMEPIIIVILGLVIGTLLVAMYLPLFNLGNVVA

SEQ ID NO: 6550 - protein, 547 aa, Neisseria meningitidis
MNAFTRAWYALERHYQDTRHVLLRDRFACEPDRFERMHERLDGMLFDYSKNRLGEDTLQLLCNLADAADLEGKMRALRTGAKVNGSEGRAALHTALRLPDGADAVYVDGRDVLPEIRRELNRALKFAHSLDDGSYQGITGKRITDFVHIGIGGSDLGPAMCVQALEPFRRHITVHFAANADPACLDAVLCRLNPETTVFCVASKSFKTPETLLNAQAVKAWYRGAGFSESETACHFCAVSADTAAAAAFGIAAERVFAMYDWVGGRYSVWSPVGLPVMVAVGGARFRELLAGAHAMDRHFFSTPTRHNIPVLMALIAVWYNNFQHADGQTAVPYSHNLRLLPAWLNQLDMESLGKSRASDGSPAVCKTGGIVFGGEGVNCQHAYFQLLHQGTRLIPCDFIVPMTAQGREDGRSRFTVANAFAQAEALMKGKTLDEARAELADLPEAERERLAPHKEFPGNRPSNSILIDRLTPYNLGMLMAAYEHKTFVQGAIWNVNPFDQWGVEYGKQLAKTIIGELEGGTSVHDASTEGLMAFYRECRLKGGGAA

SEQ ID NO: 6551 - protein, 273 aa, Neisseria meningitidis
MSLQNIIETAFENRADITPTTVTPEVKEAVLETIRQLDSGKLRVAERLGVGEWKVNEWAKKAVLLSFRIQDNEVLNDGVNKYFDKVPTKFADWSEDEFKNAGFRAVPGAVARRGSFVAKNVVLMPSYVNIGAYVDEGAMVDTWATVGSCAQIGKNVHLSGGVGIGGVLEPLQAAPTIIEDNCFIGARSEIVEGVIVEEGSVISMGVFIGQSTKIFDRTTGEIYQGRVPAGSVVVSGSMPSKDGSHSLYCAVIVKRVDAQTRAKTSVNELLRGI

SEQ ID NO: 6552 - protein, 261 aa, Neisseria meningitidis
MGFLQGKKILITGMISERSIAYGIAKACREQGAELAFTYVVDKLEERVRKMAAELDSELVFRCDVASDDEINQVFADLGKHWDGLDGLVHSIGFAPKEALSGDFLDSISREAFNTAHEISAYSLPALAKAARPMMRGRNSAIVALSYLGAVRAIPNYNVMGMAKASLEAGIRFTAACLGKEGIRCNGISAGPIKTLAASGIADFGKLLGHVAAHNPLRRNVTIEEVGNTAAFLLSDLSSGITGEITYVDGGYSINALSTEG

SEQ ID NO: 6553 - protein, 332 aa, Neisseria meningitidis
MSRPVPAVFGSVFHSQMPVLAYREGKWQPTEWQSSQDLSLAPGAHALHYGSECFEGLKAFRQADGKIVLFRPTANIARMRQSADILHLPRPETEAYLDALIKLVKRAADEIPDAPAALYLRPTLIGTDPVIGKAGSPSETALLYILASPVGDYFKVGSPVKILVETEHIRCAPHMGRVKCGGNYASAMHWVLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKSQERGYAIRKAITDIQYGLAEDKYGWLVEVC

SEQ ID NO: 6554 - protein, 160 aa, Neisseria meningitidis; identical to SEQ ID NO: 2734

SEQ ID NO: 6555 - protein, 389 aa, Neisseria meningitidis
MDNELWIILLPIILLPVFFAMGWFAARVDMKTVLKQAKSIPSGFYKSLDALVDRNSGRAARELAEVVDGRPQSYDLNLTLGKLYRQRGENDKAINIHRTMLDSPDTVGEKRARVLFELAQNYQSAGLVDRAEQIFLGLQDGKMAREARQHLLNIYQQDRDWEKAVETARLLSHDDQTYQFEIAQFYCELAQAALFKSNFDVARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKCEKEAAQTAVELVRRKPDLNGVYRLLGLKLSDMNPAWKADADMMRSVIGRQLQRSVMYRCRNCHFKSQVFFWHCPACNKWQTFTPNKIEV

SEQ ID NO: 6556 - protein, 138 aa, Neisseria meningitidis
MRLLHTMLRVGNLEKSLDFYQNVLGMKLLRRKDYPEGRFTLAFVGYGDETDSTVLELTHNWDTERYDLGNAYGHIAVEVDDAYEACERVKRQGGNVVREAGPMKHGTTVIAFVEDPDGYKIEFIQKKSGDDSVAYQTA

SEQ ID NO: 6557 - protein, 875 aa, Neisseria meningitidis
MPAGRLPRRCPMMTKFTDCTRSNRIQPPTHRGYILKNNRQIKLIAASVAVAASFQAHAGLGGLNIQSNLDEPFSGSITVTGEEAKALLGGGSVTVSEKGLTAKVHKLGDKAVIAVSSEQAVRDPVLVFRIGAGAQVREYTAILDPVGYSPKTKSALSDGKTHRKTAPTAESQENQNAKALRKTDKKDSANAAVKPAYNGKTHTVRKGETVKQIAAAIRPKHLTLEQVADALLKANPNVSAHGRLRAGSVLHIPNLNRIKAEQPKPQTAKPKAETASMPSEPSKQATVEKPVEKPEAKVAAPEAKAEKPAVRPEPVPAANTAASETAAESAPQEAAASAIDTPTDETGNAVSEPVEQVSAEEETESGLFDGLFGGSYTLLLAGGGAALIALLLLLRLAQSKRARRTEESVPEEEPDLDDAADDGIEITFAEVETPATPEPAPKNDVNDTLALDGESEEELSAKQTFDVETDTPSNRIDLDFDSLAAAQNGILSGALTQDEETQKRADADWNAIESTDSVYEPETFNPYNPVEIVIDTPEPESVAQTAENKPETVDTDFSDNLPSNNHIGTEETASAKPASPSGLAGFLKASSPETILEKTVAEVQTPEELHDFLKVYETDAVAETAPETPDFNAAADDLSALLQPAEAPSVEENITETVAETPDFNATADDLSALLQPSKVPAVEENAAETVADDLSALLQPAEAPAVEENVTETVAETPDFNATADDLSALLQPSEAPAVEENAAETVADDLSALLQPAEAPAVEENAAEITLETPDSNTSEADALPDFLKDGEEETVDWSIYLSEENIPNNADTSFPSESVGSDAPSEAKYDLAEMYLEIGDRDAAAETVQKLLEEAEGDVLKRAQALAQELGI

SEQ ID NO: 6558 - protein, 176 aa, Neisseria meningitidis
MKFVSDLLSVILFFATYTVTKNMIAATAVALVAGVVQAAFLYWKYKKLDTMQWVGLVLIVVFGGATIVLGDSRFIMWKPSVLFWLGALFLWGSHLAGKNGLKASIGREIQLPDAVWAKLTYMWVGFLIFMGIANWFVFTRFESQWVNYKMFGSTALMLVFFIIQGIYLSTCLKKED

SEQ ID NO: 6559 - protein, 92 aa, Neisseria meningitidis
MLLATDGEDVHEARMAARPEHLKRLETLKSEGRLLTAGPNPLPEDSNRVSGSLIVAQFESLDAAQAWAEDDPYVHAGVYSEVLIKPFKAVFK

SEQ ID NO: 6560 - protein, 92 aa, Neisseria meningitidis
MPAVDLIRERLQTLDPLVLEIGDESHLHKGHAGNTGGGHYAVLVVSGRFEGVSRLNRQKTVKSLLKDLFSGGMIHALGIRAATPDEYFHTAD

SEQ ID NO: 6561 - protein, 288 aa, Neisseria meningitidis; identical to SEQ ID NO: 3334

SEQ ID NO: 6562 - protein, 252 aa, Neisseria meningitidis; identical to SEQ ID NO: 298

SEQ ID NO: 6563 - protein, 163 aa, Neisseria meningitidis
MRAVIQKTVGAKVDVVSEAGTETCGKIDGGFVVLLGVTHSDTEKDARYIADKIAHLRVFEDEAGKLNLSLKDVGGAVLLVSQFTLYADAASGRRPSFSQAAPAEQAQQLYLRTAELLRGHGIHVETGRFRTHMQVSLCNDGPVTILLDSFMTRISPKMKVVPD

SEQ ID NO: 6564 - protein, 336 aa, Neisseria meningitidis
MNDNTHTLPPRHLSVAPMLDWTDRHYRYLARQITRNTWLYSEMVNAGAIVYGDKDRFLMFNEGEQPVALQLGGSDPSDLAKAAKAAEAYGYNEVNLNCGCPSPRVQKGSFGACLMNEVGLVADCLNAMQDAVKIPVTVKHRIGVDRQTEYQTVADFVGTLRDKTACKTFIVHARNAWLDGLSPKENRDVPPLKYDYVYRLKQEFPGLEIIINGGITTNEAIAGHLQHVDGVMVGREAYHNPMVMREWDRLFYGDTRSPIEYADLVQRLYTYSQAQIQAGRGTILRHIVRHSLGLMHGLKGARTWRRMLSDATLLKDNDGSLILEAWKEVERANMRE

SEQ ID NO: 6565 - protein, 295 aa, Neisseria meningitidis
MYTGRFAPSPTGLLHIGSLLTAVASYADARAHGGKWLIRMEDLDPPREMPGAASHILHTLEAFGFEWDGEVAYQSRRYALYEETLCRLKTAGLVYPCHCSRKDWQAGARRGADGFVYNGRCRHPGQRPALQGKQPAWRIRVPDRIIGFSDGIVGGYAQNLARDIGDFVLLRADGYWAYQLAVVADDAEQGVTHIVRGQDLLVSTPRQIYLQQCLDVPTPQYAHLPLLTNAQGQKWSKQTLAPALDLNRREQLLRQVFRYLKLPEAPETDRPAELLDWAVAHWDMDKVPKHAVTAP

SEQ ID NO: 6566 - protein, 150 aa, Neisseria meningitidis
MAKAIEIISPNEIYSDLIFKDPVPPHTIEYKMINLELKAINLYDCAFEDFVPEIKDNFCVGIDLDIGTDDSDAADIFSVRICSPKWILHNCFQNQRVKWGAGMMIMNEFNHSVIKSEIEKILKECSKETWEKSLTYLLRFFSWEFEDYQC

SEQ ID NO: 6567 - protein, 351 aa, Neisseria meningitidis
MTILSDVKALGQQIWLDNLSRSLVQSGELAQMLKQGVCGVTSNPAIFQKAFAGDALYADEIAALKQQNLSPKQRYETMAVADVRAACDVCLAEHESTGGKTGFVSLEVSPELSKDAQGTVEEARRLYAAIGCKNAMIKVPATDAGIDALETLVSDGISVNLTLLFSRAQTLKAYAAYARGIAKRLAAGQSVAHIQVVASFFISRVDGALDTTLPDHLKGKIAIALAKAAYQDWAQYFGSPEFAALETKGANRVQLLWASTGVKNPAYPDTLYVDSLIGAHTVNTVPDATLKAFIDHGTAKATLTEGVEEAQAQLAETAALGIDVETLATRLQEDGLKQFEEAFEKLLAPLA

SEQ ID NO: 6568 - protein, 324 aa, Neisseria meningitidis
MAENGKYLDWAREVLHAEAEGLREIAAELDKNFVLAADALLHCKGRVVITGMGKSGHIGRKMAATMASTGTPAFFVHPAEAAHGDLGMIVDNDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 6569 - protein, 178 aa, Neisseria meningitidis
MQAISPELQARAAKIKLLILDVDGVLTDGRIFIRDNGEEIKSFHTLDGHGLKMLQASGVQTAIITGRDAPSVGIRVKQLGINYYFKGISDKRAAYEELRAQAGVEEAECAFVGDDVVDLPVMVRCGLPVAVPGAHWFTRQHAAYITEHAGGAGAVREVCDLIMQAQGTLGAALNEYIK

SEQ ID NO: 6570 - protein, 193 aa, Neisseria meningitidis
MKVRWRYGIAFPLILAVALGSLSAWLGRISEVEIEEVRLNPDEPQYTMDGLDGRRFDEQGYLKEHLSAKGAKQFPESSDIHFDSPHLVFFQEGRLLYEVGSDEAVYHTENKQVLFKNNVVLTKTADGKRQAGKVEAEKLHVDTESQYAQTDTPVSFQYGASHGQAGGMTYDHKTGMLNFSSKVKATIYDTKDM

SEQ ID NO: 6571 - protein, 176 aa, Neisseria meningitidis; identical to SEQ ID NO: 1730

SEQ ID NO: 6572 - protein, 254 aa, Neisseria meningitidis
MPTEDIEEIFMSANVSRLVVQNLQKSFKKRQVVKSFSLEIESGEVIGLLGPNGAGKTTSFYMIVGLIAADAGSVTLDGQELRHLPIHERARLGVGYLPQEASIFRKMTVEQNIRAILEIRTKDKNQIDREIEKLLADLNIGHLRRSPAPSLSGGERRRVEIARVLAMKPHFILLDEPFAGVDPIAVIDIQKIIGFLKSRGIGVLITDHNVRETLSICDRAYIISDGTVLASGKPDDLVGNEQVRSVYLGKNFKY

SEQ ID NO: 6573 - protein, 233 aa, Neisseria meningitidis; identical to SEQ ID NO: 3666

SEQ ID NO: 6574 - protein, 269 aa, Neisseria meningitidis
MTALPRYAVFGNPVAHSKSPQIHQQFALQEGVDIEYERICADIGGFAQAVSTFFETGGCGANVTVPFKQEAFHLADEHSERALAAGAVNTLIPLKNGKLRGDNTDGIGLTNDITQVKNIAIEGKTILLLGAGGAVRGVIPVLKEHRPARIVIANRTRAKAEELAQLFGIEAVPMADVNGGFDIIINGTSGGLNGQIPDIPPDIFQNCALAYDMVYGCAAKPFLDFARQSGAKKTADGLGMLVGQAAASYALWRGFTPDIRPVIEYMKAL

SEQ ID NO: 6575 - protein, 472 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 6576 - protein, 427 aa, Neisseria meningitidis
MTASKSGFIGQIFSRNMLVCIFTGFTSGLPLYFLINLIPAWLRSEQVDLKSIGLMALIGLPFTWKFLWSPLMDAVRLPVLGRRRGWMLLTQAGLLAALAVYAFLNPRNHLPLIAGLSVLVAFFSASQDIVLDAFRREILSDEELGLGNSVHVNAYRIAALIPGSLSLVLADRMPWLEVFVITSLFMLPGLLMTLFLAREPVLPPAVPKTLKQTVVEPFKEFFTRKGIASAVCVLLFIFLYKLGDSMATALATPFYLDMGFSKTDIGLIAKNAGLWPAVAAGILGGVWMLKIGVNKALWLFGAVQAVTVLGFVWLAGFGPFDTVGTGERLMLAAVIGAEAVGVGLGTAAFVSYMARETNPAFTATQLALFTSLSAVPRTVINSFAGYLIEWLGYVPFFQLCFALALPGMLLLLKVAPWNGEKTQDAGR

SEQ ID NO: 6577 - protein, 91 aa, Neisseria meningitidis
MNASNWSVYLILCENSAFYCGISPNPQQRLAAHTTGKGAKYTRVFKPVAMRIVAGGMDKGTALRQEIAVKKLTAAQKRQLWEQAEKMPSET

SEQ ID NO: 6578 - protein, 26 aa, Neisseria meningitidis
MKVKAYISIFYTPTEKNTMNCLLDLY

SEQ ID NO: 6579 - protein, 45 aa, Neisseria meningitidis
MKRLRAEIYADALSFPYILCVVKVQAALKSVLPSMNHHFVLFQRA

SEQ ID NO: 6580 - protein, 257 aa, Neisseria meningitidis
MRPYATTIYQLFILFIGSVFTMTSCEPVNEQTSFNNPEPMTGFEHTVTFDFQGTKMVIPYGYLARYTQNNATKWLSDTPGQDAYSINLIEISVYYKKTDQGWVLEPYNQQNKAHFIQFLRDGLDSVDDIVIRKDACSLSTTMGERLLTYGVKKMPSAYPEYEAYEDKRHIPENPYFHEFYYIKKGENPAIITHRNNRINQTEEDSYSTSVGSCINGFTVRYYPFIREKQQLTQQELVGYHQQVEQLVQSFVNNSSKK

SEQ ID NO: 6581 - protein, 91 aa, Neisseria meningitidis
MNEGEVVLTPEQIQTLRGYASRGDTYGGWRYLANLGDRYADDAAAIVGKDANLNGLNLWMKKGVENLWDDTVGKKTRLMCISVFWIVVFNL

SEQ ID NO: 6582 - protein, 377 aa, Neisseria meningitidis; identical to SEQ ID NO: 3442

SEQ ID NO: 6583 - protein, 128 aa, Neisseria meningitidis
MCIMCELKNFRRNITCFEGYDENSFIGKWYDDGVWDDEEYWKLENDLIEVRKKYPYPMDIPRYVVIGIGTIIDFLMVPNWKLFEIKASPWLPDSVGINERYERLKTMLRYIFTEKDIVNVQFDYYNKK

SEQ ID NO: 6584 - protein, 152 aa, Neisseria meningitidis
MVDAVVKTPEFLPFTSVGIFRFGADITQYKNILETFMYEPPDEFRTEYYESPDSNLLISVKKKNKIISIFCYQELYFMGVNIIGLNFEDFKQLFHYPKSYGVDKYYLSNESYPTYVYEFDEIGVQAWEAKGKIVTIIAGGKDNYSTEPYYDE

SEQ ID NO: 6585 - protein, 129 aa, Neisseria meningitidis
MKAGSRLLSESGRTQTVRKTVVKPKPLKAYNLTVADWHTYFVKGNQAETEGVWVHNSCPPKRTGSSKNEKHGDGGRSQISAESKIAELTNKIIPGMSKNERLKIKQKIRNIAKNANRKTKGEEHGRRGR

SEQ ID NO: 6586 - protein, 125 aa, Neisseria meningitidis; identical to SEQ ID NO: 1408

SEQ ID NO: 6587 - protein, 135 aa, Neisseria meningitidis
MCEFKDFRRNIPCFKEYDENSFIGKWYDDGVWDDEEYWKLENDLIEVRKKYPYPMDIPRDIVIGIGTIIDFLMVQNWKLFEIKASTWLPKSVKINERYERFRVMLRYIFTDLDVEDWKFFYFPIQHSKGRLRRKV

SEQ ID NO: 6588 - protein, 225 aa, Neisseria meningitidis
MVKTADGYKAIARIRTGDRVFAKDEASGKTGYKPVTARYGNPYQETVYIEISDGIGNNQTLISNKIHPFYSQGKWIQAGRLKKGDTLLSESGAKQTVQNITLKQQPLKAYNLTVADWHTYFVKGNRAETEGVWVHNDCPPRKTPSTPIYGNDSEAYAAAKELGYRKIKERTRNDAAIFKKGKSYISRDVDSHNGGAWKEASSPEKLNRKETRNGTFDKNLNRIGD

SEQ ID NO: 6589 - protein, 119 aa, Neisseria meningitidis
MASYVSIKGWIECSDDDIKIIQENINNFWNNCPFNIEEKESAKIYKSGWVFPTNSFNWSSYIFFGACVKSYFIIYFEKCIKTIMELDIEISGFFELDYYEDNYKVNWKINNGNLIQTTN

SEQ ID NO: 6590 - protein, 467 aa, Neisseria meningitidis
MKPLRRLTNLLAACAVAAAALIQPALAADLAQDPFITDNAQRQHYEPGGKYHLFGDPRGSVSDRTGKINVIQDYTHQMGNLLIQQANINGTIGYHTRFSGHGHEEHAPFDNHAADSASEEKGNVDEGFTVYRLNWEGHEHHPADAYDGPKGGNYPKPTGARDEYTYHVNGTARSIKLNPTDTRSIRQRISDNYSNLGSNFSDRADEANRKMFEHNAKLDRWGNSMEFINGVAAGALNPFISAGEALGIGDILYGTRYAIDKAAMRNIAPLPAEGKFAVIGGLGSVAGFEKNTREAVDRWIQENPNAAETVEAVFNVAAAAKVAKLAKAAKPGKAAVSGDFADSYKKKLALSDSARQLYQNAKYREALDIHYEDLIRRKTDGSSKFINGREIDAVTNDALIQAKRTISAIDKPKNFLNQKNRKQIKATIEAANQQGKRAEFWFKYGVHSQVKSYIESKGGIVKTGLGD

SEQ ID NO: 6591 - protein, 313 aa, Neisseria meningitidis; identical to SEQ ID NO: 314

SEQ ID NO: 6592 - protein, 38 aa, Neisseria meningitidis
MPSESHFRRSDGIFAPFVYKPLKSLYTQNPFNIKQTPL

SEQ ID NO: 6593 - protein, 376 aa, Neisseria meningitidis
MAFCTSLGVMMETQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAAFAWLAACWINRIPGSPHKATGASKPCILGAGYYY

SEQ ID NO: 6594 - protein, 524 aa, Neisseria meningitidis
MAQIQMSANVKTINAVFAAMLVGTVGYFIYWGLGYTHYNYAALFIIATMFGVFMAFNIGGNDVANSFGTSVGAGTLTIPQALLIAAVFEVSGAVIAGGEVTNTIRKGIVDLKGVDFEPIQFVFIMMSALLAAALWLLFASKKGLPVSTTHSIIGGIVGSAVCMAVMNDAASGDLIRWGKLGGIGVSWVLSPVLGGAVSYFLFSRVKKNVLDYNAWAEGTLKGIKQEKKAYKERHRLFFEGLSEAEKVEYATKMAHDAQIYDEPEFDPQELQSEYYRGLYAFDNRKNNVDSYKALHSWIPFIASFGAMMISAMLIFKGLKNLHLGMSNVNSFLTIFMIGAAVWMGTFVFAKSLKRKDLGKSTFQMFSWMQVFTACGFAFSHGANDIANAIGPFAAIMDVLRTNSVAAQNVVPPIAMLTFGIALIVGLWFVGKEVIKTVGTSLAEMHPASGFTAELSAASVVMGASLMGLPVSSTHILVGAVLGIGLVNRNANWKLMKPIGLAWVITLPAAAVLSVVCYLVLQAVF

SEQ ID NO: 6595 - protein, 473 aa, Neisseria meningitidis
MKIIQIQNNHNVNDDRPEFDRALIASLPASGPRYTSYPTADRFHDGFREGEYIKALHLRGMGALNKPLSLYIHIPFCNTICYYCGCNKIITKDKSRADAYIEYLEKEMELLAPHLNGRHQLAQLHFGGGTPTFLSDEQIERVFRMIRKHFELIPTGEYSIEIDPRKVSRDTVLMLGRLGFNRMSIGIQDFDPKVQAAVNRIQSYEETKEVIDAAREAGFKSVSVDLIYGLPHQTSESIKTTIDTVLSLDPDRLALYHYAHLPHVFKPQRRIDTAAVPDSEEKLDMLQYCVQTLTERGYVFIGMDHFAKPDDELSIALKEGFLQRNFQGYSTYADCDLVAIGVSSIGKIGSTYSQNERDIDAYYAAIDEGRLPIMRGYQLNQDDILRRNIIQDLMCRFALDYRIYESMFGIPFDRYFKDELADLEKLAGLGLVRLNSHGLTVTPKGRFLIRNIAMVFDYHLRHKETKAKYSQTV

SEQ ID NO: 6596 - protein, 244 aa, Neisseria meningitidis
MASHNTTHQMKTLCSSCSLRELCLPVGLLPNELSQLDAVIRQSRRLKKGEYLFCVGEAFTSLFAIRSGFFKTTVASQDGRDQVTGFFMSGELIGMDGICSHVHSCDAVALEDSEVCELPFTHIEELGQNIPSLRTHFFRMMSREIVRDQGVMLLLGNMRAEERIAAFLLNLSQRLYSRGFAANDFILRMSREEIGSYLGLKLETVSRTLSKFHQEGLISVEHKHIKILNLQVLKKMVSGCSHAI

SEQ ID NO: 6597 - protein, 316 aa, Neisseria meningitidis
MKLQQLKYALEVYQHNLNVSEAAEALFTSQPGISKQIKLLEEEIGIQIFIRSGKRVVSVSQPGKVVLDIAERILRDVQNIKNIGSEFTGQDSGSLTVATTHTQARYALPLIVADFVKRYPKVNLTIKQGSPAAIARMVTSGEADLAIVTERIDDHPELGKLPCYDWTHAVIVPNDHPLLECRNPLRIEDLARFPLITYEFAFNAGSSIARAFSKARLEQPDVALAAADTDVLKTYVRLGLGVGLMAKMAYNPDTDGDLQLVDAAHLFEPSPTWIALRSDTYLRGYAYDFIQAFAPHLTREKVDRILYTPISEDFSI

SEQ ID NO: 6598 - protein, 242 aa, Neisseria meningitidis
MTKQLKLSALFVALLASGTAVAGEASVQGYTVSGQSNEIVRNNYGECWKNAYFDKASQGRVECGDAVAAPEPEPEPEPAPAPVVVVEQAPQYVDETISLSAKTLFGFDKDSLRAEAQDNLKVLAQRLSRTNVQSVRVEGHTDFMGSDKYNQALSERRAYVVANNLVSNGVPVSRISAVGLGESQAQMTQVCEAEVAKLGAKVSKAKKREALIACIEPDRRVDVKIRSIVTRQVVPAHNHHQH

SEQ ID NO: 6599 - protein, 75 aa, Neisseria meningitidis
MHEVSGFCTRYCCNIRETSVGIDDVKQTPAFAGFVFLGGFLKRLSSESGCRFGFGFRFRFRFRFRFRFVSHCRAL

SEQ ID NO: 6600 - protein, 98 aa, Neisseria meningitidis
MDGIVPDVCGTVCRIWFYHQPFSVETPSVAAIEPNRWRKLPLCIRGGVQCGALICRLCVETGWSVHTGTVWPKLKVKYAETLNEPLYCLYGLCCLAMI

SEQ ID NO: 6601 - protein, 318 aa, Neisseria meningitidis
MKEFDFIKRYLQTGTDNDVVLGIGDDAAIVRPREGFDLCFSADMLLKDRHFFADVKPEDLAWKVLAVNISDMAAMGAIPRWVLLSAALPELDEVWLKRFCGSFFGLAKKFGVTLIGGDTTKGDMAFNVTIIGELPKGRALRRDAAVAGDDIWVSGRIGMAAAALNCRLKRCVLPDEVFAECEQKLLHPEPRVGLGLALLPFARAAQDVSDGLAQDLGHILTASGKGAEIWADSLPSLSVLKDILPRAQWLSYTLAGGDDYELVFTAPESCRSRVFDAAERCGVPVTRIGKINGGCRLKVLDADGRELELHSLGFDHFG

SEQ ID NO: 6602 - protein, 161 aa, Neisseria meningitidis
MADFKPDFAWLLKRPLCFLAFGFGSGLAPFAPGTFGTLAALPLAFVLILLGIDGLLLAFLCIVLFMWGIRICAYAERETGVSDHGGIVWDEIVAMLFVLAFVPFRWTWWLAAFVLFRLFDALKPSPVGWFDKNLHGGLGIMADDMAAAVMTLIVLRIAMLF

SEQ ID NO: 6603 - protein, 558 aa, Neisseria meningitidis; identical to SEQ ID NO: 2856

SEQ ID NO: 6604 - protein, 451 aa, Neisseria meningitidis; identical to SEQ ID NO: 150

SEQ ID NO: 6605 - protein, 336 aa, Neisseria meningitidis
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLQQSADGYPNDLDLDISYRLDEDDRLTVSYRATALGDTVFDPTLHIYWRLDAGLHDAVLHIPQGGHMPADAEKLPVSTVSDDLEVFDFSRPKPLDAAVAALRRETGRAGFDDAYRVPSDIGRPAAVLQAGRRRRISIYSDRNGLVIFTAAPQDFARHDAGVYDALATEAQTLPDSLNWPEFGNIRLNKGDTREATIAYGIESLS

SEQ ID NO: 6606 - protein, 752 aa, Neisseria meningitidis
MYTRIMEISPWTLRSAKLEKEHKRLQESLTSLGNGYMGMRGSFEETYSADSHLGTYIAGVWFPDKTRVGWWKNGYPKYFGKAINAFNFSKVKIFVDGQEVDLAKNDVAGFSVELDMQHGVLRRSFTVFGVRFNVCKFLSVAQKELAVIRWEAVSVDGKTHQVRIDSIIDADVKNEDSNYEEKFWQVLDKGVSDSLSYIAAQTVANPFGVEQFIVNAEQTFAGSFKALGGSQTDWQVSNSFESEVGSTPETFEKRVIVTTSRDYQSLEAVKAAGRALSEKIAGVAFETLLDAHKAGWLHRWEIADVVIEGSDEAQQGIRFNLFQLFSTYYGEDARLNIGPKGFTGEKYGGATYWDTEAYAVPLYLALAEPEVTRNLLQYRRNQLPQAQHNAREQGLAGALYPMVTFTGIECHNEWEITFEEIHRNGAIPYAIYNYTNYTGDEGYLAKEGLEVLVEVSRFWADRVHFSKRNGKYMIHGVTGPNEYENNINNNWYTNTLAAWVLDYTREALAKYPRPDLNVRADELEKWADISANMYRPHDEELGVFVQHDGFLDKDIRPVSALSPDDLPLNQKWSWDKILRSPFIKQADVLQGIYFFSDRFNIDEKRRNFDFYEPMTVHESSLSPCIHSILAAELGKEEKAVEMYQRTARLDLDNYNNDTEDGLHITSMTGSWLAIVQGFAQMKTWGGKLSFAPFLPSAWTGYAFHINYRGRLIKVAVGKENVVFTLLKGESLDLQVYGKDITLDGSHTVALEK

SEQ ID NO: 6607 - protein, 221 aa, Neisseria meningitidis
MTFTAVLFDLDGVITDTAEYHYRAWKKLAEELGISIDRKFNEQLKGVSRDDSLKRILAHGGKTVSEAEFAELTRRKNDNYVEMIQAVKPEDVYPGILPLLEALRANGKKIALASASKNGPFLLERMGLTHFFDAIADPAAVAHSKPAPDIFLAAAEGVDADIRQCIGIEDAAAGVAAIKAAGALPIGVGKAEDLGSDIALVSGTAELTYAYLQSVWEQSGR

SEQ ID NO: 6608 - protein, 502 aa, Neisseria meningitidis
MQTDCDVLIAGNGLAALTLALSLPESFRIVILCKNRLDDTASRHAQGGIAAAWSGEDDIEKHVADTLEAGAGLCDEAAVRAILSQGKPAIEWLLAQGVAFDRNHNGLHLTREGGHTCRRIAHVADYTGEAVMQSLIAQIRRRPNIRVCERQMALDIQTESGAACGLTVLDCRTQETYRIRARHTVLAGGGLGQIYAATTTPPECTGDAIAMAIRAGCAVGNLEFIQFHPTGLARPSENGRTFLISEAVRGEGGILTNQAGERFMPHYDRRAELAPRDIVARAIAAEIAKQTQDFVSLDISHQPAAFVRRHFPSIHRHCLSQCGLDITRQAIPVRPVQHYTCGGIQTDPCGRTSLPQLYALGETACTGLHGANRLASNSLLECVVTARLCAQAIADGQAFQAEPFQRPSESLSAEAGIFSDDLQNTFSRPVLQTFNQRHLGILRNDTGLRRAIAQLQLWKQNQAEPHTASEYENRNLLECSLAVAQAAYRRRQNIGAHFNSDC

SEQ ID NO: 6609 - protein, 111 aa, Neisseria meningitidis
MQMHWLFLTVAILSEVCGSSMLKLSGGFSKLWPSIGVVVSFSVCFWALSMTLKTMPLATAYAIWAGVGLVLTALVSVVFFGEKADFIGIVSIGLILLGVVLLNTMSHMSGH

SEQ ID NO: 6610 - protein, 370 aa, Neisseria meningitidis
MQTAARRSFDYDMPLIQTPTSACQIRQAWAKVADTPDRETADRLKDEIKALLKEKNAVLVAHYYVDPLIQDLALETGGCVGDSLEMARFGAEHEAGTLVVAGVRFMGESAKILCPEKTVLMPDLEAECSLDLGCPEEAFSAFCDQHPDRTVVVYANTSAAVKARADWVVTSSVALEIVSYLKSRGEKLIWGPDRHLGDYICRETGADMLLWQGSCIVHNEFKGQELAALKAEHPEAVVLVHPESPQSVIELGDVVGSTSKLLKAAVSRPEKKFIVATDLGILHEMQKQAPDKQFIAAPTAGNGGSCKSCAFCPWMAMNSLGGIKYALTSGRNEILLDRKLGEAAKLPLQRMLDFAAGLKKKDVFNGMGPA

SEQ ID NO: 6611 - protein, 312 aa, Neisseria meningitidis
MDAYPEAEAPPQSIVELVPVLIAVTDGGLRVLTVAQGMLLPNGPLSPLRNSLQAGVKLWVAKQTSQPMGYVEQLYTFVDTHRRNEHGMPVLYVSYLGLVREAADSILHPDAKWQDCYGYFPWEDLRTDGGQRDAVVGRLRIWANSADTEEVRQKRLKRIHLCWGVEPENWSEEYVLQRYEMLYESGLIAEAAEPQANFDFALTGQPMRHDHRRVLATALSRLRAKIKYRPVIFELMPPEFTLLQLQNSVEAISGRLLHKQNFRRQIQQQNLIEPSDTGVSGSKGRPAQLCRFRDDVLPDRLISDIGLPLGSR

SEQ ID NO: 6612 - protein, 293 aa, Neisseria meningitidis
MPSEKTLFPLPDTLLRPIVEQALSEDLGRRGDITSAAVIAPDKTAKLFLVSREDGVIAGMDLARLAFQTMDPSVRFQAEIRDGQAVRAGQTLAAVEGNARALLAAERTALNYLTHLSGIATATARAVAEVAEYGTDIVCSRKTIPLLRVLQKYAVRAGGGVNHRMGLDDAVLIKDNHLAYCGSIAQAVQQAKQAVGALTCVEIEVDTLAQLDEAIAAGAERILLDNMDDETLKEAANRCHTQTAHPHTIYCEASGGIGFDRLKRVAQTGVDGIALGYLTHSSRSLDIGLDFVA

SEQ ID NO: 6613 - protein, 95 aa, Neisseria meningitidis
MSGKEPLNPNPVIASGRKCRLKDSSDGIFRKGRDALEKTAFQAGILFARQRGGIGRAGKRTGGGSFMPSESPPLRLFAKKVGKGTYNPVQSSINI

SEQ ID NO: 6614 - protein, 93 aa, Neisseria meningitidis
MNTIPLHTILKLMAHPERMAILIQLLDSERNIAELAKSLSLPATAVSNHLNRLRVEGLVDFTRYHRIIEYRLVSEEAAAILHTVRDLENKRVA

SEQ ID NO: 6615 - protein, 256 aa, Neisseria meningitidis
MKITTWNVNSLNVRLPQVQNLLADNPPDILVLQELKLDQDKFPAAALQMMGWHCVWSGQKTYNGVAIVSRSVPQDVHFGLPALPDDPQRRVIAATVSGVRVINVYCVNGEALDSPKFKYKEQWFAALTEFVRDEMTRHGKLVLLGDFNIAPADADCYDPEKWHEKIHCSSVERQWFQNLLDLGLTDSLRQVHPEGAFYTWFDYRGAMFQRKLGLRIDHILVSPAMAAALKDVRVDLETRALERPSDHAPVTAEFDW

SEQ ID NO: 6616 - protein, 190 aa, Neisseria meningitidis
MPYYLYCLRLRRLVLIFVNPLYLHQFHETQVGSVKQLIAHFDRLIDELDKQIDDHTHTHFDGKAQVAEQIKGIGSITTATLMAMLPELRRLSHKRIAGLAGIAPHPRESGETKFKSRCFGGRSAVRKALYMATVAATRFEPLIRDFHQRPLSEGKPYKVAVTACMRKLLTISNARMRDYFAENDTAENGI

SEQ ID NO: 6617 - protein, 1201 aa, Neisseria meningitidis
MFHFAFPAQTALRQAITDAYRRNEIEAVQDMLQRAQMSDEERNAASELARRLVTQVRAGRTKAGGVDALMHEFSLSSEEGIALMCLAEALLRIPDNATRDRLIADKISDGNWKSHLNNSPSLFVNAAAWGLLITGKLTATNDKQMSSALSRLISKGGAPLIRQGVNYAMRLLGKQFVTGQTIEEALQNGKEREKMGYRFSFDMLGEAAYTQADADRYYRDYVEAIHAIGKDAAGQGVYEGNGISVKLSAIHPRYSRTQHGRVMGELLPRLKELFLLGKKYDIGINIDAEEANRLELSLDLMEALVSDPDLAGYKGIGFVVQAYQKRCPFVIDYLIDLARRNNQKLMIRLVKGAYWDSEIKWAQVDGLNGYPTYTRKVHTDISYLACARKLLSAQDAVFPQFATHNAYTLGAIYQMGKGKDFEHQCLHGMGETLYDQVVGPQNLGRRVRVYAPVGTHETLLAYLVRRLLENGANSSFVNQIVDENISIDTLIRSPFDTIAEQGIHLHNALPLPRDLYGKCRLNSQGVDLSNENVLQQLQEQMNKAAAQDFHAASIVNGKARDVGEAQPIKNPADHDDIVGTVSFADAALAQEAVGAAVAAFPEWSATPAAERAACLRRFADLLEQHTPALMMLAVREAGKTLNNAIAEVREAVDFCRYYANEAEHTLPQDAKAVGAIVAISPWNFPLAIFTGEVVSALAAGNTVIAKPAEQTSLIAGYAVSLMHEAGIPTSALQLVLGAGDVGAALTNDARIGGVIFTGSTEVARLINKALAKRGDNPVLIAETGGQNAMIVDSTALAEQVCADVLNSAFDSAGQRCSALRILCVQEDVADRMLDMIKGAMDELVVGKPIQLTTDVGPVIDAEAQQNLLNHINKMKGVAKSYHEVKTAADVDSKKSTFVRPILFELNNLNELQREVFGPVLHVVRYRADELDNVIDQINSKGYALTHGVHSRIEGTVRHIRSRIEAGNVYVNRNIVGAVVGVQPFGGHGLSGTGPKAGGSFYLQKLTRAGEWVAPTLSQIGQADEAALKRLEALVHKLPFNAEEKKAAAAALGHARIRTLRRAETVLTGPTGERNSISWHAPKRVWIHGGSTVQAFAALTELAASGIQAVVEPDSPLASYTADLEGLLLVNGKPETAGISHVAALSPLDSARKQELAAHDGALIRILPSENGLDILQVFEEISCSVNTTAAGGNASLMAVAD

SEQ ID NO: 6618 - protein, 508 aa, Neisseria meningitidis
MNPMYITFAIYLVAVLLIGLAAYFSTRNFDDYILGGRSLGPFVTAMSAGASDMSGWLLMGLPGAIYLSGLNEAWIAIGLLVGAYFNWLLVAGRLRVHTEYANNALTLPDYFFHRFGAGGHLMKVVSALIILFFFTIYCASGIVAGATLFQSLFEGMTYNQAMWLGAGATIAYTFLGGFLAVSWTDTLQASLMIFALILTPVMVYLGLGGAEQMSAAIQSVAAGTGKEYGSLFAGTTVIGIISTAAWGLGYFGQPHILARFMAAESAKSLVSARRIGMTWMALCLAGAVAVGYFGIAYFGANPDKVSSMSGNHERIFIALSTLLFNPWIAGIILSAILAAVMSTLSCQLLVCSSAITEDFYKGFLRKNAQQSELVWVGRLMVLAIAVISILIASDPNSKVLGLVSYAWAGFGAAFGPIVILSVLWKRITAYGALSGMVAGALTVVVWAEWVKKPAQAAGESGLLTMYEIVPGFIVCLIVAVLVSLFNKEPSRETQERFEKADADYRATR

SEQ ID NO: 6619 - protein, 30 aa, Neisseria meningitidis
MPSENGRRIIGKTYRASFAVAKLHLKTPAA

SEQ ID NO: 6620 - protein, 106 aa, Neisseria meningitidis
MFGKQLFEEVGSKISETIANSPAKDVEKNIKAMLGGAFNRMDLVTREEFDIQQQVLIKTRTKLAALEARLEKLEAAQNPERAALEAAEAAAEEAVAEIRQQTEAGE

SEQ ID NO: 6621 - protein, 498 aa, Neisseria meningitidis
MSLALVYSRALSGMNAPLVEVEAHLANGLPHFNIVGLPDMEVKESRDRVRAAIIQSGFEFPAKKITVNLAPADLPKESGRFDLPIAIGILAASGQVAPEKLEEYEFAGELALSGLLRPVRGALAMAWQGMQAKRAFVLPEENAGQAAVMRGITVYGARSLGEVAAHLNGIEPLAQTECQVPQMPFEHGGQPDLCDVKGQHTARLALEIAAAGGHSLLMMGPPGTGKSMLSQRLPGILPPLTEDELVEVWALRSLLPNHQQQLDSNRPFRSPHHSASAAAMVGGGSDPRPGEISLAHHGVLFLDELPEFDRKVLEVLREPLENGEIHISRAARQAVYPAKFQLVAAMNPCPCGYLGHPVKPCRCTPESVARYRSKISGPLLDRIDLTIEVPSLSAAELMQQEAGESSASVLERVIAARDKQYARQGKVNAALSVSELDTSARIQKEAQEALGGLLEKLSLSARSFHRIMRVARTLADLAGDEEVGRSHVMKAIGFRRAL

SEQ ID NO: 6622 - protein, 289 aa, Neisseria meningitidis; identical to SEQ ID NO: 384

SEQ ID NO: 6623 - protein, 214 aa, Neisseria meningitidis; identical to SEQ ID NO: 3612

SEQ ID NO: 6624 - protein, 273 aa, Neisseria meningitidis
MDFLIVLKALMMGLVEGFTEFLPISSTGHLIVFGNLIGFHSNHKVFEIAIQLGAVLAVVFEYRQRFSNVLHGLGKDRKANRFVLNLAIAFIPAAVMGLLFGKQIKEYLFNPLSVAVMLVLGGFFILWVEKRQSRAEPKIADVDALRPIDALMIGVAQVFALVPGTSRSGSTIMGGMLWGIERKTATEFSFFLAVPMMVAATAYDVLKHYRFFTLHDVGLILIGFIAAFVSGLVAVKALLRFVSKKNYIPFAYYRIVFGIAIIILWLSGWISWE

SEQ ID NO: 6625 - protein, 403 aa, Neisseria meningitidis
MTAPVPTCNMSGNPINLHKLTLIMPLPSPEARQFSLKLQTLIAEKIGKHGNWIPFSRFMELVLYAPQYGYYTGGSHKIGNTGDFITAPTLTSLFAQTLARQLQELLSQTAGNIYEFGAGTGQLAADLLGSISDGISRYYIIEISPELAARQKNLIQARAPEASQKVVHLTALPEAFDGIIIGNEVLDAMPVEIVRKNEGGSFEHVGVCLDNDRFTYSARPLHDLQLSALASLYFPQTDYPYTSELHPQQYAFIRTLASRLEHGCMIFIDYGFDAAQYYHPQRNQGTLIGHYRHHIIHNPFDFIGLADLTAHVNFTDIAQAGTDAGLDLIGYLPQSHFLLNLGITELLAQTGKTDSAAYICEAAAVQKLIDQHEMGELFKVIAFGKNIGIDWAGFRFGDICHKL

SEQ ID NO: 6626 - protein, 151 aa, Neisseria meningitidis
MFGGAHELSIDSKGRLAVPAKFRDILSRLYTPAVVVTLESKHKLLMYPVAEWEKVAAQLLNLKVADNPVLRRFQNLLLHNAEILEWDSAGRVLVSAGLRKRVDFDREVVLVGRANRLELWGREQWEAEMVQALDDDPDELAFQLSQTDLQL

SEQ ID NO: 6627 - protein, 328 aa, Neisseria meningitidis
MSGAESYRHITVLLNEAVDALAVREDGVYVDGTFGRGGHSRLILSRLGDAGRLIVFDKDPQAIAVAEELARSDKRVGVVHGGFASFQTALDGLGIGKVDGALFDLGISSPQIDDGSRGFSFRFDAPLDMRMDTTRGMSAAEWIAVASEQDLHEVIKNYGEERFSRRIARAIVAQRAESPIDTTRKLAQIVAQNVRTRERGQDPATRTFQAVRIFINRELEEVGAVLPQVMCRLKEGGRLAVIAFHSLEDRIVKQFVKKYSQHAPLPRWAAVREADLPELPLKIVGRALKPGEAEIAANPRARSAVLRVAERTAGPIPEQSQRKTSEWQ

SEQ ID NO: 6628 - protein, 89 aa, Neisseria meningitidis
MAMNKLNFLLLLAVCVSAFSVVMQQNQYRLNFTALDKAKKQEIALEQDYAQMRLQQARLANHEAIRAAAEKQNLHPPVSGNTFMVEHQR

SEQ ID NO: 6629 - protein, 581 aa, Neisseria meningitidis; identical to SEQ ID NO: 3672

SEQ ID NO: 6630 - protein, 492 aa, Neisseria meningitidis
MFSKLTPLAETGIPTLSCANAAGRLLHSDSRQIKQGDIFVACPGEYADGRSYIPAAVANGAAFVFWDDDGKFAWNPEWKVPNQGIKDLKHRAGILAAQVYGNVSDGLKVWGVAGTNGKTSITQWLAQAADLLGEKTAIVGTVGNGFWGALEETTHTTPAPVDVQTLLYRFRQQGATVAAMEVSSHGLDQSRVNGVSFRSAIFTNLTRDHLDYHGTMEAYGAIKSRLFYWHGLKHAVINVDDEYGAELVGRLKKDCPDLAVYSYGFSEHADIRITDFTASSDGIAAVFQTPWGEGKCRTRLLGRFNAQNLAACIALLCANGYPLDKVLDVLAKIRPASGRMDCIMNSGKPLVVVDYAHTPDALEKALATLQEIKPQGAALWCVFGCGGNRDRGKRPLMGAAAVQGADKVVVTSDNPRLENPHDIINDILPAVPAPECVEADRAAAVRYAVEQAAANDIILIAGKGHENYQDVQGVKHRFSDLEIVGQALLTRK

SEQ ID NO: 6631 - skipped

SEQ ID NO: 6632 - protein, 455 aa, Neisseria meningitidis
MKPLDLNFICQALKLPMPSESKPVSRIVTDSRDIRAGDVFFALAGERFDAHDFVEDVLAAGAAAVVVSREDCAAMDGALKVDDTLAALQTLAKAWRENVNPFVFGITGSGGKTTVKEMLAAVLRRRFGDDAVLATAGNFNNHIGLPLTLLKLNEKHRYAVIEMGMNHFGELAVLTQIAKPNAALVNNAMRAHVGCGFDGVGDIAKAKSEIYQGLCSDGIALIPQEDANMAVFKTATLNLNTRTFGIDSGDVHAENIVLKPLSCEFDLVCGDERAAVVLPVPGRHNVHNAAAAAALALAAGLSLNDVAEGLKGFSNIKGRLNVKSGIKGATLIDDTYNANPDSMKAAIDVLARMPAPRIFVMGDMGELGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 6633 - protein, 58 aa, Neisseria meningitidis
MKSRRFFKALLLIAALVGAFYAGMRTQAYLYEDLCLDLGGGKNPGSYPICVIEKVPAR

SEQ ID NO: 6634 - protein, 360 aa, Neisseria meningitidis
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAIIASLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIR

SEQ ID NO: 6635 - protein, 198 aa, Neisseria meningitidis; identical to SEQ ID NO: 4

SEQ ID NO: 6636 - protein, 445 aa, Neisseria meningitidis
MTFQNKKILVAGLGGTGISMIAYLRKNGAEVAAYDAELKPERVSQIGKMFDGLVFYTGRLKDALDNGFDILALSPGISERQPDIEAFKQNGGRVLGDIELLADIVNRRDDKVIAITGSNGKTTVTSLVGYLCIKCGLDTVIAGNIGTPVLEAEWQREGKKADVWVLELSSFQLENTESLRPTAATVLNISEDHLDRYDDLLDYAHTKAKIFRGDGVQVLNADDAFCRAMKRAGREVKWFSLEHEADFWLERETGRLKQGNEDLIVTQDIPLQGLHNAANVMAAVALCEAIGLSREALLEHVKTFQGLPHRVEKIGEKNGVVFIDDSKGTNVGATAAAIAGLQNPLFVILGGMGKGQDFTPLRDALVGKAKGVFLIGVDAPQIRRDLDGCGLNMTDCATLGEAVQTAYAQAEAGDIVLLSPACASFDMFKGYAHRSEVFIEAFKAL

SEQ ID NO: 6637 - protein, 423 aa, Neisseria meningitidis
MGDGVHTLLLDRPIVRDGRKFDAPLLWMVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRRKMRGYRVE

SEQ ID NO: 6638 - protein, 355 aa, Neisseria meningitidis
MGGKTFMLMAGGTGGHIFPALAVADSLRARGHHVIWLGSKDSMEERIVPQYGIRLETLAIKGVRGNGIKRKLMLPVTLYQTVREAQRIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPDNARPQMYHQSGRGKLGSLQADYDALGVKAECVEFITDMVSAYRDADLVICRAGALTIAELTAAGLGALLVPYPHAVDDHQTANARFMVQAEAGLLLPQTQLTAEKLAEILGGLNREKCLKWAENARTLALPHSADDVAEAAIACAA

SEQ ID NO: 6639 - protein, 469 aa, Neisseria meningitidis
MMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYLEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLALSKQI

SEQ ID NO: 6640 - protein, 304 aa, Neisseria meningitidis
MQNFGKVAVLMGGFSSEREISLDSGTAILNALKSKGIDAYAFDPKETPLSELKAQGFQTAFNILHGTYGEDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHLQGEIIAERFIGGGEYSCPVLNGKGLPGIHIIPATEFYDYEAKYNRDDTIYQCPSEDLTEAEESLMRELAVRGAQAIGAEGCVRVDFLKDTDGKLYLLEINTLPGMTSHSLVPKSAAVTGVGFADLCIEILKTAHVG

SEQ ID NO: 6641 - protein, 235 aa, Neisseria meningitidis
MERLTRWLLVMMAMLLAASGLVWFYNSNHLPVKQVSLKGNLVYSDKKTLGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYASDGLPEKESEE

SEQ ID NO: 6642 - protein, 414 aa, Neisseria meningitidis
MEQQQRYISVLDIGTSKVLALIGEVQDDDKINIVGLGQAPSRGLRAGMVTNIDATVQAIRQAVNDAELMADTKITHVTTGIAGNHIRSLNSQGVVKIKDGEVTQADIDRAIETAKAINIPPDQKILDAVVQDYIIDTQLGVREPIGMSGVRLDTRVHIITGASTAVQNVQKCIERCGLKSDQIMLQPLASGQAVLTEDEKDLGVCVIDIGGGTTDIAVYMNGAIRHTSVIPAGGNLITKDLSKSLRTPLDAAEYIKIHYGVASCDTEGLGEMIEVPGVGDRTSRQVSSKVLAAIISARIQEIFGVVLGELQKSGFPKEVLNAGIVLTGGVSMMTGIVEFAEKIFDLPVRTGAPQEMGGLSDRVRTPRFSTAIGLLHAACKLEGNLPQPENGAVQEREGGGGLLARLKRWIENSF

SEQ ID NO: 6643 - protein, 392 aa, Neisseria meningitidis
MEFVYDVAESAVSPAVIKVIGLGGGGCNAINNMVANNVRGVEFISANTDAQSLAKNHAAKRIQLGTNLTRGLGAGANPDIGRAAAQEDREAIEEAIRGANMLFITTGMGGGTGTGSAPVVAEIAKSLGILTVAVVTRPFAYEGKRVHVAQAGLEQLKEHVDSLIIIPNDKLMTALGEDVTMREAFRAADNVLRDAVAGISEVVTCPSEIINLDFADVKTVMSNRGIAMMGSGYAQGIDRARMATDQAISSPLLDDVTLDGARGVLVNITTAPGCLKMSELSEVMKIVNQSAHPDLECKFGAAEDETMSEDAIRITIIATGLKEKGAVDFVPAREVEAVAPSKQEQSHNVEGMIRTNRGIRTMNLTAADFDNQSVLDDFEIPAILRRQHNSDK

SEQ ID NO: 6644 - protein, 436 aa, Neisseria meningitidis
MDTSKQTLLDGIFKLKANGTTVRTELMAGLTTFLTMCYIVIVNPLILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFEGLFTVSMVSVIFVFFLVDLFDSTGTLVGISHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 6645 - protein, 34 aa, Neisseria meningitidis
MKPIQMFSPFLNNPLVFFLSAVLPHNSERSAVFL

SEQ ID NO: 6646 - protein, 292 aa, Neisseria meningitidis
MMSQHSAGARFRQAVKESNPLAVAGCVNAYFARLATQSGFKAIYLSGGGVAACSCGIPDLGITTMEDVLIDARRITDNVDTPLLVDIDVGWGGAFNIARTIRNFERAGVAAVHIEDQVAQKRCGHRPNKAIVSKDEMVDRIKAAVDARVDENFVIMARTDALAVEGLDAAIERAQACVEAGADMIFPEAMTDLNMYRQFADAVKVPVLANITEFGSTPLYTQSELAENGVSLVLYPLSSFRAASKAALNVYEAIMRDGTQAAVVDSMQTRAELYEHLNYHAFEQKLDKLFQK

SEQ ID NO: 6647 - protein, 384 aa, Neisseria meningitidis
MTETTQTPTLKPKKSVALSGVAAGNTALCTVGRTGNDLSYRGYDILDLAQKCEFEEVAHLLIHGHLPNKFELAAYKTKLKSMRGLPIRVIKVLESLPAHTHPMDVMRTGVSMLGCVHPERESHPESEARDIADKLIASLGSILLYWYQYSHNGKRIEVESDEETIGGHFLQLLHGKRPSESHIKAMHVSLILYAEHEFNASTFTARVIAGTGSDMYSSITGAIGALKGPKHGGANEVAYDIQKRYRNADEAEADIRERIGRKEIVIGFGHPVYTISDPRNVVIKEVARGLSKETGDMRLFDIAERLESVMWEEKKMFPNLDWFSAVSYQKLGVPTAMFTPLFVISRTTGWSAHVLEQRKDGKIIRPSANYTGPEDLAFVEIEER

SEQ ID NO: 6648 - protein, 262 aa, Neisseria meningitidis; identical to SEQ ID NO: 434

SEQ ID NO: 6649 - protein, 868 aa, Neisseria meningitidis
MAANQRYRKPLPGTDLEYYDARAACEDIKPGSYDKLPYTSRILAENLVNRADKVDLPTLQSWLGQLIEGKQEIDFPWYPARVVCHDILGQTALVDLAGLRDAIAEKGGDPAKVNPVVQTQLIVDHSLAVECGGYDPDAFRKNREIEDRRNEDRFHFINWTKTAFENVDVIPAGNGIMHQINLEKMSPVVQVKNGVAFPDTCVGTDSHTPHVDSLGVISVGVGGLEAETVMLGRASMMRLPDIVGVELNGKRQAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAAKGLAKPYEEPSDGQMPDGSVIIAAITSCTNTSNPRNVVAAALLARNANRLGLKRKPWVKSSFAPGSKVAEIYLKEAGLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPADEEIDAVVAEYVKPQQFRDVYVPMFDTGTAQKAPSPLYDWRPMSTYIRRPPYWEGALAGERTLRGMRPLAILPDNITTDHLSPSNAILAVSAAGEYLAKMGLPEEDFNSYATHRGDHLTAQRATFANPKLFNEMVKNEDGSVRQGSFARVEPEGETMRMWEAIETYMNRKQPLIIIAGADYGQGSSRDWAAKGVRLAGVEAIVAEGFERIHRTNLIGMGVLPLQFKPDTNRHTLQLDGTETYDVVGERTPRCDLTLVIHRKNGETVEVPVTCCLDTAEEVLVYEAGGVLQRFAQDFLEGNAA

SEQ ID NO: 6650 - protein, 389 aa, Neisseria meningitidis
MPQIKIPAVYYRGGTSKGVFFKRSDLPEAAREAGSARDKILLRVLGSPDPYGKQIDGLGNASSSTSKAVILDKSERADHDVDYLFGQVSIDKPFVDWSGNCGNLTAAVGAFSIEQGLVDKGKIPSDGICTVKIWQKNIGKTIIAHVPMQNGAVLETGDFELDGVTFPAAEVQIEFLDPADGEGSMFPTGNLVDEIDVPNIGRLKATLINAGIPTVFLNAADLGYTGKELQDDINNDAAALEKFEKIRAYGALKMGLISDVSEAAARAHTPKVAFVAPAADYTASSGKTVNAADIDLLVRALSMGKLHHAMMGTASVAIATAAAVPGTLVNLAAGGGTRKEVRFGHPSGTLRVGAAAECQDGQWTATKAVMSRSARVMMEGWVRVPEDCF

SEQ ID NO: 6651 - protein, 399 aa, Neisseria meningitidis
MSDQLILVLNCGSSSLKGAVIDRKSGSVVLSCLGERLTTPEAVITFNKDGNKRQVPLSGRNCHAGAVGMLLNELEKHGLHDRIKAIGHRIAHGGEKYSESVLIDQAVMDELNACIPLAPLHNPANISGILAAQEHFPGLPNVGVMDTSFHQTMPERAYTYAVPRELRKKYAFRRYGFHGTSMRYVAPEAARILGKPLEDIRMIIAHLGNGASITAIKNGKSVDTSMGFTPIEGLVMGTRCGDIDPGVYSYLTSHAGMDVAQVDEMLNKKSGLLGISELSNDCRTLEIAADEGHEGARLALEVMTYRLAKYIASMAVGCGGVDALVFTGGIGENSRNIRAKTVSYLDFLGLHIDTKANMEKRYGNSGIISPTDSSPAVLVVPTNEELMIACDTAELAGIL

SEQ ID NO: 6652 - protein, 213 aa, Neisseria meningitidis
MTIRKQTMAQFFAIHPDNPQERLIKQAVEIVNKGGVVVYPTDSCYALGCKLGDKAAMERILSIRKIDLKHHLTLMCADLSELGTYAKVDNVQFRQLKAATPGPYTFILQATKDVPARTLHPKRKTIGLRIPDNAIAQALLGELGEPLLSCTLMLPEDGEPLTDPYEIRERLEHAVDLVIDGGWCGTEPTTVVDMTDGTELVRQGCGDTAVFGL

SEQ ID NO: 6653 - protein, 147 aa, Neisseria meningitidis
MYLTQHTDYGLRVLIYTAINDDALVNISTIAVTYGISKSHLMKVVTALVKGGFLHSVRGKGGGLRLAAPPDRINIGSVVRHLEPMQLVECMGENNECLITPSCRLTGILGGAMKSFFTYLDGFTLQDLLNKPTYDLLYEPRIPIAVQ

SEQ ID NO: 6654 - protein, 122 aa, Neisseria meningitidis
MKPLKRHPALIGLSRDHHHSLSLCVRLLRTPEERHRDELEPHFSELETHFREEETKFAPIWQNVAPELKQRFEKDHARLRQMMASPEYGNAAWNTAFATTLRDHARFEERELFPAAEPFLPA

SEQ ID NO: 6655 - protein, 384 aa, Neisseria meningitidis; identical to SEQ ID NO: 708

SEQ ID NO: 6656 - protein, 290 aa, Neisseria meningitidis
MPILNHIALIGVGLIGGSFVLDLKRQGLVRTVTGIDTDRDNLERALERGVIDQASVAIDADSIGGADLVLIATPVATVPAILTALRPVLPEHTWISDVGSTKSSVIEAFRRCLPDRLHHCIAAHPIAGSDRSGAQAAQFGLFRHRKLIITPHGGEHSDGIALVENLWHAVGAEIYTMDAQRHDAVFAAVSHMPHLTAFAYVHQILDHPDGQEYLKFAATGFRDFTRIASGHPAVWADICLANKDSLLQLVQGLGKQLDVLANILTTDDREALYRYFEEAKTTRDRWLDGN

SEQ ID NO: 6657 - protein, 270 aa, Neisseria meningitidis
MDKIRVAAVQMVSGVSPETNVAAMKRLVARAAEQGADWVLLPEYWVLMGANDTDKLALAEPLGGGRFQTALSETAKECGVVLFGGTVPLQSCEAGKVMNTLLVYGRDGVRTGLYHKMHLFGFSGLGERYAEADTIRAGGDVPHLSAEGVPVAAGICYDVRFPEFFRRQLPFDVLMLPAAFTHTTGKAHWELLLRARAVENQCYVVAAAQGGLHENGRRTFGHSMIVDPWGDVLDVLPEGEGVVTADIDANRLNSVRNRLPALKYRVLDAV

SEQ ID NO: 6658 - skipped

SEQ ID NO: 6659 - protein, 321 aa, Neisseria meningitidis
MSYTQLTQGERYHIQYLSRHCTVTEIAKQLNRHKSTISREIRRHRTQGQQYSAEKAQRQSQTIKQRKRQPYKLDSQLIQHIDPLIRRKLSPEQVCAYLRKHHQITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRALKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLIH

SEQ ID NO: 6660 - protein, 284 aa, Neisseria meningitidis; identical to SEQ ID NO: 244

SEQ ID NO: 6661 - protein, 410 aa, Neisseria meningitidis
MPSAHYPEMSEKLMAVLMAMLVTLMPFSIDAYLPAIPEMAQSLNADVHRIEQSLSLFMFGTAFGQVVGGSVSDIKGRKPVALTGLIVYCLAVAAIVFVSSAEQLLNLRVVQAFGAGMTVVIVGAMVRDYYSGRKAAQMFALIGIILMVVPLVAPMVGALLQGLGGWQAIFVFLAAYSLVLLGLVQYFLPKPAVGGKIGRDVFGLVAGRFKRVLKTRAAMGYLFFQAFSFGSMFAFLTESSFVYQQLYRVTPHQYAWAFALNIITMMFFNRVTAWRLKTGVHPQSILLWGIVVQFAANLSQLAAVLFFGLPPFWLLVACVMFSVGTQGLVGANTQACFMSYFKEEGGSANAVLGVFQSLIGAGVGMAATFLHDGSATVMAATMTASTSCGIALLWLCSHRAWKENGQSEYL

SEQ ID NO: 6662 - protein, 362 aa, Neisseria meningitidis
MSQTIDELLLPHRNAIDTIDAEILRLLNERAQHAHAIGELKGTGAVYRPEREVAVLRRIQDLNKGPLPDESVARLFREVMSECLAVERPLTIAYLGPQGTFTQQAAIKHFGHAAHTMACPTIDDCFKQVETRQADYLVAPVENSTEGSVGRTLDLLAVTALQACGEIVLRIHHNLLRKNNGSTEGIAKVFSHAQALAQCNDWLGRHLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKVIGSYPTAVL

SEQ ID NO: 6663 - protein, 263 aa, Neisseria meningitidis
MSEYRVNHEPVFMLASSPWRESSLWVEAFSRRYGRVALLARSARKRQSELRGVLVPFVPVSVSWYGSQELKTLHRAEWVGGWRQPQGRALFGGLYVNELVLKLTAREDPVPELYDALAEVMEAVCCKAAYIDDLRRFEWRLLNLLGVAPDLNRDGDGGTIAAGGTYLVRPETAVFPVGKGFAVPPHAAGVVAPGQSLIDLREGSFRTAESLQQALKITRLFIRHLLPEGLKSRQVLEQIRQFDRKETARETVPTSDGTASNAV

SEQ ID NO: 6664 - protein, 242 aa, Neisseria meningitidis
MLLGVNIDHIATVRNARGTTYPSPVEAALVAETHGADLITMHLREDRRHIKDADVFAVKNAIRTRLNLEMALTEEMLENALKVMPEDVCIVPEKRQEITTEGGLDVLAQQEKIAGFTKILTDAGIRVSLFIDADDRQIQAARDVGAPVVELHTGAYADARSHAEQIRQFERIQNGAHFAGDLGLVVNAGHGLTIHNVTPIAQILAIRELNIGHSLIAQALFLGLPEAVRQMKEAMFRARLLP

SEQ ID NO: 6665 - protein, 74 aa, Neisseria meningitidis
MNQKYILSANNNSLIEEIHNTVQSIGYCIVRGLNLNHLDGSRRNKKLFDFLSQLGMLTNHKGDGFKSIFWDIKY

SEQ ID NO: 6666 - protein, 148 aa, Neisseria meningitidis
MYVVKSANDGGNSLFLSSSDIVNQLSKTETGKKHLKTLTGNLYPFKTPASFDKKQGVRWGNILSVNTQMIRFRSDCIYKGIEENRNKVSKEMVLALDYLINVIKNASDIQEFSAQDDGLIIIDNVNGLHARTDYTDKNRHYIRARITV

SEQ ID NO: 6667 - protein, 255 aa, Neisseria meningitidis; identical to SEQ ID NO: 968

SEQ ID NO: 6668 - protein, 125 aa, Neisseria meningitidis
MIYGIGTDIVSLKRIIRLNKKFGQAFAGRILTPEELLEFPQAGKPVNYLAKRFAAKEAFAKAVGTGIRGAVSFRNIGIGHDALGKPEFFYGPALSKWLEEQGISRVSLSMSDEEDTVLAFVVAEK

SEQ ID NO: 6669 - protein, 269 aa, Neisseria meningitidis
MIQDTRPLIRVVAGILLDSDGNYLLSSRPEGKPYAGYWEFAGGKVEAGETDFQALQREFEEELGIRILAATPWLTKIHSYEHARVCLKFLWVNPDQWTGKPQSREGQEWSWQKAGDFTVAPMLPANGALLRSLSVPRRLYGSLKTGLHGENSMGAYRVLPLGSAEGSGANVLMEAAQWQDRPEHADSVWMVVQTREQWRRAQEKGADAVVWRVCDDVQAQEAAEALRQGVSVPLVLAANGQTVARYGKLWLGLGAHVVVRDETIGKNHE

SEQ ID NO: 6670 - protein, 140 aa, Neisseria meningitidis; identical to SEQ ID NO: 2084

SEQ ID NO: 6671 - protein, 380 aa, Neisseria meningitidis
MNTLYTLFATCPRGLETVLSQELESLGCTDVQVFDGGVSCRGGLEQVYAANLHSRTASRILLRLTKGTYRNERDIYKLAKNINWFNWFTLQQTFKVKVEAKRANVKSIQFVGLTVKDAVCDAFRDIYDARPSVDKAAPDVRIHAFLNERNVEIFIDTSGEALFKRGYRLDTGEAPLRENLAAGLLLSAGYDGTQPFQDPFCGSGTIAIEAAWIAARRAPGMMRRFGFEKLQNFDKTLWSDLRRRAEAQTRPVRAPIAGSDNDRRIVQTALDNARRAGVDDIVSFSVADAQSVRPNGENGIMVSNPPYGVRLEEVRALQALYPQLGTWLKKHYAGWLAAMFTGDREMPKFMCLSPKRKIPLYNGNIDCRLFLIDMVEGSNR

SEQ ID NO: 6672 - protein, 416 aa, Neisseria meningitidis
MIKLTRRQIIRRTAGTLFALSPIASAVAKTVRAPQFTAARIWPSHTYTRLTLESTAALKYQHFTLDNPGRLVVDIQNANINTVLHGLSQKVMADDPFIRSIRAGQNTPTTVRLVIDLKQPTHAQVFALPPVGGFKNRLVVDLYPHGMDADDPMMALLNGSLNKTLRGSPEADLAQNTTPQPGRGRNGRRPVIMLDPGHGGEDPGAISPGGLQEKHVVLSIARETKNQLEALGYNVFMTRNEDVFIPLGVRVAKGRARRADVFVSIHADAFTSPSARGTGVYMLNTKGATSSAAKFLEQTQNNADAVGGVPTSGNRNVDTALLDMTQTATLRDSRKLGKLVLEELGRLNHLHKGRVDEANFAVLRAPDMPSILVETAFLSNPAEEKLLGSESFRRQCAQSIASGVQRYINTSVLKRG

SEQ ID NO: 6673 - protein, 153 aa, Neisseria meningitidis
MSDLPSISRFLADEAATLDLGAAWSSRLNAPLVIYLEGDLGAGKTTLTRGILRGLGHQGAVKSPTYAIVESYPLERFTLHHFDLYRFSFPEEWEDAGLDELFAANSVCLIEWPQQGGEFTPPADITATLTHDGDGRKCLLTAHTERGRESLPL

SEQ ID NO: 6674 - protein, 270 aa, Neisseria meningitidis
MENIGRQRPIGVFDSGIGGLTNVRALMERLPMENIIYFGDTARVPYGTKSKATIENFSMQIVDFLLEHDVKAMVIACNTIAAVAGQKIRQKTGNMPVLDVISAGAKAALATTRNNKIGIIATNTTVNSNAYARAIHRNNPDTLVRTQAAPLLVPLVEEGWLEHEVTRLTVCEYLKPLLADGIDTLVLGCTHFPLLKPLIGREAGNVALVDSAITTAEETARVLAQEGLLNTDNNNPDYRFYVSDIPLKFRTIGERFLGRTMEQIEMVSLG

SEQ ID NO: 6675 - protein, 369 aa, Neisseria meningitidis
MSNWKPNIPYNDLPPLPPKQDIESKTILKRCIAARASLARLKQAAELIPNQAMLINTLPVMEARASSEIENIVTTTDKLFQSLQMDTERQDPATKEALQYRTALFAGYESLTSRPLCTQTAIMVCNAIKHPYEMAIRKTGGTALKGGNSGNVVYTPPEGEETIRGKLANWERFIHESGDLDPLIIMAAAHYQFEAIHPFTDGNGRTGRILNSLLLIEKGLLDLPILYLSRYIIENRADYYRLLLGVTERQDWESWIIYILDGVADTADWTVSKIDAIRRLFEQTRQHIRTHAQGIYTHELVNLLFEQPYTRIANLEAAGIAKRQTASKYLKELSDIGVLQEIVIGRDKLFIHPRLMELLRGEGNSFTSF

SEQ ID NO: 6676 - protein, 712 aa, Neisseria meningitidis
MNNPLVNQAAMVLPVFLLSACLGGGGSFDLDSVDTEAPRPAPKYQDVFSEKPQAQKDQGGYGFAMRLKRRNWYPQAKEDEVKLDESDWEATGLPDEPKELPKRQKSVIEKVETDSDNNIYSSPYLKPSNHQNGNTGNGINQPKNQAKDYENFKYVYSGWFYKHAKREFNLKVEPKSAKNGDDGYIFYHGKEPSRQLPASGKITYKGVWHFATDTKKGQKFREIIQPSKSQGDRYSGFSGDDGEEYSNKNKSTLTDGQEGYGFTSNLEVDFHNKKLTGKLIRNNANTDNNQATTTQYYSLEAQVTGNRFNGKATATDKPQQNSETKEHPFVSDSSSLSGGFFGPQGEELGFRFLSDDQKVAVVGSAKTKDKPANGNTAAASGGTDAAASNGAAGTSSENGKLTTVLDAVELKLGDKEVQKLDNFSNAAQLVVDGIMIPLLPEASESGNNQANQGTNGGTAFTRKFDHTPESDKKDAQAGTQTNGAQTASNTAGDTNGKTKTYEVEVCCSNLNYLKYGMLTRKNSKSAMQAGESSSQADAKTEQVEQSMFLQGERTDEKEIPSEQNIVYRGSWYGYIANDKSTSWSGNASNATSGNRAEFTVNFADKKITGTLTADNRQEATFTIDGNIKDNGFEGTAKTAESGFDLDQSNTTRTPKAYITDAKVQGGFYGPKAEELGGWFAYPGDKQTKNATNASGNSSATVVFGAKRQQPVR

SEQ ID NO: 6677 - protein, 915 aa, Neisseria meningitidis
MQQQHLFRFNILCLSLMTALPAYAENVQAGQAQEKQLDTIQVKAKKQKTRRDNEVTGLGKLVKSSDTLSKEQVLNIRDLTRYDPGIAVVEQGRGASSGYSIRGMDKNRVSLTVDGVSQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIHTGRRAGEIRAHEDAGRGVQSFNRLVPVEDSSNYAYFIVKEECKNGSYETCKANPKKDVVGKDERQTVSTRDYTGPNRFLADPLSYESRSWLFRPGFRFENKRHYIGGILEHTQQTFDTRDMTVPAFLTKAVFDANKKQAGSLPGNGKYAGNHKYGGLFTNGENGALVGAEYGTGVFYDETHTKSRYGLEYVYTNADKDTWADYARLSYDRQGIGLDNHFQQTHCSADGSDKYCRPSADKPFSYYKSDRVIYGESHRLLQAAFKKSFDTAKIRHNLSVNLGFDRFGSNLRHQDYYYQHANRAYSSNTPPQNNGKKISPNGSETSPYWVTIGRGNVVTGQICRLGNNTYTDCTPRSINGKSYYAAVRDNVRLGRWADVGAGLRYDYRSTHSDDGSVSTGTHRTLSWNAGIVLKPTDWLDLTYRTSTGFRLPSFAEMYGWRAGVQSKAVKIDPEKSFNKEAGIVFKGDFGNLEASWFNNAYRDLIVRGYEAQIKDGKEEAKGDPAYLNAQSARITGINILGKIDWNGVWDKLPEGWYSTFAYNRVRVRDIKKRADRTDIQSHLFDAIQPSRYVVGLGYDQPEGKWGVNGMLTYSKAKEITELLGSRALLNGNSRNTKATARRTRPWYIVDVSGYYTVKKHFTLRAGVYNLLNYRYVTWENVRQTAGGAVNQHKNVGVYNRYAAPGRNYTFSLEMKF

SEQ ID NO: 6678 - protein, 459 aa, Neisseria meningitidis
MQAFSLYPPVGHPDSAKKRQNRADVFLPFWKQDNFLGKSVQYRFEFAQIYFTMPKPCAGVTMGRGDFFFSNLFHQESARMKKSVLAVLAALSLAACGGSEKNAVQPQADAASAANAEAAATDTLNIYNWSNYVDESTVEDFKKANNLKLTYDLYENNETLEAKMLTGKSGYDLVVPGIAFLPRQIEAGAYQKVNKDLIPNYKNIDPELLKMLETADPGNQYAVPYFSGVNTIAITAKGKELLGGKLPENGWDLLFKPEYTHKLKSCGIALWDTPSEMFPILLNYLGKDPKGSNPEDLKAAAEVLKSIRPDVKRFSPSIIDELARGDICLAAGNGGDLNLAKARSEEVKNNVGIEVLTPKGMGFWIESWLIPADAKNVANAHKYINYTLDPEIAAKNGIAVTFAPASKPAREKMPAELVNTRSIFPNEQDMKDGFVMPQMSTDAKKLSVSLWQKIKVGTN

SEQ ID NO: 6679 - protein, 87 aa, Neisseria meningitidis
MANSAQARKRARQSVKQRAHNASLRTAFRTAVKKVLKAVEAGDKAAAQAVYQESVKVIDRIADKGVFHKNKAARHKSRLSAKVKALA

SEQ ID NO: 6680 - protein, 382 aa, Neisseria meningitidis
MPTMGAEMNTRNMRYILLTGLLPMASAFGETALQCAALTDNVTRLACYDRIFAAQLPSSAGQEGQESKAVLNLTETVRSSLDKGEAVIVVEKGGDALPADSAGETADIYTPLSLMYDLDKNDLRGLLGVREHNPMYLMPLWYNNSPNYAPGSPTRGTTVQEKFGQQKRAETKLQVSFKSKIAEDLFKTRADLWFGYTQRSDWQIYNQGRKSAPFRNTDYKPEIFLTQPVKADLPFGGRLRMLGAGFVHQSNGQSRPESRSWNRIYAMAGMEWGKLTVIPRVWVRAFDQSGDKNDNPDIADYMGYGDVKLQYRLNDRQNVYSVLRYNPKTGYGAIEAAYTFPIKGKLKGVVRGFHGYGESLIDYNHKQNGIGIGLMFNDLDGI

SEQ ID NO: 6681 - protein, 233 aa, Neisseria meningitidis
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSESLLSDSSRSFKTPVLVPFPQPGIWTIAFVSGQVSNAVKAALPKDGDYLSVYVPTTPNPTGGYYIMVKKSDVRELDMSVDEALKYVISLGMVIPDDLPVKTLAGPMPSEKADLPEQQ

SEQ ID NO: 6682 - protein, 602 aa, Neisseria meningitidis
MRTNYCGLISEQYLDQTVTVKGWVHRRRDHGGVIFIDLRDREGIVQVVIDPDTPEAFAAADSSRNEYVLSITGRVRNRPEGTTNDKMISGKIEILAKEIEVLNAAATPPFQIDDENISENVRLTNRVIDLRRPVMQRNLRLRYQVAMGVRRYLDAQGFIDIETPMLTRSTPEGARDYLVPSRVHPGEFFALPQSPQLFKQLLMVAGFDRYYQITKCFRDEDLRADRQPEFTQIDLETSFLNEDEIMDITEGMAKQVFKDALNVDLGDFPRMPYSEAMFYYGSDKPDMRINLKFTELTDLMKTEEFKVFRGAADMKGGRVVALRVPNGAEFSRKEIDEYTKFVGIYGAKGLAYIKVNDVSNLSNGEDSGLQSPIVKYLSENALKEIIARTGAQNGDIIFFGADKAKVVNEAIGALRIKVGLEHGKDNGYFTDEWKPLWVVDFPMFEYDEEADRYVAVHHPFTAPKEGHEDLMVSDPANCLARAYDMVLNGWEIGGGSIRIHRADVQEKVFAALKISPEEQQEKFGFLLDNLKFGAPPHGGLAFGLDRLVTLMTGAESIRDVIAFPKTQRAQCLLTNAPNSVDDKQLRELSLRLRQKATETKEV

SEQ ID NO: 6683 - protein, 94 aa, Neisseria meningitidis; identical to SEQ ID NO: 3732

SEQ ID NO: 6684 - protein, 630 aa, Neisseria meningitidis
MPILTIREVCNINHWGIGYYDVDDSGEIIVRPNPSQHNQTVSLQKLTEAVQQKHQARLPVLFCFPQILEHRLRDINRAFQTAREECGYKGGYCLVYPIKVNQHRRVIESLMSSGQPHGLEAGSKAELMAVLAHAGNRQTLIVCNGYKDREYIRFALMGEKLGHQVYLVIEKLSEIQMVLEEAEKLGIKPRLGVRARLASQGSGKWQSSGGEKSKFGLSASQVLQLVDILKQKNRLDCLQLLHFHLGSQLGNIRDVATGVHESARFYVELHKLGVNIRCFDVGGGLGVDYEGNRTQSDCSVNYSLNEYAATVVWGISQACLEHGLPHPTIITESGRGITAHHAVLVANVIGVERYKPRRLDAPSPEAPRVLHSMWETWTDISASREKRSLRSWIHEGQFDLADVHNQYNVGLLSLAQRAWAEQLYLNICHEVGELFNEKHRSHRTIIDELQERFADKLYVNFSLFQSLPDAWGIDQLFPVCPITGLNEPIARRAVLLDITCDSDGTIDHYIDGDGIAGTMPMPDYPEEEPPLLGFFMVGAYQEILGNMHNLFGDTATADVVVGEDGQFTVIDYDEGNTVADMLEYVYQDPKELMKRYREQIEHSDLPASQAMSFLKELEAGLNGYTYLEDE

SEQ ID NO: 6685 - protein, 307 aa, Neisseria meningitidis
MQYSTLAGQTDNSLVSNNFGFLRLPLNFMPYESHADWVITGVPYDMAVSGRSGARFGPEAIRRASVNLAWEHRRFPWTFDVRERLNIIDCGDLVFSFGDSRDFVEKMEAHAGKLLSSGKRCLSLGGDHFITLPLLRAHARYFGKLALIHFDAHTDTYDNGSEYDHGTMFYTAPKEGLIDPSRSVQIGIRTEHSKKLPFTVLSAPKVNEDSVEETVRKIKETVGNMPVYLTFDIDCLDPSFAPGTGTPVCGGLSSDRALKILRGLTDLDIVGMDVVEVAPSYDQSDITALAGATIALEMLYLQGAKKD

SEQ ID NO: 6686 - protein, 488 aa, Neisseria meningitidis
MMKLGFKPIPLAIAAVLCALVLALPVPDGVKPQAWTLLAMFVGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 6687 - protein, 358 aa, Neisseria meningitidis
MICRKPIGHTPYFDMNKTICRTAALLISGFSYANTIIPDVSPVAQGQHVFINIPQQRLFLYTDGKLTKVYPVAVGRAMTQTNLGEHKIGAKAYNPVWYIPKSIQKERGDGVKTIAAGPDNPLGPVFVRLGDPKLGLGIHGTNAPASVPGVRSHGCVRMKSPDALEFAKTIASGSPASVIYQMAGLNEDADRNLWLAAFRDPYGKNNLDIASLKKSIAQWAKTQGKTIAPEKVDAVLKDRTGSAVCLTCGKNGKMKMPLKSLAWIQGSSSYSQAEVIEQTEETNSAEISETRTPEVPDVHTPEAQPHLNTQSDGTPTAYTEPAADSSPQVETPDQAASEPVDVLFSIDVIRQGNLRLGN

SEQ ID NO: 6688 - protein, 380 aa, Neisseria meningitidis
MKVFKQQLEQLGAQNQYRSIPDLIHQGRYITRENRKMLNMSSNDYLGLASDENLRRSFLQQYGGNFPSFTSSSSRLLTGNFPIYTDLEELVAQRFQRESALLFNSGYHANLGILPALTTTKSLILADKFVHASMIDGIRLSRCAFFRYRHNDYEHLKNLLEKNVGKFDRTFIVTESVFSMDGDVADLKQLVQLKKQFPNTYLYVDEAHAIGVYGQNGLGIAERDNLIAEIDLLVGTFGKALASVGAYAVCNQVLKECLINQMRPLIFSTALPPFNVAWTYFIFERLPQFSKERSHLEQLSAFLRREVAHRTQIMPSQTCIVPYILGGNEATLAKAEYLQRQGYYCLPIRPSTVPKNTSRIRLSLTADMTTDEVRQFAACL

SEQ ID NO: 6689 - protein, 215 aa, Neisseria meningitidis
METKFYNHQGGHLILYFAGWGTPPDAVNHLILPENHDLLICYDYQDLNLDFDFSAYRHIRLVAWSMGVWAAERALQGIRLKSATAVNGTGLPCDDNFGIPCTVFKGTLENLTENTRLKFERRMCGDKASFEDYQQFPARPFGEIHQELIALFAMIGQDRRTDLIRWTNALVGSGDKIFMPANQHRYWTPRCTVREIDVGHYLFSRFTHWSALWNH

SEQ ID NO: 6690 - protein, 260 aa, Neisseria meningitidis
MESLTAINKSRIRQAFQKALNDYDRHALIQQKMTINLMTHLQDYLPDMPLENVLELGCGSGMLSALLQKQISANYWLFNDLCNVQPQLAEKLPQSFDFYCGDAENFPFQRQFDLIASASAVQWFHQPDAFITHCKTGLKTNGLLAVATFGKDNLKEVRQITNIGLNYPTLSQWQAWLAKDFELLWCEDFTVILDFDTPSDVLKHLKYTGVTATNQKNWTRKNLNGFIGDYLSAFGMPSGKVRLTYHPLFFIARYSAAGRQ

SEQ ID NO: 6691 - protein, 463 aa, Neisseria meningitidis
MLLVMRAKQGKKTPKRKSQGVGNTQGQTPGSNDSDWVDQIGQSVSDGTQPDWSWNESAETASAAVSAQEVDPLTEYQVYKQFGYQGKAAESLAAYLDGIPDGEAKPENLIRELLDINLEVGDVDVLADNLQKYGKLILSELLAKYIEQALQRDSNHLRIRVLAEEGLGWGTQEIEKRAEGGSATAASASPPPDAGGKAYEAEEIKRIPIVRGKKDVSGISQEEIGAIAGLVRADQGAKILKDKVSYETASKQYDRAIQTSEKPANLIIDALKLDYQHADIDRFAGHLWKLYQTLGNYGRQVKERMLGWGYSLGYHEVFDDLEKGPNDRQIKDIGMGHGYLPKNIQKFKSQHRDLVLQDSSLINTGSSPADDAVKEVESLLMYGQIEAAMDVLEQAVLKYPDESQLYITLIDIYERTEDWDRLGQFLRVLRERADRLPEEVVMLMSRLLQRMNQNIKKIKRYGK

SEQ ID NO: 6692 - protein, 365 aa, Neisseria meningitidis
MEVQLPKIKTVRVMLAGMTAQQESVFKMAFKMHNTTRYETVSPSDGSAVPDLVLADTDAEGGFELWKELAERYKDIPVAVCSEKVPDSEVPYLPKPIRFETLFPMLRKLLQGENVYGKSFIAPADRSAKNNGNVQRTVTIRQFNPNKGLLGALRFAEKNRQDIAILHGNKPVLIVFPSIQRVLLTESVQKLEELCKDENLQVSCKTVPDNPQWREKAKVGIMSCMWQFSIWTAQGRLIYPISPDTPFTLKSWPNLTRLANVPGSIRLSAFLTKASVNLNVLYKVMPLNLNDILNYLAATYTTGFLSVDLKTVSQQAYSDMADKINIGADSASDSEMMKKAEKITTPSQSQSRGLLQRLMKKLLGS

SEQ ID NO: 6693 - protein, 178 aa, Neisseria meningitidis
MRENKIIFTGPVGVGKTTAIAAISDEALVQTDASASDMTLDRKRNTTVAMDYGAISLDEDTKVHLYGTPGQERFNFMWEILSQGSMGLVLLLDNARTNPLKDLEFFLHSFRGLLEKAPVVVGITKMDIRSQPGIDVYHKYLAKHNLNVPVFEIDARKEDDVKQLVSAMLFSIDPGLEV

SEQ ID NO: 6694 - protein, 214 aa, Neisseria meningitidis; identical to SEQ ID NO: 612

SEQ ID NO: 6695 - protein, 119 aa, Neisseria meningitidis
MQQLLISILEDLNNTSTDIIASAVISTDGLPMATMLPSHLNSDRVGAISATLLALGSRSVQELACGELEQVMIKGKSGYILLSQAGKDAVLVLVAKETGRLGLILLDAKRAARHIAEAI

SEQ ID NO: 6696 - protein, 131 aa, Neisseria meningitidis
MMYSFEANANAVKISETVSVDTGQGAKIHKFVPKNSKTYSSDLIKTVDLTHIPTGAKARINAKITASVSRAGVLAGVGKLARLGAKFSTRAVPYVGTALLAHDVYETFKEDIQARGYQYDPETDKFAKVSG

SEQ ID NO: 6697 - protein, 110 aa, Neisseria meningitidis
MKGRTMNKPFITQAQLALYKYQPSSKYFGQSMAVIAQSEFVEFAKINKSENVIDCFSFFWNRRIKHDIWLISFSDNSEMVIKESLKDGHKIYKFEFCEIVDNCNFDDVFV

SEQ ID NO: 6698 - protein, 92 aa, Neisseria meningitidis
MYYQVGNKCLEKHQAENLYFSLVVPRIKENGQIVRPEYNGSLWKMSDGQPLRLLLAECSPKDNLQSGLETGWIVFGILASVYFVSLLKKVLK

SEQ ID NO: 6699 - protein, 94 aa, Neisseria meningitidis
MFGGRLKNAPSITAKHFLKENIMKFINTCRKYGAKLAVVTAAPLALAAHANATLPDTAKNALEAAKADGMEAGWIVVGIFAALFVFSIVKRVMK

SEQ ID NO: 6700 - protein, 65 aa, Neisseria meningitidis
MQKVYVVQSVSTGDFLYLSPETGDIGHTKLITNADYFYDFEEAINAGLEEIGNQYEFVVFGFLKD

SEQ ID NO: 6701 - protein, 96 aa, Neisseria meningitidis
MNIQLQGHIVGVKKINGQIEGKSFDYCCLIVATPLDSSQGNALGSSTTEYDFGGSANFEQFRNAQFPIEANLNVEIVTTGKTQKLKVIGFQLVKKG

SEQ ID NO: 6702 - skipped

SEQ ID NO: 6703 - protein, 31 aa, Neisseria meningitidis
MRFSRSKPRGRLKTEKPFQTALYIASLRRDD

SEQ ID NO: 6704 - protein, 164 aa, Neisseria meningitidis
MTFNQEQDYWAGYKANERALIIQTWSGFGRYAPDHLYPPHILPLDTDNETLGTTVLQALANSRTFVYDSPEDQDFFDTEKIRQRYEDWVAKLCGNLGYKTRRALFKNMMSVDIWLHNGCLKISPSRHVKLEAWDAIDADDVILSLDNSPEEIGAGLKLALSRCR

SEQ ID NO: 6705 - protein, 293 aa, Neisseria meningitidis
MRTDAFKYGTWNSLNDIRSSYDRAATKIKGAGNMGLGATTFVGSGAIGGGLCSTGIGCAAGGLIATAGMTGGYTQASEGSRQLFGTYQSDFGKKVVLSLGTPIEYESPLVSDAKNLAVWGLETLITRKLGNLATGVKTSLTPKTADVQRNILSQSEVGIKWGKGIEGQGMPWEDYVGKGLSANARLPKNFKTFDYFDRGTGTAISAKTLDTQTTARLSKPEQLYSTMKGYIDKTANFKSYELSEVPLRADMIKQREIHLAIPAQTNKEQRLQLQRVVEYGKSQNITVKITEIE

SEQ ID NO: 6706 - protein, 300 aa, Neisseria meningitidis
MTVGYGFSASGDYSQSKIRADHASVTEQSGIYAGEDGYQIKVRDNTDLKGGIITSSQSAEDKGKNLFQTATLTHSDIQNHSRYEGKSFGIGGSFDLNGGWDGTVTDKQGRPTDRISLAAGYGSDSDSQSSITKSGINTRNIHITDEAGQLARTGRTAKETEARIYTGIDTETADQHSGRLKNSFDKDAVAKEINLQREVTKEFGRNATQAVAAVADKLGNTQSYERYQEARTLLEAELQNTDSEAEKAAFRASLGQVNAYLAENQSRYDTWKEGGIGRSILHGAGRQSAMRRAGMSVRRQ

SEQ ID NO: 6707 - protein, 147 aa, Neisseria meningitidis
MAIFYFSSKKIERNIISSNLNRKQVRAIFSSDVQEIYKSSYSRVPMDVFPELNIHCFYDDKNQLEAIEIFEPNKFFLEDISFNWLGKINDEIISYLYKSGINDFEIDDLGIRLLNIPVSTIINSIGKVECCYLDFSNRDTKFYVKQV

SEQ ID NO: 6708 - protein, 107 aa, Neisseria meningitidis
MSILEENVIDSASIENGILILTISDHLKWDNEHLFLLQEKINSYIQYIESGQIFEDFGESSYETIEIQLIYKYKPNENYRKFLYRLEGALLKLKLRFSHGTISYFYS

SEQ ID NO: 6709 - protein, 2703 aa, Neisseria meningitidis
MNRTLYKVVFNKHRNCMIAVAENAKREGKNTADTQAVGILPNDIAGFAGFIHSISVISFSLSLLLGSALILTSSSATAQGIVADKSAPAQQQPTILQTGNGIPQVNIQTPTSAGVSVNQYAQFDVGNRGAILNNSRSNTQTQLGGWIQGNPWLARGEARVVVNQINSSHSSQLNGYIEVGGRRAEVVIANPAGIAVNGGGFINASRATLTTAQPQYQAGDLSGFKIRQGNVVIAGHGLDARDTDYTRILSYHSKIDAPVWGQDVRVVAGQNDVAATGDAHSPILNNAAANTSNNTANNGTHIPLFAIDTGKLGGMYANKITLISTVEQAGIRNQGQWFASAGNVAVNAEGKLVNTGMIAATGENHAVSLHARNVHNSGTVASQDDANIHSQTLDNSGTVLSSGRLTVRNLGRLKNQNNGTIQAARLDMSTGGLDNTGNITQTGSQALDLVSAGKFDNSGKIGVSDVPQTGLNPNPSVIPQIPSTATGSGSSTVSVSKPGSNNPVSPTAPAKNYAVGRIQTTGAFDNAGSINAGGQIDIAAQNGLGNSGSLNAAKLRVSGDSFNNTVKGKLQAHDLAVNTQTAKNSGHLLTQTGKIDNRELHNAGEIAANNLTLIHSGRLSNDKKGNIRAAHLQLDTAGLHNAGNILADSGTVTTKNNLRNTGKVSVARLNTEGQTLDNTRGRIEAETVNIQSQQLTNQSGHITATEQLTINSRNVDNQNGKLLSANQAQLAVSDGLYNQHGEIATNRQLSIHDKNQNTLALNNADGTIQSAGNVSLQAKSLANNGTLTAGNKLDIALTDDFVVERDLTAGKQLNLSIKGRLKNTHTLQAGHTLKLNAGNIDNQVTGKIIGGEQTDITSEQHVDNRGLINSDGLTHIGAGQTLTNTGTGKIYGNHIALDAQILLNREETTEGSTKAGAIAARKRLDIGAKEIHNQEGALLSSEGIFAVGNRLDEQHHAAGMADTFVNGSAGLEVQGDALMSVRNMQNINNHFKTETYLAKAEKQVRDYTVLGQNTYYQAGKDGLFDNSQGQKDQTTATFHLKNGSRIEANQWHVRDYHIETYKERIIENRPAHITVGGDLTASGQNWLNKDSRIVVGGRIITDDLNQKEITNQSTTGKGRTDAVGTQWDSVTKKGWYSGRKRQRRTERNHTPYHDTQLFTHDFDTPVSVIQQNAASPSFQPAASAIKLIDGVSTAAVNGQRIHTGNVVSLNNATVTLPNSSLYTTHPDNKGWLVETDPQFADYRRWLGSDYMLQQLQLDTNHLHKRLGDGYYEQKLVNEQIHQLTGYRRLDGYRSDEEQFKALMDNGLTAAKTFGLTPGIALSAEQVARLTSDIVWMENQTVTLSDGSTQTVLVPKVYALARKGDLNTSGGLISAEQVLLKLQNGNLTNSGTIAGRQAVLIQARNINSNGNIQADQIGLKAEKSINIDGGQVQAGRLLTAQAQNINLNGTTQTSGNERNGNTAIDRMAGINVVGSHTEQVDNRTSDGILSLHASNDINLNAATVSNQVKDGTTQITAGNNLNLGTIRTEHREAYGTLDDENHRHVRQSTEVGSSIRTQNGALLRAGNDLKIRQGELEAEEGKTVLAAGRDVTISEGRQITELDTSVSGKSKGILSSTKTHDRYRFSHDEAVGSNIGGGKMIVAAGQDINVRGSNLISDKGIVLKAGHDIDISTAHNRYTGNEYHESKKSGVMGTGGLGFTIGNRKTTDDTDRTNIVHTGSIIGSLNGDTVTVAGNRYRQTGSTVSSPEGRNTVTAKSIDVEFANNRYATDYAHTQEQKGLTVALNVPVVQAAQNFIQAAQNVGKSKNKRVNAMAAANAAWQSYQATQQMQQFAPSSSAGQGQNNNQSPSISVSITYGEQKSRNEQKRHYTEAAASQIIGKGQTTLAATGSGEQSNINITGSDVIGHAGTALIADNHIRLQSAKQDGSEQSKNKSSGWNAGVAVKIGNGIRFGITAGGNIGKGKEQGGSTTHRHTHVGSTTGKTTIRSGGDTTLKGVQLIGKGIQADTRNLHIESVQDTETYQSKQQNGNVQVTVGYGFSASGSYRQSKVKADHASVTGQSGIYAGEDGYQIKVRDNTDLKGGIITSSQSAEDKGKNLFQTATLTASDIQNHSRYEGRSFGIGGSFDLNGGWDGTVTDKQGRPTDRISPAAGYGSDGDSKNSTTRSGVNTHNIHITDEAGQLARTGRTAKETEARIYTGIDTETADQHSGHLKNSFDKDAVAKEINLQREVTKEFGRNAAQAVAAVADKLGNTQSYERYQEARTLLEAELQNTDSEAEKAAFRASLGQVNAYLAENQSRYDTWKEGGIGRSILHGAAGGLTTGSLGGILAGGGTSLAAPYLDKAAENLGPAGKAAVNALGGAAIGYATGGSGGAVVGANVDWNNRQLHPKEMALADKYAEALKREVEKREGRKISSQEAAMRIRRQILRWVDKGSQDGYTDQSVISLIGMKGEDKALGYTWDYRDYGARNPQTYNDPKLFEEYRRQDKPEYRNLTWLHSGTKDTKIRQGERKNEEFALNVAEGLTSLVNPNPRIKVPILAGIRNLKNIKPTVTGSDPLLAGAGNIRIPANGNVAKGDRIPDTALASKGIKHKNRKDQLEKNKKSGEDFEMEIYQKKVKQGFKPQRQITVKTKSGVKTRLDIISKEGGLDVCTECKASITAPLTKNQKKAFPEIERTGATVVGKGKPGYPKGTKIEPTKVIIERKR

SEQ ID NO: 6710 - protein, 161 aa, Neisseria meningitidis
MNDYTAMPSEDGGIGSLSLPPHSMEAEQSVLGGLMLENPAWDRIADVVSGEDFYRHEHRLIFRSIAKLINESRPADVITVQEDLQRNEELEAAGGFEYLITLAQNTPSAANIRRHAEIVRERSIMRQLAEVGTEIARSAIPKISAAERAVAWSTKNSSSFF

SEQ ID NO: 6711 - protein, 327 aa, Neisseria meningitidis
MLLTLHGTDKFCIVNNFHTNRNTAYKALKDACNNLFERQFSFIEKTPKGEKVVRTRWVSQVAYIEQQATVELVFAPNVAPLITMLEKNFTSYELDQVSSLSSKYAVRLYEIIISWRAAGKTPMFSTMELRERLGMMPDEYQKMELFKRKVLDFAVKQINDKTDISITYEQHKEGRKIVGFTFSILHKIGSKDIPLENQSELFAGMTDLEAGTIRVRAEAYIASLIAKGQNVTKAHRLNILKKAVEERWGFEDVAKDNGAKNPENKNAKVVLNEWEKISNGTRFKDKDGTIWVKDSGMLRTEGTNRWIADSQIAKLFPMLTVMVEEGI

SEQ ID NO: 6712 - protein, 559 aa, Neisseria meningitidis; identical to SEQ ID NO: 3352

SEQ ID NO: 6713 - protein, 1975 aa, Neisseria meningitidis
MNKGLHRIIFSKKHSTMVAVAETANSQGKGKQAGSSVSVSLKTSGDLCGKLKTTLKTLVCSLVSLSMVLPAHAQITTDKSAPKNQQVVILKTNTGAPLVNIQTPNGRGLSHNRYTQFDVDNKGAVLNNDRNNNPFVVKGSAQLILNEVRGTASKLNGIVTVGGQKADVIIANPNGITVNGGGFKNVGRGILTTGAPQIGKDGALTGFDVRQGTLTVGAAGWNDKGGADYTGVLARAVALQGKLQGKNLAVSTGPQKVDYASGEISAGTAAGTKPTIALDTAALGGDSITLIANEKGVGVKNAGTLEAAKQLIVTSSGRIENSGRIATTADGTEASPTYLSIETTEKGAAGTFISNGGRIESKGLLVIETGEDISLRNGAVVQNNGSRPATTVLNAGHNLVIESKTNVNNAKGPATLSADGRTVIKEASIQTGTTVYSSSKGNAELGNNTRITGADVTVLSNGTISSSAVIDAKDTAHIEAGKPLSLEASTVTSDIRLNGGSIKGGKQLALLADDNITAKTTNLNTPGNLYVHTGKDLNLNVDKDLSAASIHLKSDNAAHITGTSKTLTASKDMGVEAGSLNVTNTNLRTNSGNLHIQAAKGNIQLRNTKLNAAKALETTALQGNIVSDGLHAVSADGHVSLLANGNADFTGHNTLTAKADVNAGSVGKGRLKADNTNITSSSGDITLVAGNGIQLGDGKQRNSINGKHISIKNNGGNADLKNLNVHAKSGALNIHSDRALSIENTKLESTHNTHLNAQHERVTLNQVDAYAHRHLSITGSQIWQNDKLPSANKLVANGVLALNARYSQIADNTTLRAGAINLTAGTALVKRGNINWSTVSTKTLEDNAELKPLAGRLNIEAGSGTLTIEPANRISAHTDLSIKTGGKLLLSAKGGNAGAPSAQVSSLEAKGNIRLVTGETDLRGSKITAGKNLVVATTKGKLNIEAVNNSFSNYFPTQKAAELNQKSKELEQQIAQLKKSSPKSKLIPTLQEERDRLAFYIQAINKEVKGKKPKGKEYLQAKLSAQNIDLISAQGIEISGSDITASKKLNLHAAGVLPKAADSEAAAILIDGITDQYEIGKPTYKSHYDKAALNKPSRLTGRTGVSIHAAAALDDARIIIGASEIKAPSGSIDIKAHSDIVLEAGQNDAYTFLKTKGKSGKIIRKTKFTSTRDHLIMPAPVELTANGITLQAGGNIEANTTRFNAPAGKVTLVAGEELQLLAEEGIHKHELDVQKSRRFIGIKVGKSNYSKNELNETKLPVRVVAQTAATRSGWDTVLEGTEFKTTLAGADIQAGVGEKARADAKIILKGIVNRIQSEEKLETNSTVWQKQAGRGSTIETLKLPSFESPTPPKLTAPGGYIVDIPKGNLKTEIEKLAKQPEYAYLKQLQVAKNVNWNQVQLAYDKWDYKQEGLTRAGAAIVTIIVTALTYGYGATAAGGVAASGSSTAAAAGTAATTTAAATTVSTATAMQTAALASLYSQAAVSIINNKGDVGKALKDLGTSDTVKQIVTSALTAGALNQMGADIAQLNSKVRTELFSSTGNQTIANLGGRLATNLSNAGISAGINTAVNGGSLKDNLGNAALGALVNSFQGEAASKIKTTFSDDYVAKQFAHALAGCVSGLVQGKCKDGAIGAAVGEIVADSMLGGRNPATLSDAEKHKVISYSKIIAGSVAALNGGDVNTAANAAEVAVVNNALNFDSTPTNAKKHQPQKPDKTALEKIIQGIMPAHAAGAMTNPQDKDAAIWISNIRNGITGPIVITSYGVYAAGWTAPLIGTAGKLAISTCMANPSGCTVMVTQAAEAGAGIATGAVTVGNAWEAPVGALSKAKAAKQAIPTQTVKELDGLLQESKNIGAVNTRINIANSTTRYTPMRQTGQPVSAGFEHVLEGHFHRPIANNRSVFTISPNELKVILQSNKVVSSPVSMTPDGQYMRTVDVGKVIGTTSIKEGGQPTTTIKVFTDKSGNLITTYPVKGN

SEQ ID NO: 6714 - protein, 169 aa, Neisseria meningitidis
MSNFEKKYILELNDALSHLNHNSTSFDLLKVLISWLSNDIVIDKFKILGYDFSKYIEMNPDDYPVEKSILNREEIIYLKNNIYRKISSGNFKFQYFVQYIRDILEYLFIEHIERVCPYCEWGEMQKLEEQNTHETVYLCTQCGCAFYNDNSQFLLKTPLTIPMKRDEFK

SEQ ID NO: 6715 - protein, 540 aa, Neisseria meningitidis; identical to SEQ ID NO: 3924

SEQ ID NO: 6716 - protein, 125 aa, Neisseria meningitidis
METLNDIKKILINVGLYQGFDLTDPKVSEEVNHETANMKWIKDYTSDGNWDNEFKEDLKNFLDYMEVCQLALNDKNFKIASNSLFMAMIYAGNLSLIFDSIKTDISTLLSAEYKKNSFSWPSLDE

SEQ ID NO: 6717 - protein, 124 aa, Neisseria meningitidis
MKNFNVVKESLRELGIKQGFDLYEKATTEKLNSEDPLDLQWLSNYSSDWNDELEEDFDSFFQHMKEYQYAIDNEDIKSACSSLCEAMLYVGNIKNFFEFLKSDMIRLLRGESKTTDFQWPQFDE

SEQ ID NO: 6718 - protein, 650 aa, Neisseria meningitidis
MRKVCASARTRSMIYGSMPSEKLTIFQTAFVMQVNIQIPYILPRCVRAEDTPYACYLKQLQVTKDVNWNQVQLAYDKWDYKQEGLTGAGAAIIALAVTVVTAGAGAGAALGLNGAAAAATDAAFASLASQASVSLINNKGNIGNTLKELGRSSTVKNLMVAVATAGVADKIGASALNNVSDKQWINNLTVNLANAGSAALINTAVNGGSLKDNLEANILAALVNTAHGEAASKIKQLDQHYITHKIAHAIAGCAAAAANKGKCQDGAIGAAVGEIVGEALTNGKNPDTLTAKEREQILAYSKLVAGTVSGVVGGDVNAAANAAEVAVKNNQLSDKEGREFDNEMTACAKQNNPQLCRKNTVKKYQNVADKRLAASIAICTDISRSTECRTIRKQHLIDSRSLHSSWEAGLIGKDDEWYKLFSKSYTQADLALQSYHLNTAAKSWLQSGNTKPLSEWMSDQGYTLISGVNPRFIPIPRGFVKQNTPITNVKYPEGISFDTNLKRHLANADGFSQKQGIKGAHNRTNFMAELNSRGGRVKSETQTDIEGITRIKYEIPTLDRTGKPDGGFKEISSIKTVYNPKKFSDDKILQMAQNAASQGYSKASKIAQNERTKSISERKNVIQFSETFDGIKFRSYFDVNTGRITNIHPE

SEQ ID NO: 6719 - protein, 143 aa, Neisseria meningitidis
MKNNIFLNLNKKSINNNHFVISIFFETIYQFETKDTLLECFKNITTTGHFGVIGAQYEKIDATRWIGDYEEVNGFEYIDKAPSIYFSVGDDFNPEELIIPINLAYHYFNIAISDFLIAHPEYQKKCKEIQKTYSQTNCSLHET

SEQ ID NO: 6720 - protein, 71 aa, Neisseria meningitidis
MPMRTVASCSAPRISVRKTAKSKFNLTVTNITMRDRANSIPLNAAATKLANGTTANTLPKSKNTKTPSPTQ

SEQ ID NO: 6721 - protein, 94 aa, Neisseria meningitidis
MLLPRPACFCHRVDLLLLTVSVWMLLLIPSRIILASARACSPTPARMVAPPSVVSNCVPCSLVSQPDCRLADSATTLEGSAVFMTWVVVSCALL

SEQ ID NO: 6722 - protein, 506 aa, Neisseria meningitidis
MTPAAAAVVVIVVTVLTYGALSAPAAAGTAGAAGAGAGGAAAGTAAGTGVAAGTAATTGVAAGTSAAAITTAAGKAALASLASQAAVSLINNKGDINHTLKELGKSSTVRQAATAAVTAGVLQGISGLNTQAAEAVSKHFHSPAAGKLTANLINSTAAASVHTAINGGSLKDNLGDAALGAIVSTVHGEVASKIKFNLSEDYIAHKIAHAVAGCASAVANKGKCRDGAIGAAVGEMVGETLLDGRDVGKLSPQERQKVIAYSQIIAGSAVALVKGDVNTAANAATVAVENNSLLARRRVNIRWTSRQELEHEYAILEIQAITNQIRRLDPKFNGIAIMRNPREPWTRHDVQTYRQYYNQLRESRGFAVDPIYRIRINNGNEFNRIMSSKYPYNELYVANPKSATGYFRVDSYNPATEEIISRKFTQFSQIQESTGIGYIKEAVRKYSPGAVISNVPSTPTTIRGRKLEGKLILEVPAQVNPIPQSVLRAAQEENVIIRDTTGRIYK

SEQ ID NO: 6723 - protein, 162 aa, Neisseria meningitidis
MKKDIFYCEQWSYGYKKLHKPFSEKQAEEKHLKGELYTAVIGSATQPEYVITLREEVGFFSVHFFDKFGRDYLTHQFQKYSNSNYYFLSMAVWRDYITLESHDLAEGYTYFFNENTDDCYVLKEDFINNERYEKTELYSQKDKVILFPKFGEYDLVLNPDII

SEQ ID NO: 6724 - protein, 90 aa, Neisseria meningitidis
MNKRMKMCPACQQGYLYHSKPKYLHDEIILCDECDAVWLKGMNIFYGEYEKDFYSYVPFMESQGITSECIWEGDLFDHPYYEDENSNDMD

SEQ ID NO: 6725 - protein, 260 aa, Neisseria meningitidis
MGEIVGEALVKNTDFSGMTASEIEKAKANITAYAKLVAGATVGVTGGNVDVAANASETAVKNNALDIIWDIGNLVWDGGKWIYAKSIGDKQMAREAAIDFGVDAAAAAVPFVPAGATKISRGGAYVLKAGDEAVDTAKAIQEIQKQTGIKLTYDKVNKVWTTPAGLDYGLDAKHGNRIKHVLAHTIPNPNKPVHSVFNVSRKEVLPLVDEAWRMKGNPLPNDSSVYLVDMKKPIGTKGETKVRIVVQKGTNKIISAYPQK

SEQ ID NO: 6726 - protein, 87 aa, Neisseria meningitidis
MDKEIKICPRCEQGYLYHAKPKYFSGEVILCDECYAMWLGDMKIFYGQYGKDFYDYHEFMKDKGIEEINMWEGELFDHPYYEDEKFK

SEQ ID NO: 6727 - protein, 640 aa, Neisseria meningitidis; identical to SEQ ID NO: 912

SEQ ID NO: 6728 - protein, 140 aa, Neisseria meningitidis
MKYMISFLKKTFELMSWVLVILIIGTFYDYYQIRQYAELEKKSISNILLYAQKEKFRLESKDKYMRGGYTKYKFIFSEYSNTTFLNFINDLKKDNYLPLDGYGHGFLCRKGESISINIYPEINKFILVWGYPENLCADSN

SEQ ID NO: 6729 - protein, 133 aa, Neisseria meningitidis
MRKLNNHDVHKRYQDRLEEDVEFTINYELPLSCLWSTIKDFSSDFEEKTEAFFILFKELLRRGHLKLQRDGQIIGHTPEEWEQIFREVWPEYEIEPNPLPGYAPFDIGMWLTVEAPAYAVWIDPEDGSEYWAG

SEQ ID NO: 6730 - protein, 79 aa, Neisseria meningitidis
MLGVVPGIGESIQAYKVAKAAKNLQGMKKALDKAATVATAQGYVSKTKIKIGQTELRVTAATDKQLLKAIGEGRTRQVK

SEQ ID NO: 6731 - protein, 127 aa, Neisseria meningitidis
MTEQLFDSLAKQNGFRVLSGGKYGGNNGFDHVWQAADGSVVLIVESKQIRNGTVQLNPNGAGGYTQMSREWIKQVVKSLPDGSPAKAVVLKANQNGKLKTAIAGVDRQTGKAVILSVKVPSKTNIRR

SEQ ID NO: 6732 - protein, 311 aa, Neisseria meningitidis
MGHNMMTTQKWYEHITNVIIGNTANFNSGCPESIDYVDEKKGVPLAAMKYILMYTEAAASHAYLFEHDLKKFKQYAYVAGKLGILQSVDDEDPEPFFFPCDMLNIQDPMFLMLMSDSPQLREFLVRNIDNIANDTEAFVNRYDLNRHMIYNTLLMVEGKQLDRLKQRSEKVLAHPTPSKWLQKRLYDYRFFLAFAEQDAEAMKAALEPLFDKKTARMAAKETLSYFDFYLQPQIVTYAKIASMHGFDLGIDHEIAPRDLTVYDPLPADEYQDIFDFMKQYDLSYPYEYLQDWIDYYTFKTDKLVFGNAKRE

SEQ ID NO: 6733 - protein, 51 aa, Neisseria meningitidis
MLLQRSHALFCQQVEFFSGNQRGKASPQHRSMYYGRASIYSFRKSFSFKTA

SEQ ID NO: 6734 - protein, 83 aa, Neisseria meningitidis
MKIFWRIFMRQISLTDYFCKGLRFKHIAFRWFAYSLCHFQCSKYTCSAKRKKTYRKTYFRSSCSGQSNSTICIKGGTRRKCYH

SEQ ID NO: 6735 - protein, 67 aa, Neisseria meningitidis
MLSLEIQQEGFTIGGGLVLGGCAGAHLARKEPLILTGKTGAGASAIANASIGYQWTVNLSKPKEGAK

SEQ ID NO: 6736 - protein, 59 aa, Neisseria meningitidis
MHSHYIFGILMISYVFAMLFNFIISYKIFKEEKLINGFFDFLIKSSYLNFKYFNILFGK

SEQ ID NO: 6737 - protein, 152 aa, Neisseria meningitidis
MLTKLKILLFLFLFVFVLAINLLFFFFSSDIESFGNYQFEYVYDKGWPANYILVMKDGNEGNFDKIISGLVLEYYKEDDNIYFSYIDGQGFASDSCYYKPEILYGKIILNKNHIININSMEKNNFLSEDKIMKGTRNWLADPKNKCNIQTLD

SEQ ID NO: 6738 - protein, 41 aa, Neisseria meningitidis
MRKYNGIDRKSFPLFLKECEFRFNFGTPSQQLKILRDWCGI

SEQ ID NO: 6739 - skipped

SEQ ID NO: 6740 - protein, 406 aa, Neisseria meningitidis; identical to SEQ ID NO: 622

SEQ ID NO: 6741 - protein, 219 aa, Neisseria meningitidis
MSNQQALVIFSGGQDSTTCLIQAIQTYGRENVQAITFQYGQRHAVELERARWIAQDLGVKQTVLDLSLMRQITHNALMDDTAAIETAENGVPNTFVDGRNALFLLYAAIYAKGQGIRHIIAGVCETDFSGYPDCRDVFVKSMNVTLNLAMDYDFQIHTPLMYLTKAQTWALADEMGVLDYIREQTHTCYNGIVGGCRECPSCILRERGLAEYLESKKAV

SEQ ID NO: 6742 - protein, 172 aa, Neisseria meningitidis
MPKLHMFYLGGNAGRSNIEVHDIQFAVCDNYREAVPALKAAWFGDADKIHIDGWQIVEWADGYDIAVSETPKTKMPSEHAPRLYFANVGGYRAGQLAEAHAFGLFAAATPAEAKQKALQTLLTDSYVQQHKDNLKDVDNLLALDRIGNFHIRLTPNPHGKPAEIGFQGYLPI

SEQ ID NO: 6743 - protein, 140 aa, Neisseria meningitidis
MKITKIFTFDSSHMLDGHDGKCQNLHGHTYKLEITVSDGIIKGGAKDGMVMDFTDLKAIVKQHITDPFDHAFIYHGGNSRECQIAALLEGWNMKTLRLPCRTTAENMAVEMYGRLKNAGLNVCRVKLWETPTSCAEYEGE

SEQ ID NO: 6744 - protein, 123 aa, Neisseria meningitidis
MKLLFILLVLFVAVEHFYIAWLEMTQIPSEKAAEIFKLPYEFMEQKQVQTLFSNQGLYNGFLGIGLVWSRFAAPDNAVYGATTLFLGFVLIAAAWGAFSSGNKGILVKQGLPAMLAAAAVLAV

SEQ ID NO: 6745 - protein, 212 aa, Neisseria meningitidis
MKKINVAPENPQYRIVEIFESLQGEGWNTGMPAVFVRLGKCNLACGWCDTDYLTFGMMGLSDILGRLKTYAARNIIITGGEPTIQPHLDMLLDTLKAEGYFLCLETNGLNPAPPQIDYVATSPKACYAAKYENSCIETADEVRIVADGDVLAFCENMERKIRAHHYYLSPCEQDGAMNIYDTIRQIGILNSRPDASVHWQLSVQTHKWAGIE

SEQ ID NO: 6746 - protein, 361 aa, Neisseria meningitidis
MTVPHIPRGPVMADIAAFRLTEEEKQRLLDPAVGGIILFRRNFQNIEQLKTLTAEIKALRTPELIIAVDHEGGRVQRFIEGFTRLPAMSTLGEIWDKDGASAAETAAGQVGRVLATELSACGIDLSFTPVLDLDWGNCPVIGNRSFHRNPEAVARLALALQKGLTKGGMKSCGKHFPGHGFVEGDSHLVLPEDWRSLSELETADLAPFRIMSREGMAAVMPAHVVYPQVDTKPAGFSEIWLKQILRRDIGFKGVIFSDDLTMEGACGAGGIKERARISFEAGCDIVLVCNRPDLVDELREDFRIPDNPTLAQRWQYMANTLGSAAAQAVMQTADFQAAQAFVAGLASPQDTAGGVKVGEAF

SEQ ID NO: 6747 - protein, 506 aa, Neisseria meningitidis; identical to SEQ ID NO: 692

SEQ ID NO: 6748 - protein, 499 aa, Neisseria meningitidis
MFKKYQYLALAALCAASLAGCDKAGSFFGADKKEASFVERIEHTKDDGSVSMLLPDFAQLVQSEGPAVVNIQAAPAPRTQNGSGNAENDSDPIADNDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLQAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 6749 - protein, 209 aa, Neisseria meningitidis
MNRHIRQEIFERFRAANPHPTTELNFNSPFELLIAVLLSAQATDVGVNKATAKLFPVADTPQAMLDLGLDGVMEYTKTIGLYKTKSKHIMQTCRILLEKYNGEVPEDREALESLPGVGRKTANVVLNTAFGHPVMAVDTHIFRVSNRTKIAPGKDVREVEDKLMRFIPKEFLMDAHHWLILHGRYTCKALKPQCQTCIINDLCEYPAKA

SEQ ID NO: 6750 - protein, 137 aa, Neisseria meningitidis
MIPSYTYAALAFSAFTSATLLPGTSEAAFALFVHRFPEHAYGALLCAGLANGLGSMVSYWMGRLLPSRKMPSEKTLNLMRRFGIWLLAFTWLPVVGDALPLAAGWLRLNPWTSGLMLVIGKTARYAFILWGMQYYAA

SEQ ID NO: 6751 - protein, 426 aa, Neisseria meningitidis
MSISIFLKRVIFRHHERQIMSAQSQNNHTSPLVVLTTLFFMMGFITCMNDILIPHLKEIFDLSYVQAMLIQFCFFTAYAVMSIPMGAFVGKVGYKNGVIGGFLLTAVGCLLFYPAAGSHSYAVFLGALFILASGVTLLQVAGNPYVTLLAKPGKESATLTLVQAFNALGTTIAPQIGAFLILADATQTVSKAEQISSVQIPYLGLAGLLIILAVFVKMIRLPDARKIAAEESAHNHDGKTSVWQYKHLVFGTAGIFCYVGAEVSIGSLMVNVLGYLKGLDHASAAHYLSFYWGGAMVGRFLGSAVMAKFAPNRYLAFNASAAVVLLAVAMATGSGNADVAMWSLLAIGFFNSIMFPTIFSLATKGLGKFTNAASGVLCTAIVGGAVVPVVQGWVADTYTLMSSFVVSVICYLYIVFFAVYGYRADK

SEQ ID NO: 6752 - protein, 459 aa, Neisseria meningitidis; identical to SEQ ID NO: 3364

SEQ ID NO: 6753 - protein, 274 aa, Neisseria meningitidis
MDGAQPKTNFFERLIARLAREPDSAEDVLNLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGEIEDEFDEDDSADNIHAVSSERWRIHAATEIEDINTFFGTEYSSEEADTIGGLVIQELGHLPVRGEKVLIGGLQFTVARADNRRLHTLMATRVK

SEQ ID NO: 6754 - protein, 169 aa, Neisseria meningitidis
MKRTKKYPFLTLQRQRFHLNFENASSAAGIPAERDFYRWAWSALKNEYRRADISLILLDEEEARAYNRDYRGKDYATNVLSFALNEGEILPCQVSEKLYGDLIICPQVVLKEAAEQGKTPEQHFAHLTIHGTLHLMGYDHIEDDEAEIMEAEEIRLMRAAGFPNPYQED

SEQ ID NO: 6755 - protein, 311 aa, Neisseria meningitidis
MNPKKLVIASRESLLAMWQAKHIQGRLKALYPDCEVEILGMTTRGDQILDKTLSKVGGKGLFVKELEQALYDGRADLAVHSIKDVPMDLPEGFALAAIGERANPFDAFVSNQYTRLEEMPEGAVVGTSSLRREAQLRARYPHLLIKPLRGNVQTRLSKLDNGEYDAIILAAAGLQRLKLDGRIRMILSESDSLPAAGQGALGIEIAAHREDLYEVLKPLNHGVTNACVTAERALARALGGSCQVPLAAYCTEENGLLTLRGLVGHPDGSVVLRADAQAPAEYADALGRAVAKKLADDGARELIGAVLNTEN

SEQ ID NO: 6756 - protein, 397 aa, Neisseria meningitidis
MFFKHIEAAPADPILGLGEAFKAETRPEKVNLGIGVYKDASGATPLVKAVKEAEKRLLESETTKNYLTIDGVADYNAQTQILLFGKDHEIIASRRAKTAQSLGGTGALRIAAEFAKRQLNAQTIWISNPTWPNHNAIAKAVGIQDKPYRYYDAAKHGLDWDGMIEDLSQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEETAARAHSQVKTIIRTLYSNPASHGANTIALVLKNDDLKAQWIAELDEMRGRIKAMRQKFVGLLKAKGASQNFDFIIKQNGMFSFSGLTPEQVDRLKNEFAIYAVRSGRINVAGITDNNIDYLCESIVKVL

SEQ ID NO: 6757 - protein, 165 aa, Neisseria meningitidis
MTALTLPEDIRQQEPSALLYTLVSAYLEHTAQTGDESLSCLSDDQHTLTAFCYLDSQVEEGGFVQLIASGYGEYIFRNPLADSLRRWKIKAVPKVLDKAKALYEQHGKTIETLADGGADIPSLRKQFPEFEEWDGAYYEAAEQDLPLLAEHIQSNWETFAHIGQA

SEQ ID NO: 6758 - protein, 67 aa, Neisseria meningitidis
MDNLNPQEISVLPENLPLYCSGPGNEQWNGHPRVFLPLCEGESGSVACPYCGTRYRLDGKMPHHHYA

SEQ ID NO: 6759 - protein, 528 aa, Neisseria meningitidis
MALFLSIFPIVLLIWLMVKKNSMPSYVALPITAVLIYAIKLFYFDDAGMLLNATAASGLVKTLTPITVIFGAIMFNRMMETTGCIDVIRKWLATISPNPVAQLMIIGWAFAFMIEGASGFGTPAAIAAPILMSLGFNPLKVAIFTLVMNSVPVSFGAVGTPTWFGFAPLNLSAEDILAIGRQTGVMHFFAGFVIPVIGLGFIVPWSEIRKNLGFVAIAVFSCTIPYVALAMVNEEFPSLVAGAIGLMVSVFAANQGWGLSKDHAKDPNAEKVPFAQVAKALAPLGMLIGMLVVTRIKQLGIKGILTSKEEWFSFQLPFDLSKITVSDSLTITFGNIFGQDVSASYQTLYVPAWIPFVLTVWICILLYKTKFKDAWTIYSVTFNQTKKPLLALMGALIMVQLMLVGGDNSMVKIIGKEFAAMAGEHWVYFSPYLGAIGAFFSGSNTVSNLTFGPIQQQIALDTGLSVTLILALQSVGGAMGNMVCLNNIIAVCTVLDVKNSEGAIIKKTVIPMAIYGVIAVVAAMIFFL

SEQ ID NO: 6760 - protein, 240 aa, Neisseria meningitidis
MKPAYFISDLHLSEKQPELTALLLRFLRSSAAGQARAIYILGDLFDFWVGDDEVSELNTSVAREIRKLSDKGVAVFFVRGNRDFLIGQDFCRQAGMTLLPDYSVLDLFGCKTLICHGDTLCTDDRAYQRFRKIVHRKRLQKLFLMLPLKWRTRLATKIRRVSKMEKQVKPADIMDVNAAFTARQVRAFGAERLIHGHTHREHIHHENGFTRIVLGDWHNDYASILRVDGDGAVFVPLEKY

SEQ ID NO: 6761 - protein, 1161 aa, Neisseria meningitidis
MRLTHIKLSGFKSFTDPTTIHVPGQLVAVIGPNGCGKSNVIDAVRWVLGEASAKQLRGESMQDVIFNGAATRRPAPRASVELVFDNSDHSLQGAWGQYAEVSIKRQLTRQGESTYFINNQTVRRRDITDLFLGTGVGARGYAVIEQGMISRIIEARPEELRAYIEEAAGVSKYKERRKETEGRLKDTREHLQRLGDLQNELARQVEKLEKQAETAERYKSLTAQLNQQQDLLDYAQWRQSLAAADKATAQHQSLQAQQDETAAQVQALNDEVHALQTAEQSQQQAVHELSNKRGVLREQIARLEEQIRHQQNLHQRIERDKQAAQAQLQRIHQEQQQIRVQLEENELQVEEKQTELAEWAMQVAEHEERLPELEEAQATLNAAFQTQQDEANRIRRELALKQQQLAHAEQTIAKHEERKGRLKQENQALNLPDEAETAAAQEAAALLQSQQEHYEEQIIAAEEALHAAREAFQTASNRFQSLKQQHITLQAQQQALSQILSQQQEAADFWQATDHAAAPQLWQHITAPAEWQHALSVILAERLHARAVPQGFVPPEPLPQGQAAWLSDDLSGGIKKSLPVQALLNQIQAQPPFQTALHYWLDGVLCAPDLSYALAHQNDLGAHQIWLTPEGHQVDKVSVLLYAKPAQESLIAQKARLDGIASELENLAPELSAAEAAFKQAEAAVRSSEVQHKNLMQQQQQHTRQYSQAQQRAAELLARTNQGQIRREHIERELAQLAEEQTVLQHTSDGLSDDIVTLQEAAAELEHQQQTTAHSRQEQQGRLKQAQLALLEANRQYGLAEVAVHKLNQQKQNYRQQIAQLEQQTLDWQERQQELALAYETEFQNDEQHIKLEELSEAVQTLDEEYIVVQEKLAQIQEQGREQYAKVQTLQTKLPQLQAATQTALLQQQEALINAKRYHQNLTERAADLDALEALAKESPKVLNSSIGSLSQQIEALGAVNLAALQELEEARERDGYYRSQSEDVQAAITLLEEAIAQIDDKTKARFKETFDAVNSKVQTFFPTLFGGGEATLKMIGDDLLTAGVSIMARPPGKKNSTIHLLSGGEKALTAMSLVFALFSLNPAPFCLLDEVDAPLDDANTSRFCRLVKEMSAQTQFLYISHNRLTMEMAEQLVGVTMQEKGVSRVVAVDIKQALEMAEAV

SEQ ID NO: 6762 - protein, 348 aa, Neisseria meningitidis
MKMQAVVVNKNVAGDVEVIEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGAHVVAIDINDDKLAFAKETGADLVVNAAKEDAAKVIQEKTGGAHAAVVTAVSAAAFNSAVNCVRAGGRVVAIGLPPESMDLSIPRLVLDGIEVVGSLVGTRKDLEEAFQFGAEGLVVPKVQLRALDEAPAIFQEMREGKITGRMVIDMKKECGCGHHH

SEQ ID NO: 6763 - protein, 129 aa, Neisseria meningitidis
MKNVQKGFTLLELMIAVAILGILTLITYPSYKTYIRRVRLSEVRTTLLHNAQTMERYYRQKGTFKTYDKNKLKQNEYFDITLSEVSPDHFTLQADPNPTTNDGETCVVTLNDGGTIAASGTNQSCPGFD

SEQ ID NO: 6764 - protein, 392 aa, Neisseria meningitidis
MAKMMKWAAVAAVAAAAVWGGWSYLKPEPQAAYITETVRRGDISRTVSATGEISPSNLVSVGAQASGQIKILYVKLGQQVKKGDLIAEINSTSQTNTLNTEKSKLETYQAKLVSAQIALGSAEKKYKRQAALWKENATSKEDLESAQDAFAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGKAFVRVLGADGKAAEREIRTGMRDSMNTEVKSGLKEGDKVVISEITAAEQQESGERALGGPPRR

SEQ ID NO: 6765 - protein, 644 aa, Neisseria meningitidis
MSLIECKNINRYFGSGENRVHILKDISLSIEKGDFVAIIGQSGSGKSTLMNILGCLDTAGSGSYRIDGIETAKMQPDELAALRRERFGFIFQRYNLLSSLTARDNVALPAVYMGAGGKERSARADKLLQDLGLASKEGNKPGELSGGQQQRVSIARALMNGGEIIFADEPTGALDTASGKNVMEIIRRLHEAGHTVIMVTHDPDIAANANRVIEIRDGEIISDTSKNPEIPASNVGRIREKASWSFYYDQFVEAFRMSVQAVLAHKMRSLLTMLGIIIGIASVVSVVALGNGSQKKILEDISSIGTNTISIFPGRGFGDRRSGRIKTLTIDDAKIIAKQSYVASATPMTSSGGTLTYRNTDLTASLYGVGEQYFDVRGLKLETGRLFDENDVKEDAQVVVIDQNVKDKLFADSDPLGKTILFRKRPLTVIGVMKKDENAFGNSDVLMLWSPYTTVMHQITGESHTNSITVKIKDNANTQVAEKGLTDLLKARHGTEDFFMNNSDSIRQIVESTTGTMKLLISSIALISLVVGGIGVMNIMLVSVTERTKEIGIRMAIGARRGNILQQFLIEAVLICVIGGLVGVGLSAAVSLVFNHFVTDFPMDISAMSVIGAVACSTGIGIAFGFMPANKAAKLNPIDALAQD

SEQ ID NO: 6766 - protein, 260 aa, Neisseria meningitidis; identical to SEQ ID NO: 2202

SEQ ID NO: 6767 - protein, 729 aa, Neisseria meningitidis
MIYHRIAVNVPLSDGLLTYSHSDPLPPGTRVLVPFRNKTVVGMVWETDIAPDMDMARILSVQTAFVEEKPLPESWRDLLAFTSRYYHYPTGQAVFAALPQGLKETRAVEMPQPPLFYALNEAGRAQTPPPARFNKKAALWDALLSGGMTMAALKQVNAQAAKLIEDWAEQGWIETTEAAKPVLRSYHGQASHSEFVLNADQQQASDEIQTAFGSFQPFLLYGITGSGKTEVYFDAMAKVLAQGRQVLFLLPEINLTPQLLKRVENRFADVPTAVLHSQMAAGKRTQDYLRAMLGQAKLVIGTRLAVFTPMDDVGLIVVDEEHDGSFKQDNELRYHARDLAVWRAKQGGCPIILGSATPSLESWHKAQSGAYRLLQLTERAHTAAQLPQVDILNVGRLKLDNGFSPQALQLLKQNFEAGGMSLVYLNRRGFAPALFCGDCGYTFGCPNCSAKMVLHQRARQLRCHHCDHREPIPYKCPDCGNQDLTAVGHGTQRVEETLRTFLPKAAVVRVDRDSTAHKNDWADLYRRIADNKIDILVGTQMLAKGHDFARLNLVIVLNADGSLYSADFRAPERLFAELMQVSGRAGRADKPGKVLIQTQLPEHPVFAAVKAQDYAVFAENELNERQMFAMPPFGFQTAVRADAPRVADAMEFLNAAKETLAPLLPESVSQFGAAPMLMVRLAERERAQIFLESPSRQDLHRAVSLWAQVLQQNRDGKIRWSVDVDPQEA

SEQ ID NO: 6768 - protein, 357 aa, Neisseria meningitidis; identical to SEQ ID NO: 848

SEQ ID NO: 6769 - skipped

SEQ ID NO: 6770 - protein, 642 aa, Neisseria meningitidis
MAKVIGIDLGTTNSCLAISENGQTKVIENAEGARTTPSVIAYLDGGEILVGAPAKRQAVTNAKNTIYAAKRLIGHKFEDKEVQRDIESMPFEIIKANNGDAWVKAQGKELSPPQISAEVLRKMKEAAEAYLGEKVTEAVITVPAYFNDSQRQATKDAGRIAGLDVKRIINEPTAAALAFGMDKGDNKDRKVAVYDLGGGTFDISIIEIANLDGDKQFEVLATNGDTFLGGEDFDQRLIDHIIAEFKKEQGIDLKQDVMALQRLKEAAEKAKIELSSGQQTEINLPYITMDATGPKHLAMKITRAKFESLVEDLITRSIEPCKIALKDAGLSTGDIDDVILVGGQSRMPKVQEAVKAFFGKEPRKDVNPDEAVAVGAAIQGEVLSGGRSDVLLLDVTPLSLGIETMGGVMTKLIQKNTTIPTKASQVFSTAEDNQSAVTIHVLQGERERASANKSLGQFNLGDIAPAPRGMPQIEVTFDIDANGILHVSAKDKGTGKAANITIQGSSGLSEEEIERMVKDAEANAEEDKKLTELVASRNQAEALIHSVKKSLADYGDKLDAAEKEKIEAALKEAEEAVKGDDKAAIDAKTEALGAASQKLGEMVYAQAQAEAQAGESEQANASAKKDDDVVDADFEEVKDDKK

SEQ ID NO: 6771 - protein, 90 aa, Neisseria meningitidis
MKKTGKYLIYTAAFTAFCFAFQENRSEAKQPDITLSASLCEQFNILNAKDMDAEQVSLSKECDIIESSHDWEKEYGNLNEQEMLAGIVYE

SEQ ID NO: 6772 - protein, 228 aa, Neisseria meningitidis
METFKDRLVFLWKSEARQAKIASDIEMTIAGFSRIWNEGGLPKSETLKKIKQLKGCSIDWLLTGEGNPFPDEAPKKSLAYDTLGNEVDTDEFVFVPRYDIRAAAGYGQFVDHEEPVFTMAFRRHWIENYVTRDTKNLSVISVKGDSMEGVLNDGDSILVNHGENTPRDGLYVLRINENLLVKRLQIVPGGIINVISANEAYPAFEINLNDLTDDVEIIGRVEWFGRTI

SEQ ID NO: 6773 - protein, 112 aa, Neisseria meningitidis
MSDESPIIFTDSCCAKVADLIAEENNPDLKLRVFVNGGGCSGFQYGFTFDEIKNDDDFEIEKNGLVFLVDPMSYQYLVGAEIDYTESLQGSQFVIRNPNAETTCGCGSSFSV

SEQ ID NO: 6774 - protein, 154 aa, Neisseria meningitidis
MIEMSKDYRNDLYDVYVSYPPQVDRGLIRECLKENLGEEKAEGLIESLDSKPQVLVEEKCTWAKREELHDYFSYLGLDIITRRYMELETVVPPEEGEGEGEGADGEMPEYLELHGGREDDISAPSQPEPPSRNIKLLVFGLLIAFLGYLLGKIF

SEQ ID NO: 6775 - protein, 503 aa, Neisseria meningitidis
MKWLKRLTVIVGTFYRYRLAGLCASLMGSGWICALLKMMPQSSKLKNEPPAVRLRLALESLGPIFIKFGQVLSTRPDLIPHDYAVELAKLQDKVPPFDARLSREQIEKSLGQSIEKLYAEFETEPIASASIAQVHKARLHSGEQVAVKVLRPNLLPVIEQDLSLMRFGAGWVERLFADGKRLKPREVVAEFDKYLHDELDLMREAANASQLGRNFQNSDMLIVPKVFYDYCTSDVLTIEWMDGTPVSDIAKLKADGIDLHKLADYGVEIFFTQVFRDGFFHADMHPGNILVAADNRYIALDFGIVGTLTDYDKRYLAINFLAFFNRDYRRVATAHIESGWVPADTRAEELEAAVRAVCEPVFNKPISQISFGLVLMRLFEVSRRFNVEIQPQLVLLQKTLLNIEGLGRQLDPDLDLWKTAKPFLVKWMNGQVGPKALWRNLKNEAPDWAQIIPSLPRKISALIDENRQQEMRDAYIHLVKVQQRQSLWLAVIAVVLLLILLLK

SEQ ID NO: 6776 - protein, 272 aa, Neisseria meningitidis
MKKDHLNTTGFDLWHTIREETAAAVSAEPMLASFLHQTVLRHESLGSVLAYHLSSKLGSPIMDVRALFEIYQQALGSDTQIGKCVEADLKAIYERDPACDEYSLPLLYFKGFHAIQAHRINHRLYLDGRKTLAYFLQNRMSEVFGVDIHPAARFGYGLMLDHATGFVAGETAVLGNNISILHGVTLGGSGKEGGDRHPKIGDGVMIGANASILGNIRIGSNAKIGAGSVVVSDVPPSITVVGVPAKPVARSLKTPSADMDQNIQFTEIDFMI

SEQ ID NO: 6777 - protein, 192 aa, Neisseria meningitidis
MSEQTQQQNSEEAVENVEAVETVETVGNADGVQEQAAAEPAYEDLQARIAELEAQLKDEQLRALANEQNLRRRHQQEIADTHKFAGQKFAVEMLPVKDYLEMALLDQSGNFDALKMGVQMTLNELQKAFDATQIKEINPKAGDKLDPNIHQAMQAVASEQEPNTVVGVMKKGYTLSDRVLRPAMVTVAQKEA

SEQ ID NO: 6778 - protein, 71 aa, Neisseria meningitidis
MKTLLLTFGIFLTVIIGMAVGYIFSKRSIKGSCGGITALGMKKMCDCDTPCDTLQKKLDEEKQAGGIRVDR

SEQ ID NO: 6779 - protein, 351 aa, Neisseria meningitidis; identical to SEQ ID NO: 446

SEQ ID NO: 6780 - protein, 405 aa, Neisseria meningitidis
MEIILGIVMFTVIVLVLALMILFAKSKLVSEGDITIKVNGEKELTMPAGGKLLGALANEGIFIPSACGGGGSCGQCRVVVKSGGGDILPTELSHISKREAREGCRLSCQVNVKTDMDIEVPEEVFGVKKWECTVISNDNKATFIKELKLAIPEGEEVPFRAGGYIQIEAPPHTVAYKDFDIPKEYHEDWDKYNLWQYVSKVDEPILRAYSMASYPEEKGIIMLNVRIATPPPRVPDAPPGQMSSYIWSLKPGDKVTISGPFGEFFAKDTDAEMVFIGGGAGMAPMRSHIFDQLKRLNSKRKITFWYGARSKREMFYVEDFDQLAAEFPNFTWHVALSDPLPEDNWDGYTGFIHNVVYENHLKNHEAPEDCEFYMCGPPIMNQSVIKMLKDLGVEDENILLDDFGG

SEQ ID NO: 6781 - protein, 197 aa, Neisseria meningitidis
MEHYLSLFIKSVFIENMALSFFLGMCTFLAVSKKVSTAFGLGVAVIFVLGLSVPVNQLVYSLLKDGAIAEGVDLTFLKFITFIGVIAALVQILEMFLDKFVPALYNALGIYLPLITVNCAIFGAVSFMAQREYNFGESVVYGFGAGLGWMLAIVALAGITEKMKYSDAPKGLKGLGITFIAAGLMAMAFMSFSGIQL

SEQ ID NO: 6782 - protein, 208 aa, Neisseria meningitidis
MADMKRLKHLMFSPFIDNNPIALQVLGICSALAVTTKLQTAIVMGISVALVTGFSSFFISLVRNYIPNSIRIIVQMAIIASLVTLVDQLLQAFAYELSKQLSVFVGLIITNCIVMGRAEAFAMKEPPLESLIDGIGNGAGYGIMLLVVATVRELIGSGKLLGYTVFQTVQDGGWYQTNGLFLLAPSAFFIIGFLIWGLRTWKPEQAEE

SEQ ID NO: 6783 - protein, 258 aa, Neisseria meningitidis
MAKKFDKDSFSGTLIVVLAVSLICSVIVAGAVVGLKPIQEKQKLQDKQGYILSVAGLMDKDTDIGKTFAERIEQRVVDLATGEYVADAPKDFSARIAGKDPAQSIRIKTEDDLAGIKSRAKYTEVYLVKGEDGKIGQIILPMHGNGLWSVMYGFVAIQPDGNTINGITYYEQGETPGLGGEIGNPLWQQKFVGKKLFDGQGKLALHVGKGAGSDKEHGVDALSGASLTSKGVQGSFAYWFGENGYIPYLNKLKSAGAQ

SEQ ID NO: 6784 - protein, 410 aa, Neisseria meningitidis
MGLKHFLEKIEPHFLPGGKHEKWYALYEAAATIFYTSGAVTRKAAHVRDALDSKRMMILVWLALFPAMFYGMYNVGAQAFGALTPDLLQQNIANDWHYAFANALGINMSSEAGVSDKMLFGAIYFLPIYATVFVVGGFWEVLFATVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAVTGQTITWMDAFIGKLPGSIGEVSTLALLIGGAFIVFARIASWRIIAGVMIGMIAMSSLFNFIGSDTNAMFAMPWYWHLVVGGFAIGMLFMATDPVSASFTNVGKWWYGALIGVMCVLIRVVNPAYPEGMMLAILFANLFAPIFDYFVAQANIKRRKARSNG

SEQ ID NO: 6785 - protein, 447 aa, Neisseria meningitidis; identical to SEQ ID NO: 126

SEQ ID NO: 6786 - protein, 473 aa, Neisseria meningitidis
MRHLPLFSLMLFPASVYAADLDGANLNLLWGLPFALILLSIALGPLFFSHTWHHHYGKITAFWTLLFLIPFSLVFGASAGIHTVAHALVEEYIPFILLLLALYTISGGILVWGDLNGTPKLNTALLAVGTALASIMGTTGAAMLMIRPLLKANQNRTRRVHIVIFFIFLVANIGGGLTPLGDPPLFLGFLKGVDFMWTVKHMFAPVLISTAVLLTAFYFIDNRFFKQESIAQDTPAQQEKPEKIAIFGKWNFLLLSGVVGAVLMSGLWKPEHPGFEILGSRYALQNLVRDVILIALTAVSMAITPKQVRAGNEFNFEPIAEVGKLFLGIFITIFPVLSILKAGEAGALGGVVSLVHDTAGHPINVMYFWMSGILSAFLDNAPTYLVFFNMAGGDAQALMTGTLFHSLLAVSMGSVFMGALTYIGNAPNFMVKAIAEQRGVPMPTFFGYMMWSVAFLTPVFIVHTLIFFVFKLL

SEQ ID NO: 6787 - protein, 119 aa, Neisseria meningitidis; identical to SEQ ID NO: 2982

SEQ ID NO: 6788 - protein, 201 aa, Neisseria meningitidis
MTIMNINTSENKDAVAEHTGQWLEKAVIGLNLCPFAKAPHVKNLVRIAISEAKHLDGFLEDLDEELQRLGNTPATELETTLLVHPTLFPDFDVFNDMLDIADAAVVENGLEGIVQIAPFHPDFQFEGTDSDDIGNYTNRSPYPTLHLIREDSIAKAAQAFPDASAIFERNIALLEKMGHEGWAKLGITSCPYPHNKKNISK

SEQ ID NO: 6789 - protein, 187 aa, Neisseria meningitidis
MLIWSPSVRIAANIRTDNPNSLKRNANMPQLTLDKTDIKILQVLQENGRLTNVELSERVALSPSPCLRRLKQLEDAGIVRQYAALLSPESVNLGLQAFIRVSIRKAKDAREDFAASVRKWPEVLSCFALTGETDYLLQAFFTDMNAFSHFVLDTLLSHHGVQDAQSSFVLKEIKHTTSLPLNHLLKE

SEQ ID NO: 6790 - protein, 366 aa, Neisseria meningitidis
MTALKTTPFHQAHQDAGAKLVDFAGWELPIHYGSQIAEHEAVRTDAGMFDVSHMLVTDVAGANAKAFFRKLIANDVAKLAFVGKALYSALLNDNGGVIDDLIVYRTNEAETQYRIVSNGATREKDTAQFHKVGQEFGVAFNPRYDLGMLAVQGPKAIEKLLTVKPEWADVVHNLKPFQGADLGNDWFVARTGYTGEDGVEVILPGTEAVAFFKALQQAGVQPCGLGARDTLRMEAGMNLYGNDMDDDTSPLEAGMGWTVDLKDESRDFVGKAALLALKEKGVAVKQVGLLLEKGGILRAHMEVLTDKGQGETTSGVFSPSLKQSIAIARVPKDFDGDTAKVLMRGKEVDVRVLKLPFVRNGQKQFD

SEQ ID NO: 6791 - protein, 128 aa, Neisseria meningitidis
MSNNIPAELKYVASHEWLRLEEDGTITVGITHHAQELLGDIVFVELPEVGANLAAEEQAGVVESVKAASDVYAPIAGEVVAVNEDLPSAPETANSDPYGAGWFFKLKPANVADYDSLLTAEQYAGEVD

SEQ ID NO: 6792 - protein, 415 aa, Neisseria meningitidis; identical to SEQ ID NO: 2976

SEQ ID NO: 6793 - protein, 190 aa, Neisseria meningitidis
MIHIISILKSIGISGIVMSCFSIKRMSAFRARITAFFAAFVFLTAALPAYAERLPDFLAKIQPSEIFPGADRYGKPEGKPMVARVYKGDEQLGLVYITTDAVNTRGYSSKPIDTLMVLANDGTIAGAKLVDHHEPIMLIGIPHLPAPGRAIRSNWLPAYIKPNFTLTNRLRLKGLPTVPQPSKATGAGVP

SEQ ID NO: 6794 - protein, 344 aa, Neisseria meningitidis; identical to SEQ ID NO: 3030

SEQ ID NO: 6795 - protein, 206 aa, Neisseria meningitidis
MTTHHVELRKVTKRFGAQKAVNQVDLVLKAGESVGLAGHNGAGKSTIMKLILGLITPTEGEVMLLGERTGSKAGARLRSQIGYLPETVALHPSLIGIETLDFYAKLKKQPLTQNRGLLERVGISQAAHRRVGTYSKGMRQRLALAQALLGEPKVLLFDEPTTGLDPASRQMFYEVVRELNGRGATVLLSTHALAELDGHADRIIVD

SEQ ID NO: 6796 - protein, 164 aa, Neisseria meningitidis; identical to SEQ ID NO: 2970

SEQ ID NO: 6797 - protein, 553 aa, Neisseria meningitidis
MTESITRDSMQYDVVIVGAGPSGLSAAIKLKQLAEQNGREISVCVVEKGSEVGAHSLAGAVIDPIALNELISDWKEKGAPLTRTVTQDKVLFLTEKKAFNLPITPNFDNHGNYIVSLGEVVRWLAEQAENMGVEIYPGFAAAEVLYHEDGSVKGIATGNMGIGKDGEPTDSFQPGMELWAQQTLFAEGCRGSLSKQIIERFQLDQNSQPQTYGLGIKEVWEVPSEQHQPGLVVHSAGWPLDSKTYGGAFVYHFDDNKVAVGFVVGLDYQNPYLSPFEEFQRFKTHPEIRKTFEGGRRIAYGARSLIEGGLQSLPKLSFKGGILVGDAAGFLNMPRIKGIHTAMKSAMLAAEAVFPLLENLEEVEGFDSGKEAADYQQRFEQSWLYQELYAARNVRPSFKWGVYLGSIYTGIDQMIFRGKAPWTLKHHGKDNEQLKKAAACKPIDYPKPDGVLTFDRLSSVFLANLAHEENQPDHLVLNNPQTMIDVNYKEYASPETRYCPAGVYEIVEENGNPRLQINAANCVHCKTCDIKDPTQNITWICPEGASGPNYGGM

SEQ ID NO: 6798 - protein, 180 aa, Neisseria meningitidis
MQSWKERRDFNIVKQDLDFSCGAASVVTLLNNFYGQKLTEEDVLKKLDKEQMPASFEDMRRIMPDLGFEAKGYALSFEQLAQLQIPVIVYLKYRKDDHFSVLRGIDGNTVLLADPSLGHVSMSRAQFLDAWQTREGNLAGKILAVVPKGRDAGGDKAFFTRSPKRQTEFAVGQVKWWRAY

SEQ ID NO: 6799 - protein, 222 aa, Neisseria meningitidis
MLPSKYEDNALQIKEKSTERTAPFFVLEVTARSAADILGIHPNSAALFYRKIRTVINHHLALAADEVFEGPVEPDESDFGGRRKGRRGRGAAGKVVVFGILKRNGRVYTVVVDNAKSETLLPVIKKKIMPDSIVYTDSLSSYDKLDVSGFIHYRINHSKECADRQNHINGIENFWNQAKRVLRKYNGIDRKSFPLFLKECEFRFNFGTPSQQLKILRDWCGI

SEQ ID NO: 6800 - protein, 271 aa, Neisseria meningitidis
MRPYATTIYQLFILFIGSVFTMTSCEPVNEKTDQKAVSAQQAKEQTSFNNPEPMTGFEHTVTFDFQGTKMVIPYGYLARYTQDNATKWLSDTPGQDAYSINLIEISVYYKKTDQGWVLEPYNQQNKAHFIQFLRDGLDSVDDIVIRKDACSLSTTMGERLLTYGVKKMPSAYPEYEAYEDKRHIPENPYFHEFYYIKKGENPAIITHWNNRVNQAEEDNYSTSVGSCINGFTVQYYPFIREKQQLTQQELVGYHQQVEQLVQSFVNNSSKK

SEQ ID NO: 6801 - protein, 1302 aa, Neisseria meningitidis
MNEGEVVLTPEQIQTLRGYASRGDTYGGWRYLANLGDRYADDAAAIVGKDANLNGLNLWMKKGVENLWDDTVGKKTRLEKFDRVALQHFSQYVDLINENNGRLPNTSEIERSYYKAVTENGVSSSAAIDLVINRSLPDMADGYWALGLGIEAERIHNEQAVNNPNGSERDNRKQLISALDKGFDGSFKEKHFTFLQSVIMDVTKLGVEYTIDGWQKIGGWGNGIINDLYKSVVKREWTGIFEIVNNNIKQFRDLFPNPEGWIDDGHQCFAPWVKETKKRNGKYHVYDPLALDLDGDGIETVAAKGFSGSLFDHTNNGIRTATGWVSADDGLLVRDLNGNGIIDNGAELFGDNTKLADGSFAKHGYAALAELDSNGDNIINAADAAFQSLRVWQDLNQDGISQANELRTLEELGIQSLDLAYKDVNKNLGNGNTLAQQGSYTKTDGTTAKMGDLLLAADNLHSRFKDKVELTAEQAKAANLAGIGRLRDLREAAALSGDLANMLKAYSAAETKEAQLALLDNLIHKWAETDSNWGKKSPMRLSTDWTQTANEGIALTPSQVAQLKKNALVSLSDKAKAAIDAARDRIAVLDAYTGQDSNTLYYMSEEDALNIVKVTNDTYDHLAKNIYQNLLFQTRLQPYLNQISFKMENDTFTLDFSGLVQAFNHVKETNPQKAFVDLAEMLAYGELRSWYEGRRLMTDYVEEAKKAGKFEDYQKVLGQETVALLAKTSGTQADDILQNVGFGHNKNVSLYGNDGNDTLIGGAGNDYLEGGSGSDTYVFGEGFGQDTVYNYDYATGRKDIIRFTDGITADMLTFTREGNHLLIKAKDGSGQVTVQSYFQNDGSGAYRIDEIHFDNGKVLDVATVKELVQQSTDGSDRLYAYQSGNTLNGGLGDDYLYGADGDDLLNGDAGNDSIYSGNGNDTLDGGEGNDALYGYNGNDALNGGEGNDHLNGEDGNDTLIGGAGNDYLEGGSGSDTYVFGKGFGQDAVYNYDYATGRKDIIRFTDGITADMLTFTREGNHLLIKAKDGSGQVTVQSYFQNDGSGAYRIDEIHFDNGKVLDVATVKELVQQSTDGSDRLYAYQSGNTLNGGLGDDYLYGADGDDLLNGDAGNDSIYSGNGNDTLDGGEGNDALYGYNGNDALNGGEGNDHLNGEDGNDTLIGGAGNDYLEGGSGSDTYVFGEGFGQDTVYNYHVDKNSDTMHFKGFKAADVHFIRSGSDLVLSASEQDNVRISGFFYGENHRVDTFVFDDAAISNPDFAKYINAGNNLVQSMSVFGSNTAATGGNVDANIQSVQQPLLVTPSA

SEQ ID NO: 6802 - protein, 304 aa, Neisseria meningitidis; identical to SEQ ID NO: 2136

SEQ ID NO: 6803 - protein, 291 aa, Neisseria meningitidis
MNLYDLLLAPFAEFDFMRYALASVFCLSLSAAPVGVFLVMRRMSLIGDALSHAVLPGAAVGYMFAGLSLPAMGLGGVAAGMLMALLAGLVSRFTTLKEDANFAAFYLSSLAIGVVLVSKNGSSVDLLHLLFGSVLAVDIPALQLIAAVSSLTLITLAVIYRPLVLESIDPLFLKSVGGKGGLWHVLFLVLVVMNLVSGFQALGTLMSVGLMMLPAITARLWAKHMGALILLSVLTALLCGLSGLLISYHIEIPSGPAIILCCSVLYLFSVILGKEGGILTKWLKNHRHHTT

SEQ ID NO: 6804 - protein, 251 aa, Neisseria meningitidis
MGRLLLGSIRMSIIVENLTVSYRRRPAVHHVDITFEEHSMWAVFGPNGAGKSTFLKSLMGLQPIDTGSIRLDGLTRQNIAYLPQQSDIDRSQPMTVFDLAAMGLWYEIGFFKGINTAQKQRVHEALERVGMQRFADRQIAYLSNGQFQRVLFARMLVQNAKFLLLDEPFNAVDARTTYELLDVLQKCHCGGHAIIAVLHDYEQVRAYFPNTLLLAREKIAAGATETILTEPYLAQANAKMQQQESPDWCAS

SEQ ID NO: 6805 - protein, 121 aa, Neisseria meningitidis
MNLIQQLEQEEIARLNKEIPEFAPGDTVVVSVRVVEGTRSRLQAYEGVVIARRNRGLNSNFIVRKISSGEGVERTFQLYSPTVEKIEVKRRGDVRRAKLYYLRGLTGKAARIKEKLPARKG

SEQ ID NO: 6806 - protein, 249 aa, Neisseria meningitidis
MLIQAVTIFPEMFDSITRYGVTGRANRQGIWQFEAVNPRKFADNRLGYIDDRPFGGGPGMIMMAPPLHAAIEHAKTQSSQAAKVIYLSPQGKPLTHQKAVELAELPHLILLCGRYEGIDERLLQSSVDEEISIGDFVVSGGELPAMMLMDAVLRLVPGVLGDMQSAEQDSFSSGILDCPHYTKPLEFQGMAVPEVLRSGNHGLIAEWRLEQSLRRTLERRPDLLEKRVLIPKESRLLETIRQEQREIQS

SEQ ID NO: 6807 - protein, 169 aa, Neisseria meningitidis
MTDTQNRVAMGYIKGVFGIKGWLKIAANTEYSDSLLDYPEWHLVKDGKTISVTLEAGKVVNGELQVKFEGINDRDLAFSLRGYTIEIPREAFAPTEEDEYYWTDLVGMTVVNKDHTVLGKVSNLMETGANDVLMIDGEHGQILIPFVSQYIETVDTGSKTITADWGLDY

SEQ ID NO: 6808 - protein, 81 aa, Neisseria meningitidis
MVVIRLARGGSKHRPFYNVIVTDSRSRRDGRFIERVGFYNPVANEKQERVRLNADRLNHWIAQGAQVSDSVAKLIKEQKAA

SEQ ID NO: 6809 - protein, 808 aa, Neisseria meningitidis
MSAQTDPGYFFMPNHIILIGASEQPYSLGERVLSNLLSTPFQGKITPVNPRHHTIAGLPAYTSLNKIPGNADLIIAVTLPDSYDTLFKTCRKKQLRHIILIQDWDNLSAAELHTAETAIRKHHGNGLNITACTTAGIQLPSLGLNISTQDGYAAGHTAILTGNAAVSRQIDNILNKLRQGTSRHISLHPGISPITSADWLNRFGHSLHTKTAVLHHNPEEDQRKLFSAIRQFTRHTPLILHITCRTTETDRAVLHCLARHCNFLVSFNADDLEAALRAQLSDLPPLSRLDILSDTPAEWLHAHAPKNLTLHFPNLPHHIRNGHLTGTPTPSICHDIASRQLAHPDTQAVLTILSPSGHEDYKKTARALIRLSEQTAKPLLVSSPFSDGITHFDTPTQAIRTLSYRNTAAALKQAQLDIAPPQPCRLKTPQPQNIKKALAAANPSLLAEALHLPPYRHTTHNAVQFQFDSHPLYGDILTARCNGQTTAVLPPFTTLDSRHLARFAELDGTQTLDQFLHTLTVIPEYRQHILGITLNLNGGQYSSDFLLKTPETHDTPKRKNTGKAAQTLEHAAAKMQSAAAYLKHKNPTAAEFLRHTSEAAAELLGSKTETGAAVPNVLAPYPAAYPKTLSLRNNTTVTITPILPEDAEAKQQFVRSLGPEARYTRFMTHTNELPAATLARLCNPDYHCEAAWTAKDADSNIVAVVRHSRLNRNECEFGITLAEHMRGSGLAQKMMELIIQTAAQQGYRTMSADILKTNTPMIKLAEKSGFTLKESDTEKNLYRAYLNLAADKTTEKTNKNLRTDHKIT

SEQ ID NO: 6810 - protein, 468 aa, Neisseria meningitidis; identical to SEQ ID NO: 2788

SEQ ID NO: 6811 - protein, 225 aa, Neisseria meningitidis
MSRVLLVDDDALLTELLTEYLSAEGLNVRSVPDGEAGVQEILSGQYDVVVLDSMMPKMNGLDVLKNVRARSTVPIIMLTAKGDDIDRIIGLEMGADDYVPKPCTPRELLARINAILRRAQHSGEQNNAPNSISVSDVVLYPAKRQASVKDMPLELTSTEFNLLEVLMRHAGQVVSKETLSVEALDRKLAKFDRSIDVHISSIRHKLGDASLIQTVRGLGYLFVKN

SEQ ID NO: 6812 - protein, 604 aa, Neisseria meningitidis; identical to SEQ ID NO: 3500

SEQ ID NO: 6813 - protein, 117 aa, Neisseria meningitidis
MNRQTAYLLASFSLIALIILSLSWELWIAPLRPGGSWLALKALPLCLPLSGILKKKIYTYQYSSMLVLIYFAEAVMRLFDAYPAEQICAALSAVFSIIFFISCLSFVKQYKETNNAR

SEQ ID NO: 6814 - protein, 202 aa, Neisseria meningitidis
MNTLYLGSNSPRRMEILTQLGYRVIQLPAGIDESVKAGETPFAYVQRMAEEKNRTALTLFCETNGTMPDFPLITADTCVVSDGIILGKPRSQAEAIEFLNRLSGKQHTVLTAVCIHYRGKTSSRVQTNRVVFKPLSSEEISAYVQSGEPMDKAGAYAVQGIGGIFIQSIEGSFSGIMGLPVYETVSMLQDLGYRSPLSALKP

SEQ ID NO: 6815 - protein, 256 aa, Neisseria meningitidis
MSETQNEQPVQPLVEHLIELRRRLMWTVVGILVCFFGLMPFAQQLYTFIADPLMANLPKDTSMIATDVIAPFFVPVKVTLMAAFLISLPHTLYQIWAFVAPALYQNEKRLITPLVLSSVSLFFIGMAFAYFLVFPVIFKFLASVTPVGVNMATDIDKYLSFILGMFVAFGTTFEVPIVVILLTKIGVVTTGQLKRARPYVIVGAFVIAAIITPPDVISQTLLAIPLILLYEAGIWFGRFFTPRSEQDGDIRPPATT

SEQ ID NO: 6816 - protein, 228 aa, Neisseria meningitidis; identical to SEQ ID NO: 70

SEQ ID NO: 6817 - protein, 67 aa, Neisseria meningitidis
MGSFSLTHWIIVLIIVVLIFGTKKLRNVGKDLGGAVHDFKQGLNEGTDGKEAQKDDVIEHKKDEDKA

SEQ ID NO: 6818 - protein, 107 aa, Neisseria meningitidis
MDNCIFCKIAAKDIPAQTVYEDGEMVCFKDINPAAPVHLLLIPKVHFDSLAHAAPEHQMLLGKMMLKVPEIAKAAGLADGFKTLINTGKGGGQEVFHLHIHIMGTPV

SEQ ID NO: 6819 - protein, 107 aa, Neisseria meningitidis
MGDSVLSAIQQTITQRKSANPSESYVAQLLHKGEDKILKKVIEEAGEVLMASKDKNPSHLVYEVADLWFHTMILLTHHDLKAEDVLDELARRQGLSGLVEKAARTES

SEQ ID NO: 6820 - protein, 354 aa, Neisseria meningitidis
MKAARFYDKGDIRIEDIPEPTVAPGTVGINVAWCGICGTDLHEFMEGPIFIPPCGHPHPISGESAPVTMGHEFSGVVYAVGEGVDDIKVGQHVVVEPYIIRDDVPTGEGSNYHLSKDMNFIGLGGCGGGLSEKIAVKRRWVHPISDKIPLDQAALIEPLSVGHHAYVRSGAKEGDVALVGGAGPIGLLLAAVLKAKGIKVIITELSKARKDKARESGVADYILDPSEVDVVAEVKKLTNGEGVDVAFECTSVNKVLDTLVEACKPAANLVIVSIWSHPATINVHSVVMKELDVRGTIAYCNDHAETIKLVEEGKINLEPFITQRIKLDELVSKGFERLIHNNESAVKIIVSPNL

SEQ ID NO: 6821 - protein, 369 aa, Neisseria meningitidis
MSLTRLILKFYALLRLFLGKNARTAWISHPACAGHEPGANHPDSPDRILCIEQALRRAGIWQHLQTIEAEEISDTRLALVHSSKYLNRLESCLPQKGKISRLDNDTAISTGSLSAARFAAGSAVQAVDMVMNRKAWHAFCAARPPGHHAGSGKAGGFCLLNNVAAGVMHAIAEYRLKRIAVIDFDVHYGDGTAEIFKDDPRILFFNLFETDLFPFPENNDMPDGGNMVHLPLPPGTGSRTFREAVRRQWLPRLAAFKPELVLLSAGFDAHRLDESGRLNLHEADFAWLTHKIIQTASGCPGKIISVLEGGYTLEPLAQSAAEHIRVLAGLGKSDAATAYQKTLDPTKKRFAKPKTGQVRQPTQSDRYDI

SEQ ID NO: 6822 - protein, 88 aa, Neisseria meningitidis
MNQAVAQFAPLVLIMVVFYFLIMRPQQKKFKAHQAMLAALKVGDKVVLAAGFKGKVTRVGEQFFTVDIGQGTKIEVEVERNAIAAKVD

SEQ ID NO: 6823 - protein, 618 aa, Neisseria meningitidis
MMNRYPLWKYLLIVFTIAVAAVYSLPNLFGETPAVQVSTNRQAIIINEQTQFKVDAALKNAGIQTDGMFVVDNSLKVRFKDTETQLKARDVIENTLGEGYITALNLLADSPEWMAKIKANPMFLGLDLRGGVHFTMQVDMKAAMQKTFERYSGDIRRELRREKIRSGTVRQAGNSLTVPLQDAGDVQKALPQLRKLFPEATLNSDGSNIVLTLSEEAVNKVCSDAVKQNITTLHNRVNELGVAEPVIQQSGADRIVVQLPGVQDTAKAKDIIGRTATLELRMVEDDPAKLREALEGNVPSGYELLSSGGDRPEILLISKQVELTGDNINDAQPSFDQMGAPAVSLSLDSAGGSIFGELTAANVGKRMAMVLIDQGKSEVVTAPVIRTAITGGRVEISGSMTTAEANDTSLLLRAGSLAAPMQIVEERTIGPSLGKENIEKGFHSTLWGFAIVAAFMVVYYRLMGFFSTIALSANILFLIGILSAMQATLTLPGMAALALTLGMAIDSNVLINERIREELRAGVPPQQAINLGFQHAWATIVDSNLTSLIAGIALLVFGSGPVRGFAVVHCLGILTSMYSSVVVFRALVNLWYGRRRKLQNISIGSVWKPKAEMAGGKE

SEQ ID NO: 6824 - protein, 311 aa, Neisseria meningitidis
MELFKIKRDIPFMSYGKLTTFISLVTFIAAVFFLVTRGLNFSVEFTGGTVMEVQYQQGADVNKMRERLDTLKIGDVQVQALGTNKHIMIRLPNKEGVTSAQLSNQVMDLLKKDSPDVTLRQVEFIGPQVGEELVSNGLMALGFVVIGIIIYLSMRFEWRFAVSAIIANMHDIVIILGCFAFFQWEFSLTVLAGILAVLGYSVNESVVVFDRIRENFRKPAMRGHAVPEVIDNAITATMSRTIITHGSTEAMVVSMLVFGGAALHGFSMALTIGIVFGIYSSVLVASPLLLMFGLSRDNIGKEPKKKEEIVV

SEQ ID NO: 6825 - protein, 89 aa, Neisseria meningitidis
MALTVEQKAQIVKDFQRKEGDTGSSEVQVALLTFRINDLTPHFKANPKDHHSRRGLLKMVSQRRRLLAYLRRTQPDTYRALITRLGLRK

SEQ ID NO: 6826 - protein, 419 aa, Neisseria meningitidis
MLPVRFTRVSDGIKRLTPASNQTAFYHPFENPFCRYSSFYWSIAIMTATTASSAKPYLKIQGLVKKFGDNYAVDNIDLDIYQHEIFALLGSSGSGKSTLLRMLAGMESPNQGKIILDGQDITKLAPYDRPINMMFQSYALFPHMTVEQNIAFGLKQDKMPKGEIAARVEEMLRLVQMTKFAKRKPHQLSGGQQQRIALARSLAKRPKILLLDEPLGALDKKLRQQTQLELVNTLEQVGVTCIMVTHDQEEAMTMATRIAIMSDGQLQQVGTPSDVYDYPNSRFTAEFIGETNIFDGVVIEDHADYAVIECEGLENHVRIDHGLGGPSEQDLWVSIRPEDIDLYKEKPEYLGDYNWAKGTVKEIAYLGSFAIYHIKLGNGRVVKSQVPAPYWYVRNITPPTWDETVYISWPENQPTPLFR

SEQ ID NO: 6827 - protein, 321 aa, Neisseria meningitidis
MNLNKLKNKLFRRPGQRAVIAVPYIWLLVLFLIPFAIVLKISFAEQEIAIPPFTPLTTIDEDLGRLNIAVSYQNYADIFQNFWSTLNPFGDGENSNIYLMTYWSSIKTALTTTVICLLVGYPTAYAISRANPSVRNGLLLAIMLPFWTSFLLRVYAWMGLLGHNGIVNNLLIKMGIISEPLDLFYNAFSLNLVMVYAYLPFMILPLYTQLVKLDNRLLEAASDLGAGPVKSFLTITLPLSKTGIIAGSMLVFVPAVGEFVIPELVGGSENLMIGKVLWQAFFDQNNWPLASAVAVVMVALLVVPIALFQHYENRELEEGAK

SEQ ID NO: 6828 - protein, 295 aa, Neisseria meningitidis
MQKSKLSWFLKLMLALSLAFLYIPLVVLVIYSFNESKLVTVWGGFSTKWYGALLENDTILEAAWLSLRIAVVSSLAAVVLGTLAGYAMARIKRFRGSTLFAGMISAPMVMPDVITGLSMLLLIIQVQIFLQGSEWLQHLYFDRGFFTIFLGHTTLCMAYITVVIRSRLVELDQSLEEAAMDLGARPLKIFFVITLPLIAPAIASGFLLGITLSLDDLVITSFLSGPGSSTLPQVIFSKIKLGLDPQMNVLATILIGIIGTLVIIVNYWMMRQATKRDREAAEAYRQEKLAAEKAN

SEQ ID NO: 6829 - protein, 35 aa, Neisseria meningitidis
MTGSACFLQPIFCLDDMARQPVSFRPKIHLIKQTQ

SEQ ID NO: 6830 - protein, 431 aa, Neisseria meningitidis
MIRPDFQEYLPSYYFSSVNPHTVYPKLQCRLKTDTCIIGGGLGGLCTALPLAEQGHETVVLEAARIGFGASGRSGGQVISDYACGMGEIEKQVGLEQAQWFWQQSLQAVELVDERVRKHAVDCDWQRGYATVAVRPQHWEELQQWHEHAQRHYGASHYQLWDKAELKQQLDSDMYQGAQFDPLSGHLHPLTYTLGIARAAAEAGAQIFEQSPMTCIEPHQNGWLVYTPEGSVECKNVVYAVNTYAGLNPIFRPLERKAIAVSTFIIATEPLGARAKGLIRNNMAVCDNRHILDYYRLSADGRLLFGGKDNEFIDNPERMTELVRQDMLKVFPQLADVKIEYSWGGECDITANLVPHFGRLAPNVFYAQGYSGHGMAITGIAGLAVAEAILGDECRLKPFERLRQPNIILQPFLRKLGSFLGSKYYQWKDSR

SEQ ID NO: 6831 - protein, 434 aa, Neisseria meningitidis
MKKHIWAASLLPASLSAEPLNWWKPYSAVNSGDTAWVMTAAALVLLMTLPGLALFYGGMVRKKNLLSTMMHSFSIATLVGILWVAVGYSLAFTPGNAFIGGLGRVFLSGMQIDATAQMLTVSPNAPTVPEPVFMFFQMTFAIISTAIITGAFAERMKYSAMMLFSGIWFLLVYVPGAHWVWGGGFMSKGGVLDYAGGTVVHINAGIAGLVAALVLGRRIGYGREAMPPHNMAMTLIGAAMLWFGWFGFNAGSALAADAAAGMAMAVTQVSAVFGAAGWLACEKIAGHKPSALGLASGAVSGLVGITPAAGFTGPSGAAAIGILTAAACFVSVTVVKHKLRYDDSLDAFGIHGFGGLVGGILTGIFFDNRIFGGDAAVWQQLWIQVKDGVVMAAYSGLMSWAILKVVGKICGGLRVGKDVEREGLDLNIHGERVE

SEQ ID NO: 6832 - protein, 134 aa, Neisseria meningitidis
MRKIRLSRYKQNKLIELFVAGVTARTAAELVGVNKSTSAYYFHRLRLLIYQNSPHLEMFDGEVEADESYFAERQNHINGIGNFWNRAKRHLRKFDGIPKAHFELYLKGYERRFNNSEIKVQISILKQLVKSSLS

SEQ ID NO: 6833 - protein, 419 aa, Neisseria meningitidis
MHVSELQTLHISKLLELAEEHGIENANRFRKQDLVFAIVRQMMKKGEGFTCSGTLEILPDGFGFLRSADTSYLAGPDDIYVSPTQIRRFNLHTGDTIEGSVRVPKDNERYFALVRLDTINGDHPEVCRHKILFENLTPLFPTEQLKLERDLKSEENLTGRAIDLISPIGKGQRALLVAPPKSGKTVMLQNIAHAVTANYPEVELIVLLIDERPEEVTEMSRSVRGEVVSSTFDEPAQRHVQVAEMVLEKAKRMVEHKKDVVILLDSITRLARAYNTVVPTSGKILTGGVDANALHRPKRFFGAARNVEEGGSLTIIATALVETGSRMDDVIYEEFKGTGNMELHLDRRMAEKRLFPAININKSGTRREELLVPNDQLQRMWLLRKFLHPMDEIEAAEFLIGKIKASKNNDDFFELMRGK

SEQ ID NO: 6834 - protein, 794 aa, Neisseria meningitidis
MADNYVIWFENLRMTDVERVGGKNASLGEMISQLTEKGVRVPGGFATTAEAYRAFLAHNGLSERISAALAKLDVEDVAELARVGKEIRQWILDTPFPEQLDAEIEAAWNKMVADAGGADISVAVRSSATAEDLPDASFAGQQETFLNINGLDNVKEAMHHVFASLYNDRAISYRVHKGFEHDIVALSAGVQRMVRSDSGASGVMFTLDTESGYDQVVFVTSSYGLGENVVQGAVNPDEFYVFKPTLKAGKPAILRKTMGSKHIKMIFTDKAEAGKSVTNVDVPEEDRNRFSITDEEITELAHYALTIEKHYGRPMDIEWGRDGLDGKLYILQARPETVKSQEEGNRNLRRFAINGDKTVLCEGRAIGQKVGQGKVRLIKDASEMDSVEAGDVLVTDMTDPDWEPVMKRASAIVTNRGGRTCHAAIIARELGIPAVVGCGNATELLKNGQEVTVSCAEGDTGFIYAGLLDVQITDVALDNMPKAPVKVMMNVGNPELAFSFANLPSEGIGLARMEFIINRQIGIHPKALLEFDKQDDELKAEITRRIAGYASPVDFYVDKIAEGVATLAASVYPRKTIVRMSDFKSNEYANLVGGNVYEPHEENPMLGFRGAARYVADNFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVEEGIESVSLNPDTVIETWLYLANELNK

SEQ ID NO: 6835 - protein, 273 aa, Neisseria meningitidis
MSSPRHVFYISDRTGLTAENIGEALLNQFGNLSFKRHTHPFVDTPEKARAVVEKVNRSRQENGQRPIAFVSVVDDEIRRIIKGADAFQINFFETFLGLLEKELNTEATASGQGHHSIGNTKRYDARMEAVNFSLNHDDGVSDKNLQEADVILMGVSRSGKTPTCLYLALQYGIRAANYPLIPDDLESADLPRMVKPYRDKLFGLTIQPERLQAIRQERRPNSTYAKIDTCRSEVADAQSMFRRHGIPFANTTDKSVEELAVHILQACKLKRRF

SEQ ID NO: 6836 - protein, 220 aa, Neisseria meningitidis
MIQAVLFDLDGTLADTALDLGGALNTLLARHGLPAKSMDEIRTQASHGAAGLIKLGAGITPDHPDYARWRTEYLDEYDSRYAQDTTLFDGVNELIAELGKRGIKWGIITNKPMRFTDKLVPKLGFIIPPAVVVSGDTCGEPKPSVKPMLYACGQIHADPQHTLYVGDAERDIQAGRNAGMTTVLAEWGYIAPEDDTGSWQADFHIRTPLDLLECLDKIQP

SEQ ID NO: 6837 - protein, 275 aa, Neisseria meningitidis
MKPDIYALLERALLSGDPDEKGRLTDEAFAAVQNADGAETNAPPADFPRAGRPDKPVLVAPSQLTPRKMNTTEGYAAMLHAIAHIEFNAINLALDAAYRFRTLPFQFVRDWVKVAKEEVYHFRLMRERLRAFGFDYGDFEAHNHLWDMAYKTAYDPLLRMALVPRVLEARGLDVTPGIRAKVAQRGDSETCGVLDIIYRDEVGHVAIGNRWYQHLCRERGLEPVALFRSLIARYDMFIFRGYVNIEAREKAGFSRFELDMLEDFEQGLKQNKHAV

SEQ ID NO: 6838 - protein, 207 aa, Neisseria meningitidis; identical to SEQ ID NO: 2328

SEQ ID NO: 6839 - protein, 379 aa, Neisseria meningitidis
MKKTLVAAAILSLALTACGGGSDTAAQTPSAKPEAEQSGKLNIYNWSDYVDPETVAAFEKETGIKTRSDYYDSNETLEAKVLTGKSGYDLTAPSIANVGRQIKAGAYQKIDKAQIPHYGNIDKDLLKMMEAVDPGNEYAVPYFWGINTLAINTQQVKKALGTDKLPENEWDLVFKPEYTAKLKSCGISYFDSAIEQIPLALHYLGKDPNSENPEDIKAAVDMMKAVRGDVKRFSSSGYIDDMAAGNLCAAIGYGGDLNIAKTRAEEAANGVEIKVLTPKTGVGVWVDSFMIPRDAQNVANAHRYIDYTLRPEVAAKNGSFVTYAPASRPARELMDEKYTSDASIFPNKELMEKSFIVSPKSAESVKLGVKLWQGLKAGK

SEQ ID NO: 6840 - skipped

SEQ ID NO: 6841 - protein, 176 aa, Neisseria meningitidis
MNAIRTFQNRTPEIHETCMIDEACVVIGEVSLAEDVSVWPCAVLRGDVNSITVGARSNIQDGSVLHVSHKTAAKPEGSPLVIGEDVTVGHKVMLHGCRIGNRVLVGMGTTVLDDAVIEDEVMIGAGSLVPPRKRLAGGYLYVGSPVRQVRVLTDEEKAFLKYSAAHYVKLSKQYGM

SEQ ID NO: 6842 - protein, 531 aa, Neisseria meningitidis; identical to SEQ ID NO: 1496

SEQ ID NO: 6843 - protein, 131 aa, Neisseria meningitidis
MDKNLLEAVKFDEKGLVCAIAQDAETKRILMVAWMNAEALQKTVETGFAHYYSRSRQKQWMKGEESGHTQKVRALRLDCDGDAIVMLIAQNGGIACHTGRESCFYKVWRGSAWETADAVLKDEKEIYGSTH

SEQ ID NO: 6844 - protein, 255 aa, Neisseria meningitidis
MALAKRIIPCLDVKDGRVVKGVNFIGLRDAGDPVEAAKRYNGEGADELTFLDITASSDNRDTILHIIEEVAGQVFIPLTVGGGVRTVADIRRLLNAGADKVSINTAAVTRPDLIDEAAGFFGSQAIVAAVDAKAANPENTRWEIFTHGGRNPTGLDAVEWAVEMQKRGAGEILLTGMDRDGTKQGFNLPLTRAVAEAVDIPVIASGGVGNVRHLIEGITEGKADAVLAAGIFHFGEIAIREAKRAMREAGIEVRL

SEQ ID NO: 6845 - protein, 245 aa, Neisseria meningitidis
MLLIPAIDLKEGRCVRLKQGLMEEATVFSDSPAETALHWFKQGARRLHLVDLNGAFAGVPQNLPAIKDILAAVAKDIPVQLGGGIRDLKTIGQYLDLGLNDVIIGTAAVKNPDFVREACKAFPGRIIVGLDAKDGMAAIDGWATVTGHHVIDLAKRFEDDGVNSIIYTDIGRDGMMSGVNIDATVKLAQTVRIPVISSGGLTGLDDIRALCAAEKHGVAGAITGRAIYEGSIDFAQAQQLADSLD

SEQ ID NO: 6846 - protein, 212 aa, Neisseria meningitidis
MQTAIIDYGMGNLHSVLKSVRTAGQLAGKNTEIFLSGDPDRVSRADKVIFPGQGAMPDCMAALKRDGLDEAVKDALKNKPFFGICVGAQLLFDHSEEGNTDGLGWFGGKVRRFERDLRDPQGCRLKVPHMGWNTVRQTQNHPLFKDIPQDTRFYFVHSYYFAPENPETILGESDYPSPFACIVGKDNVFATQFHTEKSHDAGLTMLKNFLNW

SEQ ID NO: 6847 - protein, 500 aa, Neisseria meningitidis
MAKVLIVPVSAGLDASAAAQAFAKALDAQIFQAVDATAETLLAQGKSDDWFDALVGKVAALDAANLVIEGIAPDADKIYLAGKNVELALSLDAAAVFAVRSDNADADELANRVNLAKQFFAAAPGVLEGFVVDGAAASVAEAAAEKTGLTFFGSSDALKDVSVLAGREAKRLSPAQFRYNLIDFARQADKRIVLPEGAEPRTVQAAAICHEKGIARCVLLAKREEVEAVAKERGISLPDSLEIIDPASLVEQYVEPMCELRKSKGLTPEDARKQLQDTVVLGTMMMAQNDVDGLVSGAVHTTANTIRPALQLIKTAPGASLVSSVFFMLLPNQVLVFGDCAVNPNPTAQQLADIAIQSADSAKAFGIDPKVAMISYSTVNSGSGPDVDTVIEATKLAREKRPDLAIDGPLQYDAATVPGVGKSKAPGSPVAGQATVLVFPDLNTGNCTYKAVQRNANVLSVGPLLQGLRKPVNDLSRGALVEDIVFTIALTAVQAKQMEG

SEQ ID NO: 6848 - protein, 352 aa, Neisseria meningitidis
MTAALHIGHLSKSFQNTPVLNDISLSLDPGEILFIVGASGCGKTTLLRCLAGFEQPDFGEISLSGRTIFSKNTNLPVRERRLGYVVQEGVLFPHLTVYRNTAYGLGNGKGKTAQERQRIEAMLELTGISELAGRYPHELSGGQQQRVALARALAPDPELILLDEPFSALDEQLRRQIREDMIAALRANGKSAVFVSHDREEALQYADRIAVMKQGRILQTASPHELYRQPADLDAALFIGEGIVFPAALNADGTADCGLGRLPVQSGAPAGTRGTLLIRPEQFSLHPHSAPTASIHAVVLKTTPKARHTEISLRVGQTVLTLNLPSAPTLSDGISAVLHLDGPALFFPGNTL

SEQ ID NO: 6849 - protein, 505 aa, Neisseria meningitidis
MSPKKIPIWLTGLILLIALPLTLPFLYVAMRSWQVGINRAVELLFRPRMWDLLSNTLTMMAGVTLISIVLGIACALLFQRYRFFGKTFFQTAITLPLCIPAFVSCFTWISLTFRVEGFWGTVMIMSLSSFPLAYLPVEAALKRISLSYEEVSLSLGKSRLQTFFSAILPQLKPAIGSSVLLIALHMLVEFGAVSILNYPTFTTAIFQEYEMSYNNNTAALLSAVLMAVCGIVVFGESIFRGKAKIYHSGKGVARPYPVKTLKLPGQIGAIVFLSSLLTLGIIIPFGVLIHWMMVGTSGTFALVSVFDAFIRSLSVSALGAILTILCALPLVWASVRYRNFLTVWIDRLPFLLHAVPGLVIALSLVYFSINYTPAVYQTFIVVILAYFMLYLPMAQTTLRTSLEQLPKGMEQVGATLGRGHFFIFRTLVLPSILPGITAAFALVFLKLMKELTATLLLTTDDVHTLSTAVWEYTSDAQYAAATPYALMLVLFSGIPVFLLKKYAFK

SEQ ID NO: 6850 - protein, 331 aa, Neisseria meningitidis
MKTSIRYALLAAALTAATPALADITVYNGQHKEAAQAVADAFTRATGIKVKLNSAKGDQLAGQIKEEGSRSPADVFYSEQIPALATLSAANLLEPLPASTINETRGKGVPVAAKKDWVALSGRSRVVVYDTRKLSEKDLEKSVLNYATPKWKNRIGYAPTSGAFLEQVVAIVKLKGEAAALKWLKGLKEYGKPYAKNSVALQAVENGEIDAALINNYYWHAFAREKGVQNVHTRLNFVRHRDPGALVTYSGAAVLKSSQNKDEAKKFVAFLASKEGQRALTAVRAEYPLNPHVVSTFNLEPIAKLEAPQVSATTVSEKEHATRLLEQAGMK

SEQ ID NO: 6851 - protein, 321 aa, Neisseria meningitidis
MSYTQLTQGERYHIQYLSRHCTVTEIAKQLNRHKSTISREIRRHRTQGQQYSAEKAQRQSRTIKQRKRQPYKLDSQLIQHIDPLIRRKLSPEQVCAYLCKHHQITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRALKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLIH

SEQ ID NO: 6852 - protein, 127 aa, Neisseria meningitidis
MTDTDTQADRFEQMMWQAVDKLFEQHDGKLESMDGREQELVLIWRTEADIGNGSILQFVCNWGFPAAEKTCSVLKKIGAVHSAMLIHRAADALDKEIRRLQSEGKNLKEMWDITSRQQNRLTAEQSG

SEQ ID NO: 6853 - protein, 458 aa, Neisseria meningitidis
MHDKTWSGRFNEPVSELVKQYTASIGFDRRLAEWDIQGSLAHAQMLKETGVLDEGDLADIRRGMAEILEEIRSGKIEWSSDLEDVHMNIERRLTDKIGDAGKRLHTGRSRNDQVATDIRLWLRDQITVIQSLIQSLQTALLDLAEQNAETVMPGFTHLQVAQPVSFGHHMLAYVEMLGRDNERMADCRCRVNRMPLGAAALAGTTYPIQREITAELLGFEQICQNSLDAVSDRDFAIEFTAAASLVMVHLSRLSEELILWMSPRFGFIDIADRFCTGSSIMPQKKNPDVPELVRGKSGRVIGHLIGLITLMKSQPLAYNKDNQEDKEPLFDTADTLIDTLRIYADMMRGVTVKPDNMRAAVMQGFATATDLADYLVKKGMPFRDAHEVVAQAVRHADQAGVDLSELPLEVLQGFSDLIADDVYGVLTPEGSLNARNHLGGTAPEQVRFQVKRWREMLA

SEQ ID NO: 6854 - protein, 289 aa, Neisseria meningitidis
MKPIRKAVFPVAGMGTRFLPATKASPKEMLPIVDKPLIQYAVEEAVEAGCTEMVFVTGRNKRSIEDHFDKAYELETELEMRHKDKLLEHVRNILPPNITCLYIRQAEALGLGHAVLCARAAIGDEPFAVILADDLIDAPKGALKQMVEVYGRSGNSILGVETVEASQTGSYGIVETEQLKQFQRITGIVEKPKPEDAPSNLAVVGRYILTPRIFDLLTNLPRGAGNEIQLTDGIAKLLDHEFVLAHPFEGTRYDCGSKLGYLEATVAYGLKHPETGEPFRRLLEKYRTE

SEQ ID NO: 6855 - protein, 199 aa, Neisseria meningitidis
MSEKPEKIVLASGNAGKLEEFGNLFKPYSITVLPQSAFGIPECPEPYPTFVENALAKARHAAKYSGLPALADDSGICAAALNGAPGIHSARYAGDNPKSDTANNLKLAAELVGKADKSCCYVCVLVFVRHKDDPRPIIAEGVWHGQWNDTPLGQNGFGYDPYFYLPEHGKTAAELDTEVKNRESHRAQALAELLRKLAL

SEQ ID NO: 6856 - protein, 77 aa, Neisseria meningitidis
MNRRKIYLLSVALFTLAFMLLVLLGAYLLTVGSKAFAVASFLFAFGALFGQIGSLALYLRHKSLRAAQSATKENRYV

SEQ ID NO: 6857 - protein, 177 aa, Neisseria meningitidis
MADFNQILTPGDVDGGIINVVNEIPAGSNHKIEWNRKLAAFQLDRVEPAIFAKPTNYGFIPQTLDEDGDELDVLLVTEQPLATGVFLEARVIGVMKFVDDGEVDDKIVCVPADDRNNGNAYKTLSDLPQQLIKQIEFHFNHYKDLKKAGTTKVESWGDAEEAKKVIKESIERWNKQA

SEQ ID NO: 6858 - protein, 152 aa, Neisseria meningitidis
MPMAKPLKYPVSALVVLYSGDGGILLIERTHPEGFWQSVTGSLEPGETVAQTARREVWEETGILLADGQLQDWHDSTVYEIYHHWRHRYPKGVFENREHLFSAEIPRDTPIALQPEEHVSYGWFDMEEAAEKVFSPSNRRAILELGRFLGKR

SEQ ID NO: 6859 - protein, 608 aa, Neisseria meningitidis
MGISRKISLILSILAVCLPMHAHASDLANDSFIRQVLDRQHFEPDGKYHLFGSRGELAERSGHIGLGKIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGSMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPIKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQEIRNGNINSNFSQHAQLEREINKLKSADEINFADGMGKFTDSMNDKAFSRLVKSVKENGFTNPVVEYVEINGKAYIVRGNNRVFAAEYLGRIHELKFKKVDFPVPNTSWKNPTDVLNESGNVKRPRYRSK

SEQ ID NO: 6860 - protein, 154 aa, Neisseria meningitidis
MAIWNYRYYLIPSAAIRNKFNANKDIILDEYRSNGFQNFNENKSFENYFIDNDVILLSIINEAKKQLKLKESWDKDAIMFCDNFGNSLTVWPDDIECELDLRFDYTKFIQKTIDWAIKYNCLLVIEKTGNVVSPNINNLMYEIKAYLESKPWPI

SEQ ID NO: 6861 - skipped

SEQ ID NO: 6862 - protein, 95 aa, Neisseria meningitidis
MQLEIIGSKIYTEQDFHNQISKIFSIQDYYGNNLDALWDLLSTNVERPITLVWKDAMFSKNQLENIFIEIVNVLERVKKQDEDYGFEEKFNYILE

SEQ ID NO: 6863 - protein, 412 aa, Neisseria meningitidis
MIASLTGAAVGGTPVDAQTGGAVGQNAVENNLYLTSEALKKDKQTARKIYSVIKEQVKHECSSTGRITECRQNIGRIIEFTQDKRFDSRFKDLKKESLYYLNKHPDLVASYLKAEYEKLDREDKSILHRYISPGAEIVSGSLGVVLSGVAGGGSCAETFGLGCAAALVGVTSSYDHVITGTKNFGKKASEQRPTIAVQALKQLGLSEQAAEYVQFSIDLFSVGKSGGGIPKAKPVFDAKPRWEVDRKLNKLTTREQVEKNVQETRRRSQSSQFKAHAQREWENKTGLDFNHFIGGDINKKGTVTGGHSLTRGDVRVIQQTSAPDKHGVYQATVEIKKPDGSWEVKTKKGGKVMTKHTMFPKDWDEARIRAEVTSAWESRIMLKDNKWQGTSKSGIKIEGFTEPNRTAYPIYE

SEQ ID NO: 6864 - protein, 140 aa, Neisseria meningitidis
MMKRIKCFCDKFPSGDTFRMCIILDDYDNRVDYYVGIYDYITSTLMSDIYYRSTIDEHFKIIELIENNPNEIYDDGGGQQFCLEFHHDKVIFYHNEFDEEDGYPVLSCSLHTFKTALIAWNAFLQLPKSIHSVVETVIEE

SEQ ID NO: 6865 - protein, 74 aa, Neisseria meningitidis
MRLATKDLAEAIRKGQVRKSSFNTEQLRAIEKGESKIPDYTWHHHQDTGRMQLIREGLHHDTGHIGWEAMNKGR

SEQ ID NO: 6866 - protein, 139 aa, Neisseria meningitidis
MGSNEQRKVTMWKIIKEDSDDLEFAIKCLFSQSIDLNEFKLWIEQVIRDMPIEDIPFYIFDLADFDGGIADIDNIVGFVSSCRLSKSKKNALTGIAFLRGIDVYDPPISKEKALKALEKHPEIYQKFQHFFPFVELPPL

SEQ ID NO: 6867 - protein, 129 aa, Neisseria meningitidis
MWKIIKEDSDDLGFAIKCLFSQSIDLNEFKLWIEQVIRDMPIEDIPFYIFDLADFDGGIADIDNIVGFVSSCRLSKSKKNALTGIAFLRGIDVYDPPISKEKALKALEKHPEIYQKFQHFFPFVELPPL

SEQ ID NO: 6868 - protein, 313 aa, Neisseria meningitidis; identical to SEQ ID NO: 314

SEQ ID NO: 6869 - protein, 422 aa, Neisseria meningitidis
MKPLRRLTNLLAACAVAAAALIQPALAADLAQDPFITDNAQRQHYEPGGKYHLFGDPRGSVSDRTGKINVIQDYTHQMGNLLIQQANINGTIGYHTRFSGHGHEEHAPFDNHAADSASEEKGNVDEGFTVYRLNWEGHEHHPADAYDGPKGGNYPKPTGARDEYTYHVNGTARSIKLNPTDTRSIRQRISDNYSNLGSNFSDRADEANRKMFEHNAKLDRWGNSMEFINGVAAGALNPFISAGEAVDQWMQENPNAAETVEALVNVLPFAKVKNLTKAAKPGKAAVSGDFSDSYKHNTASRLSQSVDGEMFQTRNVDFKAKSIGTKIHDGAQGKHISGHRNYIEGKSTLNQNINPQELLNGIHSGAYPVISKGARGNPVVDFGYPIGSDGKSGLSTNFGTIHSGKNGVHIVPANPKTIKKVQ

SEQ ID NO: 6870 - protein, 105 aa, Neisseria meningitidis
MNILPSWLRVGMNIAMLGMIHSDIRLITVDYEEGRRFLKIKNYLSREAITEDHEDMEYLITELWSMCGEYFDEADFECIYSNHSSMELNQINGAVFRRKELISQA

SEQ ID NO: 6871 - protein, 235 aa, Neisseria meningitidis
MVKTADGYKAIARIRTGDRVFAKDEASGKTGYKPVTARYGNPYQETVYIEISDGIGNNQTLISNKIHPFYSQGKWIQAGRLKKGDTLLSESGAKQTVQNITFKQQPLKAYNLTVADWHTYFVKGSQAETEGVWVHNDCPYDKGNQRYKDASYHGKNDNSVKSRAPTNGQAALDNSVQVKSTSPRRVGVDKANNEIVVLNKTQTFNNGSAEYHGHVRSWQDLHTDQKNALKKAGLD

SEQ ID NO: 6872 - protein, 109 aa, Neisseria meningitidis
MTDKSKTEKLISSDDKQSVIDGILDMVFNSKAYEVPWISEKLMELSKNKDLDIAGLSLTCFGHLARLHSNIGDYDKVIPLLHSKQDDPELQGRAEDALEDISLFLSENH

SEQ ID NO: 6873 - protein, 67 aa, Neisseria meningitidis
MRTEFFKNPTLAPSTAAPWSKRQTAEKQTPSVVLPFADEYGSTPMPPKPSKPPSTLPPPKPQSWQKR

SEQ ID NO: 6874 - protein, 86 aa, Neisseria meningitidis
MLLPRQHLGQNGRRLKSKHRPSCCRLRMSTGQPQCRRNRRSRLQHCRRQSRKVGKNGKTGEIKADGRKVNVRIDSTEADLLYPAGQ

SEQ ID NO: 6875 - protein, 133 aa, Neisseria meningitidis
MKIKPLQFSNNNHRFYVDKICVTEQDVNILASDRNYELNIEIFIDNIIHFQITDESYKVKFSEYLFENKEKNDWDRNPAINYFFEIIDDSYMDWLKEESFDFFEKKYYKAYIFFFSDSVIEVISSTEPVFYSK

SEQ ID NO: 6876 - protein, 129 aa, Neisseria meningitidis
MWKISKENCEDLGFAIVCMFYDAINLSEFKLWLDIVVRDIPIDTIPLYIFDLIDFDKSIGEIYDVIGVVNYGYISNDQKNALTGIAFLRGIDVYDPPISKEKALKALEKYPEIYQRFQHFFPFVELPLF

SEQ ID NO: 6877 - protein, 766 aa, Neisseria meningitidis
MAHYAIGDIQGCFDELTALLGKIGFNHGTDTLWLTGDIVNRGPKSLETLQFCIRHENSVQIVLGNHDLHLLAVGCGEGAPKRSDTIEPILKHPDGKKMLDWLRAQPLLIREGSRVMVHAGILPQWRITKAESLAREAEAELRGKKYVKFFSKMYGNKPAAWDEGLKGYARLRFIVNAFTRMRALTFKNELDFDYKSTVKKMPPYLRPWFKAPDRQNLDAHHLRTLVLAGLHECRQRHLAGHRRAVGRTADRRQPRNGRNYPSPSRRRHRLEKLRKITDRPTMHKILPIAHVLSRLGMLFSFILLIPAALSYAFSDGAYTAFATTATVTLSGSCIVRLATLRFRRELRPRDGFTLVLMLWLAFAAMAAMPMYLYFPNMGFTDAFFESMSGLTTTGATVIPHVDGLAPSVNFWRHMLNWLGGMGIIVLAVAILPMLGVGGTQLFKAEIPGIDKESKMSPRISQVAKKLWFGYTLITILAAACLHFAGMGWFDAVCHAMATLSLGGFSTHDASIAYYNSPLIEAVIIVFTIVGGINFANHFAALNSRSLKTYWKDEECRTMLLLLSGSILAAALYLWHTGYYAGFTESLRYTAFNFVSIGLANGLANTDFAQWPLLISLWMFFLANILANSGSTGGGIKTIRALVLFKFSLREMMVLLHPKAVRTVKISGKAIPDRLALTVMSFIFIYFMTVVLFSFLLMASGMEFTTAFTAVIACITNAGPGLGEVGPAGNYAGLDVMQKWICVTAMLLGRLEIFTVFILFTPAYWKK

SEQ ID NO: 6878 - protein, 129 aa, Neisseria meningitidis
MSKTIIHTDKAPAAIGAYSQAVRAGDTVYMSGQIPLDPATMTVVGNGDFRAEARQVFQNLQAVAEAAGGTLADIVKLNAYLTDLGNFAVFNEVMAEFIAEPFPARAAVGVASLPKGVQVEAEAVLVLNA

SEQ ID NO: 6879 - protein, 174 aa, Neisseria meningitidis
MKKALATLIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSIGLGVLTGVSYAVTPNVDLDAGYRYNYIGKVNTVKNVRSGELSAGVRVKF

SEQ ID NO: 6880 - protein, 64 aa, Neisseria meningitidis
MENAAASPAGRFRRHSRRRKCPTLKAQTHTKPYACTCNNPTDTAVFSKPFASFTHPPRDAAATI

SEQ ID NO: 6881 - protein, 391 aa, Neisseria meningitidis
MHTISFPNRTRLTALPPLSLYIHIPWCIKKCPYCDFNSHSLKNGLPEAAYIDALLTDLQLELPNIWGRPVETIFFGGGTPSLFQAESIDRLLSGVRSLLRLQPEAEITLEANPGTFEIEKFQGFKDAGITRLSIGVQSFNDDMLSRLGRVHNGKEALTAIDTALKLFDKVNIDLMYALPNQTVQTALDDVQTAIATGATHISAYHLTMEPNTPFGHTPPKGLPQDEAALDIEDAVHGALEGAGFVHYETSAFAKPAMQCRHNLNYWQFGDYLGIGAGAHGKISYPDRIERTVRRRHPNDYLALMQSQPSEAVERKTVAAEDLPFEFMMNALRLTDGVPAAMLQERTGVPSAKIMAQIETARQKGLLETDPAVFRPTEKGRLFLNDLLQCFL

SEQ ID NO: 6882 - protein, 841 aa, Neisseria meningitidis
MNPNSKHNTNFTNLLKPSDSDIKQFAAQHICRLTDLLNRYAYEYYTLDAPSVPDAEYDKLFRELEALELNHPELKLPDSPTQRVGGEPLAGFAEVRHEVPMLSLTNAFSPQDENGVFDHAEMYAFDQRVRDGLDGGNPEYVIEPKFDGLAISLLYRDGVLVQAATRGDGTTGEDVTQNIKTVSNIPLRLHGENTPELIEVRGEVLMLKADFVALNKRQAENGQKPFANPRNAAAGSLRQLDSRITAQRKLHFFPYSVARQQDGFVAEEHIQELAYFQALGFSLPNGNFGCFKNIDEVLAFYEHMQQKRPELPYEIDGMVVKVNSLAQQHELGFISRAPRWAVAHKFPAEEALTIVEAIDVQIGRTGAVTPVARLQPVFVGGVTVTNATLHNQDEVSRKDVRVGDTVVVRRAGDVIPEVVRVIFERRPMRETAVAVSDGIGHRQDDLFAETPSANQTQSVPLHKPYRLPTHCPICRSEIEREEGEAVARCSGGMLCQAQRAQGLIHFASRKAMDIDGLGEKQIEQLVAQDLVRHFADLYRLDIPTLQKMKETADKTVAESDQMPSEGSSVGASGKHKKQPVKWAENILAGIEASKTPELARFLFALGIRHVGERTAKTLAQAFGTLERVRRAPEPVLACLPDIGTVVARSIAHFFAQAEQQAMIDELLAAGVAPQTQAVTIPPARHAEPQRWIARLPGFKISENKAQALWELAGKNIEGLQTDKALPTDWQAWRSEPQNAALLENLKTFFAQMPSEDEAAQGSDGINKAVAGKTFVLTGTLPTLKRDQAQSLIEAAGGKVSGSVSKKTDYVVAGEAAGSKLEKANALGVSVLSEAELLTLLG

SEQ ID NO: 6883 - protein, 428 aa, Neisseria meningitidis; identical to SEQ ID NO: 526

SEQ ID NO: 6884 - protein, 190 aa, Neisseria meningitidis
MDNHAEAHWQNGWLQSIRHTPSPNFSPRETGETVSLIVLHNISLPPFEYGTDAVEKLFANRLDPDGHPFFSLIHTLRVSSHFLIKRDGETVQFVSCDNMAYHAGVSSFGGREKCNAFSIGIELEGCDFEPFAEAQYRSLEALLDAICRHYPVTAVTGHQDIAPGRKTDPGHFFDWRRIREKGFLVDRNAV

SEQ ID NO: 6885 - protein, 331 aa, Neisseria meningitidis; identical to SEQ ID NO: 32

SEQ ID NO: 6886 - protein, 206 aa, Neisseria meningitidis
MKPQFITLDGIDGAGKSTNLAVIKAWFERRGLPVLFTREPGGTPVGEALREILLNPETKAGLRAETLMMFAARMQHIEEVILPALSDGIHVVSDRFTDATFAYQGGGRGMPSEDIEILEHWVQGGLKPDLTLLLDVPLEVSMARIGQTREKDRFEQEQADFFMRVRGVYLDRAAACPERYAVIDSNRNLDEVRNSIEKVLDGHFGC

SEQ ID NO: 6887 - protein, 426 aa, Neisseria meningitidis
MENSLKEAALKFHEFPVPGKISVTPTKSLATDKDLALAYSPGVAAPCMEIHADPQNAYKYTAKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRFTGRKIEEATLVCSGAGAAAIACLNQLLDLGLKRENVTVCDSKGVIYQTREDKDRMDESKQFYAIEDNGQRVLADAVKGKDIFLGLSGANLLTPEILNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLSEWKL

SEQ ID NO: 6888 - protein, 344 aa, Neisseria meningitidis
MPNCFKFHTVIERHWQKPYPVLSFLLKPLSGLFAKIAAKRRTDFLSGKRQSEKLPVPVVVVGNIHAGGTGKTPIVAALVSGLQEKGVKVGIISRGYGRKSKAVHVLNAESRAEDAGDEPLLLFRKTGAPTAVGSSRAEAGRALLAAHPDIGLIVADDGLQHYALRRDVEIAVFPAADTGRTDLDLLPNGSLREPLLRLDSVDAVVVSGGKADALFRPSENMFHSRIEAGRIYRLNNPSEILDTGRLKNQTVVAVAGIAKPARFFDSLRNMGITVKRTVALPDHADISAADLPDADAVIITEKDAVKFSDGICTDNVWVLPVCAIIEPDLAAFVLERLEDVPKAV

SEQ ID NO: 6889 - protein, 195 aa, Neisseria meningitidis
MNIKLKTLLLPFATLALCTNAFAAPPSDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIAQHHLPEFTEELRRIICGGKNPDAGCKQAGQVGKRHQK

SEQ ID NO: 6890 - protein, 60 aa, Neisseria meningitidis
MEKKFLDILVCPVTKGRLEYHQDKQELWSRQAKLAYPIKDGIPYMLENEARALSEEELKA

SEQ ID NO: 6891 - protein, 253 aa, Neisseria meningitidis
MTEFVVLIPARLDSSRLPGKALADIHGKPMVVRVAEQAAKSKAARVVVATDHPDIQTACQAHGIEVVMTSNRHESGTTRLAEASVALKLPPHLIVVNVQGDEPLIAPELIDRTAEVLVENNVQMATAAHELHDFDELMNPNAVKVVLDKNRNAIYFSRAPIPYPRDAIRAGKREMPSETAVLRHIGIYAYRAGFLQRYAEMSVSPLETIESLEQLRVLWHGYPIAVETAKEAPAAGVDTQEDLDRVRAVFQTV

SEQ ID NO: 6892 - protein, 133 aa, Neisseria meningitidis
MQQHIEKWQHLSREEQKILAEVWGLVQNDDQEVHYEMLKLNAPDEASGEFWFRMAETLSTLPPNRSLGLRMNGGRLATAVSILSVMIEDNPDIPQLWAQKITALNYSGLNLNQYGVASPCRTICTVCGFVALS

SEQ ID NO: 6893 - protein, 38 aa, Neisseria meningitidis
MHKSILLEDVAVRNISIQEEKKCLIGYNQGKSYFISKD

SEQ ID NO: 6894 - protein, 261 aa, Neisseria meningitidis
MSRIRQAFAALDGGKALIAYITVGDPDIRTTLALMHGMVANGADILELGVPFSDPMADGPVIQRAAERALANGISLRDVLDVVRKFRETDTQTPVVLMGYLNPVHKMGYREFAQEAAKAGVDGVLTVDSPVETIDPLYRELKDNGVDCIFLIAPTTTEDRIKTIAELAGGFVYYVSLKGVTGAASLDTDEVSRKIEYLHQYIDIPIGVGFGISNAESARKIGRVADAVIVGSRIVKEIENNTGNEAAAVGALVKELKDAVR

SEQ ID NO: 6895 - protein, 290 aa, Neisseria meningitidis
MSWLDKILPPKIKNRGKDGSSNVPEGLWHKCPSCSATVYSTELQQNNQVCPKCNHHNPLSARQRLNLLLDEDGREEVAGNVKPTDPLKFKDGKKYPDRLSAARKLTGEDDALVVMKGKMNGLPVVVAAFEFRFIGGSMGSVVGERFVQGIRRAVADNCPFVCVAASGGARMQEGVNSLMQMTKTSAALHLLTEKRLPFISVLTDPTMGGVSASFAFLGDVVLAEPNALIGFAGPRVIEQTVRETLPEGFQRAEFLLEKGAIDQIVDRRDMKRRISDLITLLCRQDKVSAA

SEQ ID NO: 6896 - protein, 203 aa, Neisseria meningitidis
MRRTALLLLALAAGTSLAAGFSQKDTPINTRYRETPEEAAAREFKEHTAKLPPLPDTHSDGWFDIYVDENYGKQPKILLDSLQIMPAPDGSIRYILNIRSDKGYDNLTAKGIFCARFSIRFGNGKPSSYKVFGYGDTVNRRWIQPRNAEWKPIGGTLSRNDALRTVLYQAFCEGGVPADTKGLVQRLKERAGRYAPSIKPHNK

SEQ ID NO: 6897 - protein, 74 aa, Neisseria meningitidis
MNSETLDVTGLKCPLPILRAKKALAQMQQGDVLTVLATDGGAPGDFEAFCRQTGHVLLDASEQDGVFTLVVQHK

SEQ ID NO: 6898 - protein, 344 aa, Neisseria meningitidis
MQTLTIIRPDDMHLHLRDGDALKAVAPYTARQMGRAVIMPNLKPPVVSVADALAYKARIMAALPEGSAFEPLMTLYLTDNATPELVREAKAAGIVAFKLYPAGATTNSDSGVTDLFKLIPVLEEMAKQGILFLVHGEVTDPEIDIFDREAAFIGRVMKPVLAQVPNLKVVFEHITTAEAARLVLEAGDNVAATVTPQHLLLNRNDLLVGGVRPHHFCLPVLKRETHRQALVAAVTGEKAHKFFLGTDSAPHAKSAKENACGCAGMFSAMTAIELYAEVFEKAGALDKLEAFASKNGARFYGIPENTDTITLVKQSQTVPASVPYGDGELVPMRAGGEIGWTVQY

SEQ ID NO: 6899 - protein, 141 aa, Neisseria meningitidis; identical to SEQ ID NO: 3198

SEQ ID NO: 6900 - protein, 158 aa, Neisseria meningitidis; identical to SEQ ID NO: 3204

SEQ ID NO: 6901 - protein, 107 aa, Neisseria meningitidis
MNAFAQALSSALDRCIATNTVAKQNRPVGFLYREAPVFENDSGWRFFSGDETDEYTDDPDNFSIVSLADIAKTNPETAALLSQPEGSAWELAEDGTFQTVADWQPQD

SEQ ID NO: 6902 - protein, 239 aa, Neisseria meningitidis
MKDDVLKQQAHAAIQKKLGYAFRDISLLRQALTHRSHHAKHNERFEFVGDSILNYTVARMLFDAFPKLTEGELSRLRASLVNEGVLAEMAAEMNVGDGLYLGAGELKSGGFRRPSILADAMEAMFAAVSFDADFNTAEKVVRHLFADRVRRADFQNQAKDGKTALQEALQARRFALPKYRIEEQIGYANDSMFVISCDLGELGFVCRAKGTSRKAAEQEAAKEALKWLEEKLPLKRKKK

SEQ ID NO: 6903 - protein, 324 aa, Neisseria meningitidis
MRRRVNMPSEHMDTKANMDIETFLAGERAAGGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRFTDADRVVLKQLPKHTPVILVVNKIDKDKAKDRYALEAFVAQVRAEFEFAAAEAVSAKHGLRIANLLELIKPYLPESVPMYPEDMVTDKSARFLAMEIVREKLFRYLGEELPYAMNVEVEQFEEEDGLNRIYIAVLVDKESQKAILIGKGGERLKKISTEARLDMEKLFDTKVFLKVWVKVKSGWADDIRFLRELGL

SEQ ID NO: 6904 - protein, 208 aa, Neisseria meningitidis; identical to SEQ ID NO: 3186

SEQ ID NO: 6905 - protein, 163 aa, Neisseria meningitidis
MSTETKNYITPAGWQALKDELYQLVNKERPEIVQIVNWAAGNGDRSENGDYLYGKRRMREIDRRIRFLTKRLEAAVVVDPELREATDQVFFGATVGLLRDDGREQTVKIVGIDEIDTAQNKISWISPLARCLIKAREGDEVVLNTPEGREEIEILSVEYIKID

SEQ ID NO: 6906 - protein, 514 aa, Neisseria meningitidis
MCGVLGLVSHEPVNQLLYDGLQMLQHRGQDAAGIATAEGGTFHMHKGKGMVREVFRTRNMRDLTGNAGIAHVRYPTAGNAGSSAEAQPFYVSSPFGIVLAHNGNLTNTAELYENVCNKHLRHVNTSSDSEVLLNVFAHELRREVSKNADPHRLNADNIFNAVAQVHRLVRGAYGVIAMIAGYGMLAFRDPYGIRPLVLGSQTDSEGRKSYAVASESVAFNALTYDLERDIRPGEAVFVGFDGTMIARQCSDRAKLSPCLFEYVYFARPDSVIDGVSVYQSRLDMGVSLAEKIKRELPVDGIDVVMPIPDTSRPSAMELAVHLDKPYREGLIKNRYIGRTFIMPGQATRKKSVRQKLSPMETEFAGKSVLLVDDSIVRGTTSREIVEMVRAAGARKVYIASAAPEVRYPNVYGIDMPTREELIANGRSAAEIAAEIGADGIVFQDLGDLEAVVKALNPKIESFDSSCFNGIYQTGDIDDAYLDRLSAEKSGCGGLKIHPSRMEHSISISDAGDEE

SEQ ID NO: 6907 - protein, 165 aa, Neisseria meningitidis; identical to SEQ ID NO: 3216

SEQ ID NO: 6908 - protein, 332 aa, Neisseria meningitidis; identical to SEQ ID NO: 3536

SEQ ID NO: 6909 - protein, 424 aa, Neisseria meningitidis
MKTLQDWLSHLETAHSGGLIDMGLERTSEVKKRMKLEPQCPVVVVAGTNGKGSVCAYLTQIYKQAGYKIGTLTSPHLLRYNERIAINAEPVSDDTIIASFERIEAARGEISLTYFEFNALAAVDIFMREQVDVMILEVGLGGRLDAVNAFDGDCAVVTSVDLDHQAFLGDTVEQVGFEKAGVFRSGKPAICGQNPAPKSLLSHAEAIGAKLLMVQRDFEFHAMENIQWNYRFRPQHSDDPARNRNALPFPALRGTYQLSNAACALTVLECLNDKLPVDIGAIKRGLLLVENPGRFQVLPGRPLTVLDVGHNPHAARALRRSLINLAFAQKRTAVFSMLSDKDIDGVLETVKDQFDEWYIAPLDVPRGMTLESLQNKLHEHSIENIQTFAAVREAYRAAASKAGENDRIVVFGSFHTVADVMSVL

SEQ ID NO: 6910 - protein, 148 aa, Neisseria meningitidis
MRAFQTALRPSRILNILTVSLHAASLAVCLTWFYGRMMWFGLAALVASYAYSLRITNLKHRHAITAITIDRDGQAEIVSGKDKTAKAAALSGSSMVTPYALFLQWDTGGKTVRQCIMPDMTDKESYRKLKVWVLWRQPKKTAETDTSD

SEQ ID NO: 6911 - protein, 119 aa, Neisseria meningitidis
MYFVDRTAVVLKPTARFLEWLKSTDENMPDLTIEQLRANCSVFLVPQFDEPEAVVSYFDERYRQIFEAELAGWDIDKDKWPQDMGLKAFWEFFDIEIHDIVLNMEEAELNITPVFDNMM

SEQ ID NO: 6912 - protein, 242 aa, Neisseria meningitidis
MIKFKNVHKHFKDLHVINGVNLEIKKGEVVVVCGPSGSGKSTLIRTVNQLESIESGEIWVDGVNVADPKTDLNKIREEVGFVFQGFNLYPHLTVLENITLAPMKVKGQNAEQAEKKAMELLERVGLAHKKDAFPSQLSGGQQQRVAIARGLAMEPRVMLFDEPTSALDPEMVGEVLKVMKDLAESGMTMMCVTHEMGFAREVADRVIFVDKGQILEDETPEAFFTNPKHERAKQFLQQVMTH

SEQ ID NO: 6913 - protein, 259 aa, Neisseria meningitidis
MKEHKARKRFGQNFLQDTRIISDIVNAVRPQADDVVIEIGPGLAAITEPLAKKLNRLHVVEIDRDIVCRLKTLPFADKLVIHEGDVLQFDFNGIAGKKKIVGNLPYNISTPLLFKLAEVADDVVDMHFMLQKEVVERMVAAPKSNDYGRLGVMLQYFFDMEMLIDVPPESFDPAPKVDSAVVRMIPVKHRIGKADDFEHFAKLVKLAFHQRRKTIRNNLKELAGDDDLQAVGINPQDRAEHIAPEKYVALSNYLAGKVV

SEQ ID NO: 6914 - protein, 229 aa, Neisseria meningitidis
MLFEGLPCLAVWCKNRLSAVLPVGGLNVSENLLEIETHPFDPVLPPKAAVMMMGTFPPKEDKRAMQFHYPNFQNDMWRVYGLVFFNDAAHFQRLSEKAFDAEKIKAFLHERGIASCPTVLKAVRQHGNASDKFLKVVETVDLAAVLAKIPECRHICTTGGKATEILLDIQGGGIKMPKTGETVPFPFAGRDLTLTRLPSTSRAYPLSLAKKAAAYRAFFEMAGLCEKQL

SEQ ID NO: 6915 - protein, 400 aa, Neisseria meningitidis
MKNYHAPDEKGFFGEHGGLYVSETLIPALQELADAYKAAKNDPEFWEAFRHDLKHYVGRPSPVYHAARLSEHLGGAQIWLKREDLNHTGAHKVNNTIGQALLAKRMGKKRVIAETGAGQHGVASATVAARFGMTCDVYMGADDIQRQMPNVFRMKLLGANVVGVESGSRTLKDAMNEAMREWVARVDDTFYIIGTAAGPAPYPEMVRDFQCVIGNEAKAQMQEAIGRQPDVAVACVGGGSNAIGLFHPYIGEENVRLVGVEAGGLGVNTPDHAAPITSGAPIGVLHGFRSYLMQDENGQVLGTHSVSAGLDYPGIGPEHSHLHDIKRVEYTVAKDDEALEAFDLLCRFEGIIPALESSHAVAWAVKNAPKMGKDQVILVNLSGRGDKDINTVAKLKGIKL

SEQ ID NO: 6916 - protein, 1815 aa, Neisseria meningitidis
MKTKRFKINAISLSIFLAYALTPYSEAALVRDDVDYQIFRDFAENKGKFFVGATDLSVKNKQGQNIGNALSNVPMIDFSVADVNRRTLTVIDPQYAVSVKHVKGDEISYYGHHNGHLDVSNDENEYRSVAQNDYEPNKNWHHGNQGRLEDYNMARLNKFVTEVAPIAPTSAGGGVETYKDKNRFSEFVRVGAGTQFEYNSRYNMTELSRAYRYAIAGTPYQDVNVTSNLNQEGLIGFGDNSKHHSPEKLKEVLSQNALTNYAVLGDSGSPLFAYDKQEKRWVFLGAYDYWAGYQKNSWQEWNIYKKEFADEIKQRDNAGTIKGNGEHHWKTTGTNSHIGSTAVRLANNERDANNGQNVTFENNGTLVLDQNINQGAGGLFFKGDYTVKGINNDITWLGAGIDVADGKKVVWQVKNPNGDRLAKIGKGTLEINGTGVNQGQLKVGDGTVILNQQADADKKVQAFSQVGIVSGRGTLVLNSSNQINPDNLYFGFRGGRLDANGNDLTFEHIRNVDEGARIVNHNTGHASTITLTGKSLITDPKTISIHYIQNNDDDDAGYYYYRPRKPIPQGKDLYFKNYRYYALKSGGSVNAPMPENGQTENNDWILMGSTQEEAKKNAMNHKNNQRISGFSGFFGEENGKGHNGALNLNFNGKSAQNRFLLTGGTNLNGKISVTQGNVLLSGRPTPHARDFVNKSSARKDAHFSKNNEVVFEDDWINRTFKATEIAVNQSASFSSGRNVSDITANITATDNAKVNLGYKNGDEVCVRSDYTGYVTCNTGNLSDKALNSFGATQINGNVNLNQNAALVLGKAALWGQIQGQGNSRVSLNQHSKWHLTGDSQVHNLSLADSHIHLNNASDAQSANKYHTLKINHLSGNGHFHYLTHLAKNLGDKVLVKESASGHYQLHVQDKTGEPNQEGLNLFDASSVQDRSRLSVSLANNHVDLGALRYTIKTENGITRLYNPYAENRRRVKPAPSPATNTASQAQKATQTDGAQIAKPQNIVVAPPSPQANQAEEAKRQQAKAEQVKRQQAEAERKSAELAKQKAEAEREARELATRQKAEQERSSAELARRHEKEREAAELSAKQKVEAEREAQALAVRRKAEAEEAKRQAAELARRHEKEREAAELSAKQRVGEEERRQTAQSQPQRRKRRAAPQDYMAASQDRPKRRGHRSVQQNNVEIAQAQAELARRQQEERKAAELLAKQRAEAEREAQALAARRKAEAEEAKRQAAELAHRQEAERKAAELSANQKAAAEAQALAARQQKALARQQEEARKAAELAVKQKAETERKTAELAKQRAAAEAAKRQQEARQTAELARRQEAERQAAELSAKQKAETDREAAESAKRKAEEEEHRQAAQSQPQRRKRRAAPQDYMAASQNRPKRRGRRSTLPAPPSPSFDSSAYAAPRALHNPDWYENDYEEIPLDALEDENVSESVDTSDKQPQDNTELHEKYENDYEEIPLDALEDEDVSESVDTSDKQPQDNTELHEKVETVSLQPRAAQPRAQAATQLQAQAAAQADAVSTNTNSALSDAMASTQSILLDTGASLTRHIAQKSRADAEKNSVWMSNTGYGRDYASAQYRRFSSKRTQTQIGIDRSLSENMQIGGVLTYSDSQHTFDQASGKNTFVQANLYGKYYLNDAWYVAGDIGAGSLRSRLQTQQKANFNRASIQTGLTLGNTLKINQFEIVPSAGIRYSRLSSADYKLGNDSVKVSSMSVKTLTAGLDFAYRFKVGNLTVKPLLSAAYFANYGKGGVNVGGNSFVYKADNQQQYSAGAALLYRNVTLNVNGSITKGKQLEKQKSGQIKIQIRF

SEQ ID NO: 6917 - protein, 84 aa, Neisseria meningitidis
MTNPSVRKPAPRHSHEPPSRHYHESGNLGLRVKKTYIPSFPQKQKTKIRNLKSRHSRKSGNPKTKSRRNLTEEPNPENRLPAFA

SEQ ID NO: 6918 - protein, 691 aa, Neisseria meningitidis
MLCVLAGAAYGVFRTEAALSSQWRAEAVSGVPLTVEVADMPRSDGRRVQFAAKAVDSGGRTFDLLLSDYKRREWAVGSRWRITARVHPVVGELNLRGLNREAWALSNGIGGAGTVGADRVLLHGGSGWGIAVWRSRISRNWQQADADGGLSDGIGLMRALSVGEQSALRPELWQAFRPLGLTHLVSISGLHVTMVAVMFAWLAKRLLACSPRLPARPRVWVLAAGCAGALFYALLAGFSVPTQRSVLMLAAFAWAWRRGRLSAWATWWQALAAVLLFDPLAVLGVGTWLSFGLVAALIWACSGRLHEGKRQTAVRGQWAASVLSLVLLGYLFASLPLISPLVNAVAIPWFSWVLTPLALLGSVVPFAPLQQLGAFLAEYTLRFLVWLADVSPEFAVAAAPLPLLVLAVCAALLLLLPRGLGLRPWAVLLLAGFVFYRSPGVPENEVAVTVWDAGQGLSVSVQTANHHLLFDTGTASAAQTGIVPSLNAAGVRRLDKLVLSHHDSDHDGGFRAVRNIPAGGIYAGQPEFYEGARHCAEQRWQWDGVDFEFLRPSERKNIDDNGKSCVLRVVAGGAALLVTGDLDTKGEESLVGKYGGNLYSQVLVLGHHGSNTSSSGVFLNAVSPEYAVASSGYANAYKHPTEAVQNRVRAHGIKLLRTDLSGALQFGLGRGGVKAQRLRGYKFYWQKKPFE

SEQ ID NO: 6919 - protein, 267 aa, Neisseria meningitidis
MKKILLTVSLGLALSACATQGTVDKDAQITQDWSVEKLYAEAQDELNSSNYTRAVKLYEILESRFPTSRHAQQSQLDTAYAYYKDDEKDKALAAIDRFRRLHPQHPNMDYALYLRGLVLFNEDQSFLNKLASQDWSDRDPKANREAYQAFAELVQRFPNSKYAADATARMVKLVDALGGNEMSVARYYMKRGAYIAAANRAQKIIGSYQNTRYVEESLAILELAYKKLDKPRLAADTRRVLETNFPKSPFLKQPWRSDDMPWWRYWH

SEQ ID NO: 6920 - protein, 374 aa, Neisseria meningitidis
MQNTSFDNESDYSDDSDFASASETENRIGLTVPLELAGGRLDAVLAKLLPDYSRSRLTSWIKEGAVIVNDKPSQPKDKMIGGEQICVTVRPSEENLAFVPEPMALDIVYEDDTVIVVNKPAGLVVHPAAGNWTGTLLNGLLAHCPELSQVPRAGIVHRLDKETSGLMVVAKTLPAQNSLVRQLQERTVKRIYRAVANGIVPFDGKIETQIGRDPHNRLKMAVVKFGGKPAVTHVKVLERYLTHSYIECSLETGRTHQIRVHMREANHPLAADPVYGNPRHPCGDTVKEAVKSLGARQALHAYRLSFTHPESGETVSFEAPIPNDIYHLLSVLRLEAGLDSSLSNEEEWQDKFGADDDDDWNEDDYDVEVVYVRE

SEQ ID NO: 6921 - protein, 315 aa, Neisseria meningitidis
MNILSKISSFIGKTFSLWAALFAAAAFFAPDTFKWAGPYIPWLLGIIMFGMGLTLKPSDFDILFKHPKVVIIGVIAQFAIMPATAWLLSKLLNLPAEIAVGVILVGCCPGGTASNVMTYLARGNVALSVAVTSVSTLISPLLTPAIFLMLAGEMLEIQAAGMLMSIVKMVLLPIVLGLIVHKVLGSKTEKLTDALPLVSVAAIVLIIGAVVGASKGKIMESGLLIFAVVVLHNGIGYLLGFFAAKWTGLPYDAQKTLTIEVGMQNSGLAAALAAAHFAAAPVVAVPGALFSVWHNISGSLLATYWAAKAGKHKKP

SEQ ID NO: 6922 - protein, 259 aa, Neisseria meningitidis
MKTITETLNLAPKGKNFLTADWPAPANVKTLITTRNGGVSQGAYQSLNLGTHVGDNPEAVRRNREIVQQQVGLPVAYLNQIHSTVVVNAAEALGGTPDADASVDDTGKVACAVMTADCLPVLFCDRAGTAVAAAHAGWRGLAGGVLQNTIAAMKVPPVEMMAYLGPAISADAFEVGQDVFDAFCTPMPEAATAFEGIGSGKFLADLYALARLILKREGVGGVYGGTHCTVLERDTFFSYRRDGATGRMASLIWLDGNAV

SEQ ID NO: 6923 - protein, 159 aa, Neisseria meningitidis; identical to SEQ ID NO: 2622

SEQ ID NO: 6924 - protein, 332 aa, Neisseria meningitidis
MAAHIGRIDTDAPLKPLYVIHGEEELLRIEALDALRAAAKKQGYLNREVYTADNAFDWNELLQTAGSAGLFADLKLLELHIPNGKPGKTGGEALQDFAARLPEDTVTLVLLPKLEKTQLQSKWFAALAAKGEVWEAKPVGAAALPQWIRGRLDKIGLGIEADALALFAERVEGNLLAARQEIDKLGLLYPKGHTVNIDEAQTAVANVARFDAFQLAGAWMKGDVLRVCRLLDGLREEGEEPVLLLWAVAEDVRTLIRLAAALKQGQSIQSVRNSLRLWGDKQTLAPLAVKRISVVRLLDALKTCAQIDRIIKGAEDGDAWTVFKRLVVSLAE

SEQ ID NO: 6925 - protein, 139 aa, Neisseria meningitidis; identical to SEQ ID NO: 2614

SEQ ID NO: 6926 - protein, 188 aa, Neisseria meningitidis
MPSEACWRFRRHILIEKMMTLKTAPLKRRFAAMLYEMLLVGAATCLAALIAGIAAIFLNPVSIAVSALVTSILIMGAWWLYFRANWHGQGQTLAMRTWKIGLCDLNGIQPSLHLLRLRFIWACIFIVFIPMLAYAGLRHFLGIPPKGAAGAALIWLILPWGFALLNPDRQFLYDFLAGTRLVAVKGKP

SEQ ID NO: 6927 - protein, 294 aa, Neisseria meningitidis
MSSGNIHIHSMTGFANAAAECGSKRINLDLRAVNHRFLDIQIRMPDDLRYLESGIREKISSHIARGKVECKIQIQDAENGSQSLELNRDLVGQLAEINKDLRKHHDLAKLGVADILRFPGVLASQRENTEELAKSITELTEKALKDFTAARKREGKKLGEHLLQRLEAMEEIIDALSELFPTLLETHKEKIRARLVEAVGSIDNDRLQQEFALFIQKSDIDEEFSRLRTHIAEVRRIVTEHKGSSGKRLDFLMQELNREANTLGSKSIAAECTQASVELKVLIEQMREQVQNIE

SEQ ID NO: 6928 - protein, 290 aa, Neisseria meningitidis
MSQMNNAFALPAIQSGNGSLEQYIHTVNRIPMLTQEEETRLAERQHKGDLNAAKQLILSHLRVVVSIARGYDGYGLNQADLIQEGNIGLMKAVKRYEPGRGARLFSFAVHWIKAEIHEFILRNWRLVRVATTKPQRKLFFNLRSMRKNLNALSPKEAQDIADDLGVKLSEVLEMEQRMTGHDIAIMADNSDDEDSFAPIDWLADHDSEPSRQLSKQAHYALQTEGLQNALAQLDDRSRRIVESRWLQDDGGLTLHQLAAEYGVSAERIRQIEAKAMQKLRGFLTEEAEAV

SEQ ID NO: 6929 - protein, 524 aa, Neisseria meningitidis
MFRRYLPNRQMNMVSKLDKYWQHPALYWPLLILFAAATPFTFAPYYHFWLMPLIFGAFVRLIELRPRFAVSSAYLFGLTAYTTQFYWIHTALHDVSGLPDLYAVPLTFLLPAYLALYPALCFWLWKKFTLPRGIKIGLVLPILWTLTEFARERFLTGFGWGAIGYSQITPDSPLAGFAPLGGIHMVTLATAFLGVWLVLASNNTARSGKRLLPIILIAALLAAGYTARQTDFTRPDGSRSTVALLQGNIDQTLKWREDQVIPTIQKYYEQVGKTTADIVILPETAIPVMRQNLPENILAKFAEQAQNNGSALAVGISQYTSDGNGYENAVINLTGYQENNQDGIPYYAKNHLVPFGEYKPLPFLTTPLYKMMDMPLSDFRKGGGKQSALLMKNQKIAFNICYEDGFGDELIAAAKDATLLANASNMAWYGKSNAMYQHLQQSQARAMELGRYMVRATNTGATAIISPKGNIIAQAQPDTETVLEGHIKGYVGETPYMKTGSSWWLMGILALAALILFIFRNKEH

SEQ ID NO: 6930 - protein, 251 aa, Neisseria meningitidis
MAFASLFTLPDDITAVLDDVALMTKAAAKKTAGVVGDDLAPNANRVTGVSAERELPIVWSMAKGSFSNKPVLVPAALLLSAFLPQLITPLLTAGGIYLCFEGVEKLLHKFLHRHDAHARNGGNRHRHDCFGVRNRCRHRQTRRLRHAADAPPTNLFAQFGANADCLYALLYARFERGRHACHVSYRRRTGRPQPRPSARFPARATLGRWLGGVLRQPRCRAAFRFDCLRPRLAADESFRQALIPFSNTDAV

SEQ ID NO: 6931 - protein, 106 aa, Neisseria meningitidis
MDWMGSLFLPGGALLFLSVVSTTLSARLGMPLLLVSPANVLDRAAEALAIAAFLMLVARPSAVFGGLWKFNYSLREKAYSRIEMQSDTVLQAGIWRGTSCPTARSI

SEQ ID NO: 6932 - protein, 96 aa, Neisseria meningitidis
MAKYFTETGISVREHFDFFGEFVVSPAARSGDLALTYGLRLEAGEEGLSLAELFDKRSDSQEPVEGGRIDIGGFMLTAKEVDGGGNIGSMGLKVLR

SEQ ID NO: 6933 - protein, 138 aa, Neisseria meningitidis
MKETPMNTTRLPTALVLGCFCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKSKKN

SEQ ID NO: 6934 - protein, 360 aa, Neisseria meningitidis
MPSEAASDGILPLYPTRTIFQKPIMLPFFPEPSLSYTQQNRTAVLLLNLGTPDAPTAQAVRPYLKSFLTDRRVVELPKWLWYPILHGLVLTLRPKKSAHAYEKIWFKEGSPLEVYTARQAAALAKRMPDLIVRHAMTYGNPSVADVLSELKAQGAGRLLVIPMYPQYAASSSGAAVDKVCEQLLLQRNQMSVRTVSRFYDDTGYIDAMKNHILRYWAEHGRGKKLMLSFHGVPQKHHDLGDPYPDECRHTAKLLAEALELTEDQYVVSFQSQFGRAKWVTPSTQDLFGKLPKQGVTELDVFCPGFLADCLETMEEIALMGREQFYEAGGKSYRYIPCLNDNPDWIDALVALAEENLGSWR

SEQ ID NO: 6935 - protein, 371 aa, Neisseria meningitidis
MLKFTLHKKDGLARRGTLELNHGKIETPVFMPVGTYGSVKAMNPQNLHDIKAQIILGNTYHLWLRPGLEVIGQFGGLHGFIGWDKPILTDSGGFQVFSLSDMRKLTEEGCTFKSPINGDKLFLSPEISMKIQTVLNSDIAMQLDECTPGEATREQARKSLQMSLRWAERSKKAFEDLKNPNALFGIVQGAMYEDLREESLRGLEQFDFPGLAVGGLSVGEPKPEMYRMLRAVGPILPEHKPHYLMGVGTPEDLVYGVAHGIDMFDCVMPTRNARNGWLFTRFGDLKIKNAKHKLDKRPIDESCTCYACQNFSRAYLHHLHRTGEILGAQLNTIHNLHFYQVIMAEMREAVEQGKFADWQARFHENRARGTD

SEQ ID NO: 6936 - protein, 637 aa, Neisseria meningitidis
MLNITLPDGSVRQYESPVTVAQIAASIGAGLAKATVAGRVNGKLVDACDPIVEDSAVQIITPKDQEGIEIIRHSCAHLVGHAVKQLYPNAKMVIGPVIEEGFYYDIATEKPFTPEDVAAIEARMKELIAQDYDVVKIMTPRAEAIKIFQERGEEYKLRLIDDMPEVEAMGMYHHQEYVDMCRGPHVPNTRFLKNFKLTKLAGAYWRGDSNNEMLQRIYGTAWATKDELKAYIQRIEEAEKRDHRKLGKQLDLFHLQDEAPGMVFWHPKGWALWQVIEQHMRKELNAAGYKEVKTPQIMDKTFWEKSGHWDNYKDNMFVTSSEKREYAVKPMNCPGHVQIFNNGLRSYRDLPMRLAEFGSCHRNEPSGALHGLMRVRGFVQDDAHIFCTEDQIVSEARAFNELLIRIYKQFGFHDVSVKLSLRPEKRAGSDDVWDKAEQGLREALTACGVEWGELPGEGAFYGPKIEYHVRDALGRSWQCGTLQLDFVLPERLNAEYVTENNDRARPVMLHRAILGSLERFIGILIENHAGSFPLWLAPVQLVIMNITENQADYCREVAAKLQAAGFRAELDLRNEKIGYKIRDNSQYRFPYQIVVGDKEKQENKVAVRRKAEDLGSLDLDDFIAQLQQEITDALVNH

SEQ ID NO: 6937 - protein, 155 aa, Neisseria meningitidis
MRLISESGEQLGVVSVREALAMAEGQDVDLVEISPTAKPPVCKLMDYGKYKYQQAKKRDEAKKNQKQVQIKEIKFRPGTDEGDYQIKMRNINRFLADGDKVKVTLRFRGREMAHQQLGAQLLERVKEDLAEVAQIESFPKMEGRQMVMMIAPKKK

SEQ ID NO: 6938 - protein, 65 aa, Neisseria meningitidis
MPKMKTKSSAKKRFKVLGNGGVKRAHAFKRHILTKKTTKNKRQLRGTSMVNDRDLASVAKMLPYA

SEQ ID NO: 6939 - protein, 119 aa, Neisseria meningitidis
MPRVKRGVTARARHQKIFALAKGYRGRRKNVYRVAKQAVMKAGQYAYRDRRQRKRQFRQLWIVRINAGTRENGLSYSKFMNGLKRASIEIDRKVLADLAVFDKAAFAQLVEKAKAALAA

SEQ ID NO: 6940 - protein, 330 aa, Neisseria meningitidis
MENVNRIVAEGIAAVEAAQDFNALEQIKARYLGKTGELTGLLKTLGQMSPEERKTIGAHINECKNRFQTAFNAKREALNEVKLQARLAAEALDITLPGRAQEGGSLHPVTLTLQRVVELFHGMGFEVADGPEIEDDFHNFQALNIPANHPARAMQDTFYVENGDVLRTHTSPIQIRYMLDKKEPPIRIIAPGRVYRVDSDATHSPMFHQAEGLWVEEGVTFADLKAVFTDFIRRFFERDDLQVRFRPSFFPFTEPSAEIDIMGENGKWLEVGGCGMVHPNVLKNVNIDPEKYTGFAFGIGLDRFAMLRYNVNDLRLFFDNDLNFLKQFAK

SEQ ID NO: 6941 - protein, 352 aa, Neisseria meningitidis
MMIGASLFSSAGIAETYLHNAGIKIIAANELVPERANLYKALYPESKMIIGDILHEEVFQNLIQSVPNRLDFLIASPPCQGMSVAGKNRNIQEMANDKRNHLIFRVIEFILLKRPTFVLIENVPFFLKIKLPYKGTLQTVEVILQDLFGCEYYIQTHIFDSADYGVAQHRKRAIIRMNKHSTIWGMPEKVTKTISVRDAISFLPSIESGQKSNVKWHFARTHAPEHIIWLKNTPTGRSAFDNIEHYPKKKNGEKIKSYNTTYRRMEWDAPAPTITIRNDAISSQLNVHPGRSMPDGTYSDARVLTPLELMLLTSLPIDWNIPDDTSELLIRQCIGESIPPLLIKKIVERIGK

SEQ ID NO: 6942 - protein, 489 aa, Neisseria meningitidis
MTTARWVIDKHLQNFHILCKFAGILKTNSFISVEDKAKLSEKLEKLDLYHRRNTGKSLDATTHKIKELSFYMFGYRDVCGQVTQKFLFSPLGNLFLKHLDNNEYIQKIFLTMLWAIPFPHPYIKTDESIQLYPMRLIFKLLSDERLDCKLFSYEYIYLISFVKSADQNSYEKLVQDILVLRTCAEVKIKHQLTAENSRSHAYVNAAHEWESYFSKTLTDAGVLQKTDGKIICRLKHGKTETYRKVTSSEFSIPKQLQEFVKKLQSAYSFSEMPLNLNDSDRLKIDVIKEIYSFYPKELLEEIGELKDEAAYELLHLPRLIEQYADNNNGTEAYLFEDVLEMGFNMFYNVEAKKIGGPGNTDLECLYITQKRKFAVEAKSTKNKLSGINSGRLEDHKNKIKAIYTIVVTPRYVPAVLSDIRNCPIVIIRANTFAEFLYNCLINRSSIPEIDYRYFDEIIIKNLGKDISSEISNLTMQQFASNTTMEAYST

SEQ ID NO: 6943 - protein, 216 aa, Neisseria meningitidis
MITISNEDNMILMSRYPDKYFDLAIVDPPYGILNKTKRGGDYKFNMNEYSQWDIKPDQTYFNELFRVSKNQIIWGGNYFGELWLRSEYNKGFIIWDKNQPETLNNFSMAEMAWSSFDRPSKIFRFSVRKNRNKTHPTQKPVELYQWLLKMYAKQGDKILDTHLGSGTLAIACCIAQFDLTACEINSDYYQQSIEKIKNNLPEARISFGHPGYCIIE

SEQ ID NO: 6944 - protein, 787 aa, Neisseria meningitidis
MQFSYSWLKTQADTELSSDKLEHLLTMSGLEVEEAETAAPAFAGVVIAEVKSVEKHPDADRLNVTRVDAGTGGLVQIVCGAPNVKAGIKVPCSLPGAVLPGNFKIKPTKMRGEVSDGMLCSTDELGLPDDGVNGLHILPEDAPVGTNIREYLDLDDTLFTLKITPNRADCLSIKGIAREVSALTGCAFRQPEIHTAPITGSRKQPVQINAPADCGRFISRVIENVNARATTPDWMKQRLERSGIRSISALVDIGNYVMLEIGQPMHVFDADKLSGSLHIRRAREGETLECLNEKTVSLSENTLVVADEKGVLSLAGLMGGAASAVSDGTQNIVLEAAWFAPEIIAGKSRQYGFGSDSSFRFERGVDYRLQADAIERATELVLQICGGAAGEMVEAQGELPEAKQVGLRLDRLKTVLGVDIPAEQVETILQHLGLQPEKTAEGFRVTAPSFRFDIEIEADLIEEIGRVYGYENIPDDYTSGRLKMLELPETRRPRFAVYNEMAARGYREVVSYAFVDEQWEQDFAANADPIRLQNPLAAQYAVMRSTLIGGLVEILQNNLNRKQNRVCVFEIARVFSKGSDGQFVQNERIGGLWYGAVMPEQWGGKTRNADFYDIKADVENLLKNKAVEFVKTGHPALHPGRAANIVSDGKVIGFVGELHPKWLQKYDLPQAPLVFEIDMAAVLECGKTRYRVVSKFQPVRRDLAFVMPEAMSHDDLLLVLKGAANKLVQEISVFDVYRGTGLPEGMKSVAVKVILQDMENTLTDEAVEPLIGKLIGAATAAGARLRS

SEQ ID NO: 6945 - protein, 100 aa, Neisseria meningitidis
MTLTKAELADILVDKVSNVTKNDAKEIVELFFEEIRSTLASGEEIKISGFGNFQLRDKPQRPGRNPKTGEEVPITARRVVTFHASQKLKSMVEHYYDKQR

SEQ ID NO: 6946 - protein, 161 aa, Neisseria meningitidis; identical to SEQ ID NO: 280

SEQ ID NO: 6947 - protein, 75 aa, Neisseria meningitidis
MNVWYIWDRMVEIYHKYKKPCLVLAVDFVMGMVFIEPNEEPCIGRCYAPMSESPDFANAVAMAVAMICIVWIAVL

SEQ ID NO: 6948 - protein, 433 aa, Neisseria meningitidis
MPSEHQHISSLLDFDRTHLLHPYTSMTDPLPVYPVKRAEGVFIELADGTRLIDGMSSWWCAIHGYNHPVLNQAVETQMKQMAHVMFGGLTHEPAVELGKLLVGILPQGLNRIFYADSGSISVEVALKMAVQYQQARGLTAKQNIATVRRGYHGDTWNAMSVCDPETGMHHIFGSALPQRYFVDNPKSRFDDEWDGADLQPVRALFEVHHADIAAFILEPVVQGAGGMYFYHPQYLRGLHDLCDEFDIMLIFDEIATGFGRTGKMFACEHAEVVPDIMCIGKGLSGGYMTLAAAITSQKVTETISRGEAGVFMHGPTFMANPLACAVACASVKLLLSQDWQANIRRIESILKGRLKAAWDIRGVKDVRVLGAIGVIELEKGVDMARFQADCVAQGIWVRPFGRLVYLMPPYIISDGVLTKLADKTVQILKEHSK

SEQ ID NO: 6949 - protein, 215 aa, Neisseria meningitidis
MKGVYFVSGIDTDIGKTVATGVLAKQLLQQGKSVITQKPVQTGCQNIADDIAVHRKIMGIPMQEADKRRLTMPEIFSYPASPHLAARLDGRALDLDKIRTATQELAAQYEVVLVEGAGGLMVPLTENLLTIDYIRQQGYPVILVTSGRLGSINHTLLSFAALKQYGIRLHSLVFNHIHDSRDAHIAQDSLSYLKCRLKADFSEAEWMELAKTDAV

SEQ ID NO: 6950 - protein, 158 aa, Neisseria meningitidis
MEHLFGKWLPDLPAAISDGISLPMVRLLHTRSLTAALRALPHTFSVELLKLGELETECGGRLVREVLLKLDRIPVVEARSECRIGSAFWQNILDCGTRPLGERLFQADLEGARSAFEFAVAGEGCGRYFAARRSRFSRHGEEMLLTEYFLPELKRFIG

SEQ ID NO: 6951 - protein, 296 aa, Neisseria meningitidis
MNPKSPLFLRLSDRLDVYLRLMRADKPIGTLLLLWPTYWALWLASDGIPDLAVLAAFTIGTFLMRSAGCVINDFADRDFDGAVERTKNRPFAQGRVKKKEALLLTAFLCLLAALCLIPLNHLTWLMSLPALFLALTYPFTKRFFPIPQLYLGLAFSFGIPMAFAAVAGNVPPQAWILFAANVLWTLAYDTVYAMADKEDDLKIGIKTSAVTFGRYDIAAVMLCHGGFTLLMAVLGAVIGAAWAYWTAIPIVLLLQYRQYAAIKSRVRQICFETFLANNRIGWVWFTAIFAHTFFAK

SEQ ID NO: 6952 - protein, 149 aa, Neisseria meningitidis
MSLIGEILPLSHIVLDMEVGSKKRLFEEAGLLLERESSLSHADVFECLFAREKLGSTGLGQGVAIPHGRHAGVKQATGAFIRTREPVGFDAPDGKPVSLIFILLVPENATGEHLEVLSKLAGKFSQKSIRESLMTVSSAEEVRAILTEE

SEQ ID NO: 6953 - protein, 320 aa, Neisseria meningitidis
MPSISVRRLFDDNQYKLQLAWAAGNSGADNRIGVEADKPVLALVGHLNFIHPNQIQVVGLAESEYLNRLESGETGYQFGDLFDISMSLVIVANGLPVSPGLRDYCHKNDIPLLTSKLESPYLMDVLRIYLQRTLAASSVKHGVFLDVFEIGVLITGHSGLGKSELALELISRGHSLIADDAVELFRIGPETLEGRCSPMLRDFLEVRGLGILNIRHIFGETSIRPKKILQLIINLVEADDEYMKQLDRLSIRTETESILNVNVRSVTLPVAVGRNLAVLVEAAVRNYILQLRGKDSTREFLERHQTQLKENEQHNEDRPD

SEQ ID NO: 6954 - protein, 284 aa, Neisseria meningitidis
MKIVLISGLSGSGKSVALRQMEDSGYFCVDNLPLEMLPALVSYHIERADETELAVSVDVRSGIDIGQAREQIASLRRLGHRVEVLFVEAEESVLVRRFSETRRGHPLSNQDMTLLESLKKEREWLFPLKEIAYCIDTSKMNAQQLRHAVRQWLKVERTGLLVILESFGFKYGVPNNADFMFDMRSLPNPYYDPELRPYTGMDKPVWDYLDGQPLVQEMVDDIERFVTHWLPRLEDESRSYVTVAIGCTGGQHRSVYIVEKLARRLKGRYELLIRHRQAQNLSDR

SEQ ID NO: 6955 - protein, 505 aa, Neisseria meningitidis
MAIQWFPGHMNKAKKAIAERAKSVDMVIEMLDARMPASSENPLLAQLSKGKPKLKILNKQDLADPERTKIWLEHYNSRPDTCAIALDSSETGAHGKITQACRAMIPHRQGIDKPLRVLICGIPNVGKSTLINGMIGKKSAKTGNEPGITKAEQRLFLADDFWLYDTPGMLWPKIIVEEGGYNLAAGGAVGRNALDEEEVALELLDYLRRHYLPMLQERYQADKDPSSHWDENVWLEWIAKKRGAVLSGGRINYQKAAENILTDFREGKIGRITLETPNQWETWLKKARQKEAELKAIREARKAERKGQKLRKHKECRLKNIFQAASLYSNRFQTAYPNPCRFSTDTRMTDKISPDALIEAALLTQTEPLTEKSMRELCVPPLSQDKLIDVLAQLKTRWQDRALQLVHTQEGWRFQIVQTAFERLGSLQEQRAPRYSRAVMETLAIIAYQQPVTRGDIEGIRGVAVSQNVMQTCRIGGGLKSSDIGTHWENPHCGRQRQRSSAIWV

SEQ ID NO: 6956 - protein, 557 aa, Neisseria meningitidis
MLLTLSLRDFVIVENLNLDFQSGFTVLTGETGAGKSITLDAIGLLLGDKADYSQVRSGAKEAQLSALFDISHLPVLKAELYEQGLLNDGEEELSIRRIIDAKGKSRSFINNQAATLAQLKAVGSQLIDIHGQNAHHSLNQEAAQRELLDAFAGSREQAETVRQLYQNWANAKKALQEAQEHADAVIIERERLEWQFNELNQLDIKQGEWEALSQSHDSLAHSAELLQAAEEVGSKIDGDNGIQRHIYQCQKLLANLQNIEPRFAESLNMLASIEAELGEISANMRDVAGRSDINPNELAAQEQRMGELMGMARKYRIEPEELPAKLAEIEERLQSLQAAADLDALEHNVAHNFAEYQEAAHILSAMRHQAAERLSGETTEHMQHLAMKGARFDIVLLPSSPTAHGLEQVQFQVAANKGNPPRLLNKVASGGELARISLALQVVASQYTQVPTLIFDEVDTGIGGGVAEMVGKALRALGRKHQVLAVTHLPQVASCGENHWRVRKHSEGEQTVSEISILDEIQRIEEVARMLGGEVITDTTRQHAAELLQLASKNSLF

SEQ ID NO: 6957 - protein, 479 aa, Neisseria meningitidis
MQCLQFDSINLIEHILPDVRFWLVPPSRTHHLHEHFHHISWQTEAIPQTESKPDKPWFALPQTSERQKPEHILVIGAGISGAATAHALASHGISVTVLEARKAAQAASGNRQGLLYAKISPHDTEQTELLLAGYGYTKRLLGHILPESETWGGNGIIHLNYSRTEQQRNHELGLQKHHNHLYRSITSAEAEKIAGIPLSVPYDHPSCGLYWQHGVWLNPPAFVRTLLNHPLIGLHEDTPLTDISHDGEKWIASTPNGTFTATHIIYCTGANSPYLPETNLAALPLRQIRGQTGLTPSTPFSEQLRCAVSGESYISPSWHGLHCYGASFIPNSSHTGWNEAEEASNRQALAHLNPALSESLFAANPNPQKHQGHAAIRCDSPDHLPLVGALGDIAAMRQTYTKLALDKNYRIDTPCPYLPNAYVNTAHGTRGLATAPICAAAIAAQILGLPHPFSQRLRHALHPNRTIIRAIVRRKDLTP

SEQ ID NO: 6958 - protein, 119 aa, Neisseria meningitidis
MNNIPVEIRLLKNRTVLVLTYGDEPKNLPAEFLRVYSPSAEVRGHGVGQDVLQTGKADVQIADLQPVGQYALKISFSDGHDSGLYDWAYLHRLAYGYDAMWQEYLDKLAAAGASRFEEK

SEQ ID NO: 6959 - protein, 245 aa, Neisseria meningitidis
MGGQKTHFGFSTVNEDEKAGKVAEVFHSVAKNYDIMNDVMSAGLHRVWKHFTINTAHLKKGDKVLDIAGGTGDLSRGWAKRVGKEGEVWLTDINSSMLTVGRDRLLNEGMILPVSLADAEKLPFPDNYFNLVSVAFGLRNMTHKDAALKEMYRVLKPGGTLLVLEFSKIYKPLEGAYDFYSFKLLPVMGRLIAKDAESYQYLAESIRMHPDQETLKQMMLDAGFDSVDYHNMSAGIVALHKGVKF

SEQ ID NO: 6960 - protein, 159 aa, Neisseria meningitidis
MPESIFKQISLDILKLHRDSVYSLLATSGCNCQVHEAAYVNIDGKYYIALSCEPEVGEVKTGILLIEDESRNLRLSWVGSARELDCKDNAYKRALSALSRKLGRCKDRLHTAVQPFLLELVPEKGRFSVGDEEVWISRNDLVRALYPVGYSMRQAVFQI

SEQ ID NO: 6961 - protein, 164 aa, Neisseria meningitidis
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLDLDIIDFDGISSDDTRLTLPHPRAHERSFVIRPLAEILPDFVLGKHGKVAELSKRLGNQGIRLLPDR

SEQ ID NO: 6962 - protein, 124 aa, Neisseria meningitidis
MQYLIVKYSHQIFVTITILVFNIRFFLLWKNPEKPLAGFWKALPHLNDTMLLFTGLWLMKITHFSPFNAPWLGTKILLLLAYIALGMMMMRARPRSTKFYTVYLLAMCCVACIVYLAKTKVLPF

SEQ ID NO: 6963 - protein, 188 aa, Neisseria meningitidis
MLLQNILPFAHCLLRKALPEGGNALDGTAGNGHDTLFLAQTAGIRGKVWAFDIQPQALNNTRCRLQEAGYSNVRLILDGHENLKQYIPKPLDAAIFNFGWLPGGDKSLTTRTETSIAALSATLSLLKENGMLIAVLYPGHENGKQEAEAIEQWAKNLPQEQFAVLRYGFTNRKNSPPYLLVFEKLRQK

SEQ ID NO: 6964 - protein, 97 aa, Neisseria meningitidis
MTAKGQMLQDPFLNALRKEHVPVSIYLVNGIKLQGQVESFDQYVVLLRNTSVTQMVYKHAISTIVPARSVNLQHENRPQAAPTSTLVQVETVQQPAE

SEQ ID NO: 6965 - protein, 312 aa, Neisseria meningitidis
MSIHTLKRLPSSLLLGLCLSLPSAHLFADNDILGQFLEQNMLTSSDPIEIFAESTIHPTNTQAITGGLILSSQSALVVNNKTGQILYQKNADRIMPIASISKLMSAMVVLDANLDMNETVTITPDEIDRIKGTGSRLAIGTALTRKKLLHLSLMSSENRATHALGRTYPGGMGAFVAAMNRKAQSLGMYGSRFYEPTGLNFQNVSTAKDLSLMVNAAAQYPQIRTNSTSNYASVQTKNGQQNYKNSNALVREGMWNIELQKTGYIREAGRSMVVKANIQNQPVTIVLLNSPTSATRVNDARKIESWMLQQRS

SEQ ID NO: 6966 - protein, 146 aa, Neisseria meningitidis
MDVKYEFTLPSSSGADFHSAEHLPLVVYFYPKDSTLGCTTEGLDFNARLEQFEALGYTVVGISRDGVKAHQNFCAKQGFRFELLSDKDETVCRLFDVIKLKKLYGKESLGIERSTFVLNKDGEIAHEWRKVKVAGHAQEVLETLSR

SEQ ID NO: 6967 - protein, 291 aa, Neisseria meningitidis
MEEGLIDRLLETLWLDRRLSQNTLNGYRRDLEKIARRLSQSGRMLKDADEADLAAAVYVDGEQRSSQARALSACKRLYIWMEREGIRTDNPTRLLKPPKIDKNIPTLITEQQISRLLAAPDTDTPHGLRDKALLELMYATGLRVSEAVGLNFGNVDLDRGCITALGKGDKQRMVPMGQESAYWVERYYTEARPLLLKGRNCDALFVSQKKTGISRQLAWMIVKEYASQAGIGHISPHSLRHAFATHLVRHGLDLRVVQDMLGHADLNTTQIYTHVANVWLQGVVKEHHSRN

SEQ ID NO: 6968 - protein, 66 aa, Neisseria meningitidis
MFVCICNAVTDHQIKETIAAGATTMGDLQSQLGVASCCGCCGELAASFLTAHNAQPTVTAGINVQA

SEQ ID NO: 6969 - protein, 77 aa, Neisseria meningitidis
MKLTLMFREYCSLCHKMRDELKPFQDEYGFGLEVVDVDENPVLEEKYNELVPVLLAGDEEICHWFLDEDRLKQFLER

SEQ ID NO: 6970 - protein, 36 aa, Neisseria meningitidis
MPSEAGLQAAFFSNQRSLRFCGADDLPVKEARLDAW

SEQ ID NO: 6971 - protein, 47 aa, Neisseria meningitidis
MLHINPFFILFVGWEDSYLLIFSIKIRKFIVRCYCWQSYHVLLLMEA

SEQ ID NO: 6972 - protein, 306 aa, Neisseria meningitidis
MRILLTGSKSQLARCLRDRLPEDWETIATDSASLDITDADAVCNMVKSFQPDAIVNTAAYTAVDKAEGDAAAAFAVNASAVYNLALAAHRAHARFIHISTDYVFDGKGKRPYQESDFTNPSNVYGQSKTAGELLALSANPDSLILRTSWLFSEYGDNFIRTMLNLARERSPLSAVHNQIGCPTYAGDLSATIIRLLQHSNPVRGIYHYAGSKSVSWYEFAQHIFQAASQQQTSFPVPELTAVSDKEYPTAAPRPAYSILDCRKIENDFGIKPSDWQKALHRSFPSCSDAARPSVSAVKHRLGGFLI

SEQ ID NO: 6973 - protein, 287 aa, Neisseria meningitidis
MSEIGLVKIYFGKVRDLYEIDDKRMLMVASDRLSAFDVILDDPIPSKGEILTQISNFWFKKLAHIMPNHFTGQTVYDVLPENEAKALEKRAVVAKKLTPVKVEAIVRGYLAGSGWKDYQKTGSVCGIQLPEGMQEAQQLPEVIFTPSTKAAVGDHDENISFEECGRIIGKELAEEVRAKAVRLYTEAAEYAKSRGIIICDTKFEFGLDENGTLTLMDEVLTPDSSRFWPADQYKVGTNPPSFDKQFVRDWLEQSGWNKKAPAPKVPADVIQKTVEKYREALTLLTQD

SEQ ID NO: 6974 - protein, 707 aa, Neisseria meningitidis
MMFDKHVKTFQYGNQTVTLETGEIARQAAAAVKVSMGDTVVLVAVTTNKEVKEGQDFFPLTVDYLERTYAAGKIPGGFFKREGKQSEKEILTSRLIDRPIRPLFPEGFYHDIQIVAMVVSVDPEIDSDIPAMLGASAALVLSGVPFAGPIGAARVGYVNGVYVLNPTKAELAKSQLDLVVAGTSKAVLMVESEAKILPEDVMLGAVVYGHDQMQVAINAINEFADEVNPELWDWKAPETNEELVAKVRGIAGETIKEAFKIRQKQARSAKLDEAWSAVKEALITEETDTLAANEIKGIFKHLEADVVRSQILDGQPRIDGRDTRTVRPLNIQTSVLPRTHGSALFTRGETQALAVATLGTSRDEQIIDALSGEYTDRFMLHYNFPPYSTGEVGRMGAPKRREIGHGRLAKRALLAVLPKPEDFSYTMRVVSEITESNGSSSMASVCGGCLSLLSAGVPLKAHVAGIAMGLILEGNKFAVLTDILGDEDHLGDMDFKVAGTTEGVTALQMDIKIQGITKEIMQIALAQAKEARLHILDQMKAAVAGPQELSAHAPRLFTMKINQDKIREVIGKGGETIRSITAETGTEINIAEDGTITIAATTQEAGDAAKKRIEQITAEVEVGKVYEGTVVKILDNNVGAIVSVMPGKDGLVHISQIAHERVRNVGDYLQVGQVVNVKALEVDDRGRVRLSIKALLDAPAREENAAE

SEQ ID NO: 6975 - protein, 242 aa, Neisseria meningitidis
MCRTAANHPFSRKIFDFKLPMNHDITFLTLFLLGFFGGTHCIGMCGGLSSAFALQLPPHINRFWLILLLNTGRVSSYTAIGLILGLIGQVGVSLDQTRVLQNILYTAANLLLLFLGLYLSGISSLAAKIEKIGKPIWRNLNPILNRLLPIKSIPACLAVGILWGWLPCGLVYSASLYALGSGSAATGGLYMLAFALGTLPNLLAIGIFSLQLKKIMQNRYIRLCTGLSVSLWALWKLAVLWL

SEQ ID NO: 6976 - protein, 283 aa, Neisseria meningitidis
MNTLKFTKMHGLGNDFMVIDAVSQDFTPEDAPIAEWADRFRGVGFDQLLVVGRSETEGVDFRYRIFNADGSEVGQCGNGARCFARFVADKGLTDKKEICVETANGVIFPKLSDNGMVTVNMGKPKFMPSEIPFVPESGEGDDACIYGVHLESGIQPVSCVNMGNPHAVIVVDDVECAPVRETGSLIEPHRQFPERVNVGFMQVVGRTAIRLRVFERGVGETQACGTGACAAVVAGIRLGLLDEGKTVEVVLPGGTLYIEWACGGDVMMTGPAEAVFEGELAYS

SEQ ID NO: 6977 - protein, 75 aa, Neisseria meningitidis
MVLGEYYAVAGHIGFGGKADARHMGNDPRRALVHPPFLPDFGQHIFFHRALEPENRWKRMAGRPRTSAARAFCRQ

SEQ ID NO: 6978 - protein, 152 aa, Neisseria meningitidis
MCVGALLLFGNGSSVCVCGTAQTLCAEAGLLVRVAVCADGGCLCPPLRYRPAAAVNVRRLAAATRRVDGSVDAGLGTGAAAFRNWKIIRCGRIGTKSYKERNFGYWFFRRHRFRIKPYPKFVYVSAQIPCNRTGCLWGLRLTVETLLFRSRR

SEQ ID NO: 6979 - protein, 310 aa, Neisseria meningitidis
MKIANSITELIGNTPLVKLNRLTEGLKAEVAVKLEFFNPGSSVKDRIAEAMIEGAEKAGKINKNTVIVEATSGNTGVGLAMVCAARGYKLAITMPESMSKERKMLLRAFGAELILTPAAEGMAGAIAKAKSLVDAHPDTYFMPRQFDNEANPEVHRKTTAEEIWRDTDGKVDVFVAGVGTGGTITGVGEVLKKYKPEVKVVAVEPEASPVLSGGEKGPHPIQGIGAGFIPTVLNTKIYDSITKVSNEAAFETARAIAEKEGILVGISSGAAVWSALQLAKQPENEGKLIVVLLPSYGERYLSTPLFADLA

SEQ ID NO: 6980 - protein, 301 aa, Neisseria meningitidis
MGKGGDIVVGNGKKYAAPLLVLGCVVFGLGSLIVRSVPVGSYAIAFWRLLISVFVFWFLARFFRQKFPKNRKTVRYALTAGVFLAFDLALWHESIHAVGPGISTLLNSLQIFFLSAIGVFFFGERLSGLKKAGLISAVAGVAMIAGAEFGYNGNAVWGFASGLVSGLMLALSMVFVRKTHEIEPVALFPSMMILSLGGAVSLVVPALLMDGGALYPTTWKDAGLVLVYGVVMQCFAWAMVAYAIPLLSLSLTGLLLLSEPVAALFIDYFGLGKPIEGVQWAGVALTLSAIYLGSLKRQSSH

SEQ ID NO: 6981 - protein, 339 aa, Neisseria meningitidis
MNTMLMSGAAAALLAGIILYFKSDKKRQENGEWSSGLEYAYILTAVGVFAALSLFMSFTAVFLIFVVLCGTAWGVYKYRLKTHPEISESSHFGDYFGSFFPTVLVLFLIRSFIAEPFQIPSSSMRPGLIKGDFILVGKFSYGLRVPVLNNIFIPTGKIERGDVVVFNYPLQPEMTYIKRIVGIPGDVVEYRDKILTVNGKPTSDIPDGTYRYPDDTDPSEIHNTDMFRSGLDGKSFNILKKEGQPAVSLPVLGKYTSDIMSENGYSIEQSGLEHCQYADDGSGFVCKVPEGRYFAMGDNRDNSADSRYWGFVDDKLVVGKAMFILMNFGDFGRSGTAIR

SEQ ID NO: 6982 - protein, 597 aa, Neisseria meningitidis
MKNIRNFSIIAHIDHGKSTLADRFIQYCGGLDLREMSTQVLDSMDIEKERGITIKAQTAALNYKARDGQVYQLNLIDTPGHVDFSYEVSRSLSACEGALLVVDASQGVEAQTVANCYTAIDLGVEVVPVLNKIDLPAADPERVEQEIEDIIGIDAVGAVQCSAKSGIGVEDVLEEIVAKIPAPTGDENAPLQAVIVDSWFDNYVGVVMLIRVKNGTIKLKDKVRFMSTKAETQVEQLGVFTPKSVQKQELKAGEVGFLITGVKELGQAKVGDTVTLVANPATEPLPGFQEVQSQVFAGLYPVESHDYEALRDALEKLQLNDASLKFEPEVSQALGFGFRCGFLGLLHLEIVQERLEREFDMDLITTAPTVIYEVVLKSGEKIEVENPSKLPDIGSIETILEPIITATILVPQEYVGNVMTLCNQKRGVQVNMQYMGRQVMLTYDLPMNEVVMDFFDKLKSTSRGYASLDYHFKEFQPSDLIKLDIMVNGEKVDALSLIVHRQSAVHRGRELASKMRELIPRQMFDIAVQAAIGSQIIARENVKALRKNVLAKCYGGDITRKKKLLEKQKAGKRRMKQVGNVEIPQSAFLAILQVSDK

SEQ ID NO: 6983 - protein, 233 aa, Neisseria meningitidis
MSLKTVAVIGAMEQEIELLREMMENVKAVSFGRFSAYEGELAGKRMVLALSGIGKVNAAVATAWIIREFAADCVINTGSAGGLGKGLKVGDVVIGTETAHHDVDVTAFGYAWGQVPQLPARFASDGILIEAAKRAARTFEGAAVEQGLIVSGDRFVHSSEGVAEIRKHFPEVKAVEMEAAAIAQTCHQLETPFVIIRAVSDSADEKADISFDEFLKTAAANSAKMVAEIVKSL

SEQ ID NO: 6984 - protein, 370 aa, Neisseria meningitidis
MTAKEELFAWLRHMNQNKGSDLFVTTHFPPAMKLDGKITRITDEPLTAEKCMEIAFSIMSAKQAEEFSSTNECNFAISLPDTSRFRVNAMIQRGATALVFRTITSKIPKFESLNLPPVLKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGDISLQEALKNADSAHDLRLAVQLRSRRAQSSSPDLELL

SEQ ID NO: 6985 - protein, 325 aa, Neisseria meningitidis
MIYPWHNEQWRQIAEHWERRPNAWLFAGKKDTGKTTFARFAAKALLCETPAPGCKPCGECMSCHLFGQGSHPDFYEITPLSDEPENGRKLLQIKIDAVREIIDNVYLTSVRGGLRVILIHPAESMNVQAANSLLKVLEEPPPQVVFLLVSHAADKVLPTIKSRCRKMVLPAPSHEEALAYLRERGVAEPEERLAFHSGAPLFDEADGVRALRIKLLDILAEPRLLKILDYAALFDKEKLPLAVFVGWMQKWLVDLGLCLQHMKPVYYPAYEDRLLQTVSGFRPRNVFAAEDMLKQLAPYGFHTLNVKMQIEHLLINYLELKKENG

SEQ ID NO: 6986 - protein, 116 aa, Neisseria meningitidis
MSDGQNIPAKMMSLQLKDMNLLYSSYMPFLEHGGLFVQTNDVFSIGDDILLAVEILNFPKLFLPTKVAWINPARTSSKPKGVGLAFTKHENCLKVKDQIEVELGNTIGGSRPTFTM

SEQ ID NO: 6987 - protein, 259 aa, Neisseria meningitidis
MHIIDSHCHLNFEGLKERLPEVLSNMEANGVGQALAISVSRESFSEVFAIAEAHEHIYCTIGVHPDSKEAEEFSIAEMVEAAAHPKVVGIGETGLDYYWCKGDLSWQHKRFADHIEAANQTGLPVIVHTRDAAADTLSILKECRVNSGVIHCFSEDIGFARAAMDLGLYISFSGIVTFKNAPLVQEAAKYVPDDRILVETDAPFLAPVPKRGRQNEPAFVRHTAEHIAKLRNQTLEQVAAYTTENFYRLFKKVPDMRTV

SEQ ID NO: 6988 - protein, 71 aa, Neisseria meningitidis
MKAIHPYACPRCCRLPANTFRTGMANSASKFCIAKGGRREAKKDESGGGYALCHLPDSRIVEEWEYFRSQY

SEQ ID NO: 6989 - protein, 103 aa, Neisseria meningitidis
MASIHDQIKEVVTTHRVVLFMKGTKQFPQCGFSSRAVQILNAAGCTDYVTVNVLENPEVRQGIKEYSDWPTIPQLYVNGEFVGGSDILMEMYEAGELQELLKA

SEQ ID NO: 6990 - protein, 208 aa, Neisseria meningitidis
MNVNVINHPLVRHKLTLMREADCSTYKFRTLATELARLMAYEASRDFEIEKYLIDGWCGQIEGDRIKGKTLTVVPILRAGLGMLDGVLDLIPTAKISVVGLQRDEETLKPISYFEKFVDSMDERPALIIDPMLATGGSMVATIDLLKAKGCKNIKALVLVAAPEGVKAVNDAHPDVTIYTAALDSHLNENGYIIPGLGDAGDKIFGTR

SEQ ID NO: 6991 - protein, 106 aa, Neisseria meningitidis
MNFQDYLATFPSIDHLGGLDVQDADGKTVHHIPAVQGKLGSLKLYNALAERFDGKLGKEAAEQGLIWFAEHVADARAHPGKHPNIDLLENVVQSGETWLLKPLSAQ

SEQ ID NO: 6992 - protein, 139 aa, Neisseria meningitidis
MKKMFLSAVLLLSAAAQTVWADTVFSCKTDNNKYIEVQKINRNLYEYSFGSAAKKEIAIRNSKADLLGRSDRWQGMGSGRWATMKFQNGEFMYTIWTGFDSVTHTESSGVVVERRGKEVARVGCTPKTAQANFNDDDFS

SEQ ID NO: 6993 - protein, 246 aa, Neisseria meningitidis
MLIVRPSGRAAEDVETCLNAGWRAEVLSPVEIEADAAGLELLSEQYARADAVFWVSPTAVETAVPYLNLSDGIKAQIAVGQGSRRALERCLVRTVIAPDDGNDSEAVLRLPVWNSLPEGARVLFVRGHGGRDFLMNALQEKGFRTEVAEVYFRRHKPLNFQNFQTENIAAAYITSTELVRLLFGQLPPQFSRFFKSLLYFTHHPRIAEALKREGVCSVETVPTLEAALSHSSISVSDGMVFPGTSN

SEQ ID NO: 6994 - protein, 424 aa, Neisseria meningitidis
MPSETSSPRKENETEVHIPAAPFIVKQSGSNALAVCALVLAALGLGTSGFLFVQGQNVLKNQELAFNQKIDKAALGESENAALLKDNLNRQAAIQSELDRLDGNVKANGEQILEMQKSYRELTKGRADWLVDETETILNLAAQQLVLTGNIQTAVGVLEHIDSRLSRFNQAELLPIKQAVSSDLAELKNRPYVDISGTALRLDRLETAVSGLPLMLDGVLKPGVQVKNEAASASWWQNVWEKSLGTLKGLVEIRRLENNDAMLISPEQAYFVRENLRLRLLDARTALMQRNSEVYQGDLNNAEAAVRQYFDAKSPATQSWLKELAELKALDVRMTADDGLKNSLNAVRAYRDGTRMTAAENQEAEQAASEPANEKTASEPAAASDVKTIEAPSLPSERKPEQPAKKQTVPEKAGRSPSAKGERA

SEQ ID NO: 6995 - protein, 407 aa, Neisseria meningitidis; identical to SEQ ID NO: 752

SEQ ID NO: 6996 - protein, 146 aa, Neisseria meningitidis
MGSSDSFKEKKEIFEIGTPAYRQKLIDVWKKSINGNEKSWVLFENGTCVILLEPEKDLAKQAKEMLSKWGKVQIGTPSADFGIITLDSGDGYAVSCHHPEIFTLILKEEGLDEDFKIGIEGRSHRDCDAEEPKVIHIEDKRTIETP

SEQ ID NO: 6997 - protein, 354 aa, Neisseria meningitidis
MISLKNDTFLRALLKQPVEYTPIWMMRQAGRYLPEYKATRAKAGSFLDLCKNTELATEVTIQPLERFDLDAAILFSDILTVPDAMGLGLYFAEGEGPKFKRALQHEADIAKLHVPDMEKLQYVFDAVTSIRKALDGRVPLIGFSGSPFTLACYMVEGGGSKEFRTIKTMMYSRPDLLHKILDTNAQAVTAYLNAQIDAGAQAVQIFDTWGGVLSDAAFKEFSLKYIRQIVAGLKRESEGRRVPVIVFAKGGGLWLESMAQIGADALGLDWTCNIGEARRRVGKQVALQGNFDPFALFGTPESIRTEVARILADYGHGSGHVFNLGHGINQHADPEHAKILVDTVHELSRQYHGG

SEQ ID NO: 6998 - protein, 459 aa, Neisseria meningitidis
MAKTLKTLYQCTECGGTSPKWQGKCPHCGEWNTLQESLAAPEPKNARFQSWAADTSTVQSLSAVTATEVPRNPTGMGELDRVLGGGLVDGAVILLGGDPGIGKSTLLLQTIAKMAQSRKVLYVSGEESAQQVALRAQRLELPTDGVNLLAEIRMEAIQAALKQHQPEVVVIDSIQTMYSDQITSAPGSVSQVRECAAQLTRMAKQMGIAMILVGHVTKDGAIAGPRVLEHMVDTVLYFEGDQHSNYRMIRAIKNRFGAANELGVFAMTENGLKGVSNPSAIFLASYRDDTPGSCVLVTQEGSRPLLVEIQALVDDAHGFTPKRLTVGLEQNRLAMLLAVLNRHGGIACFDQDVFLNAVGGVKIGEPAADLAVILAMLSSFRNRPMPEKTVVFGEIGLSGEVRPVARGQERLKEAEKLGFKRAIVPKANMPRNAKEFPNLKIYGVSSLQEAIDICRDSRE

SEQ ID NO: 6999 - protein, 159 aa, Neisseria meningitidis; identical to SEQ ID NO: 358

SEQ ID NO: 7000 - protein, 119 aa, Neisseria meningitidis; identical to SEQ ID NO: 3618

SEQ ID NO: 7001 - protein, 1204 aa, Neisseria meningitidis
MSASIQAFDPLTVPISGTNLIEASAGTGKTYGIAALFTRLIVLEQKNVERVLVVTFTKAATAELKTRLRGRLDDVLQVLESKGIAKLGDDTLSDGIAAYCAEHHEGDTFLPELLKQALQKEGRTRLIVRLKAAIGQFDNAAIYTIHGFCQRILRDYAFLCQAPFDVEMTEEDGDRLLIPAQDFWRERVSNDPVLAALALKRKAVPQTVLAQISRYLSRPYLNFRRPQADLKQAQRNAETSWQTICRLLPELEAGFWRIHPDLNGNSYRKNSFGNLFKELAQKSAAGQLPFLDKDTHDRLLKLASDKLEAGLKKGKTPDAAVFAELQKLADFGRDLNALEEAEEATMIRLQLDLIEYLNRSLAEMKKSRRERGFDDLLLDVHTALTDNPHADTLARAVAENWETALIDEFQDTDPLQYEIFQKIFIAQNRPLFLVGDPKQAIYSFRGADIYAYLQAAEDARHRYTLATNYRSHAALIGSIGALFRLKERPFVLENIGYSEVGAARAESRLSPERPAVQVRWLHENDNEKANKDVLRRRAADYCADEIAHALNEAARGRLNFKGCPLQSGDIAVLVRTHNEAVMVSAALKKRQVQSVLLSRESVFASPEAAALSALIGFWLEPRRAGTLRFVLTSSIFGYDAQQLHDFNQNESEILHWAESARTALDNWNKYGIFAAMQQFSQTHGIETRLLSRNNGRSLTNYFQLLELLAAEDAQNRNPAALHKWLGDQISLAENNSGDNRAIRLESDEDLVKIVTMHASKGLQYPLVYCPFAWDAQDTGPSDWQILHQGANRTELLAKAQLSEDEQKQYADEEMAERLRLLYVALTRAEEQLNIYAAYSTNTADNPLAYLIEGSPQDSRETVRRAYACEKDGIAMLKRNWRRVADNAPSGTNFAFTENAPPPAAYRSNAGQTAEFAANSIPERGFRFVRHTSFTALSRHTQTPDGGEEDACPSLDAAETSVPAMPSETPTASDGISIHDFPKGTQAGLCLHEILEDFKFGQAAAGQETLIADKLKKYGFEEIWLPAVAEMAEACRKTPLTGAYDLSDISPECRCPEMGFTLHTEDFSLKRLRDWFARDDIRLPEVCRAAAETLDFHTVNGFLNGFVDMVCQDPDGNICVIDYKSNHLGTDASAYTQQAMDEAVAHHHYYLQALIYAVAAARYFKLRGQPPAAVSVRYLFLRGLDGKGGGVWRWDIDAAALEQIK

SEQ ID NO: 7002 - protein, 302 aa, Neisseria meningitidis
MNTPQSAIIPDHAQAGIFIEADFAANRLNDIKAACRASLDALTALKARFPDDILGLTIAFGSKAWATFGHTDEGSEIKPFSEMGNGLAPSTQHDMSIHIQSFRQNAAYALAQSVLGAFGDSICVASEEHGLRLYQDRGLDGFVDGTENPQGDENVREVAIIPEGKPDAGGSYVLLQKYLHDLKKWDAVPVAEQEASVGRGKETDDEFGRDVRLPDSHLGRVNLKENGVGLKIVRRSLPFGKISGEHGLMFTAYCRTLHNIEAQLLSMFGDTDGKTDLLLRHLSAAVSGGYYYAPSVERLQNL

SEQ ID NO: 7003 - protein, 275 aa, Neisseria meningitidis
MMLKKFVLGGIAALVLAACGGSEGGSGASSAPAQSAVSGSLIERINNKGTVTVGTEGTYAPFTYHDKDGKLTGYDVEVTRAVAEKLGVKVEFKETQWDSMMAGLKAGRFDVVANQVGLTSPERQATFDKSDPYSWSGAVLVVRNDSNIKSIADIKGVKTAQSLTSNYGEKAKAAGADLVAVDGLAQSLTLIEQKRADATLNDELAVLDYLKKNPNAGVKIVWSAPADEKVGSGLIVNKGNDEAVAKFSTAINELKADGTLKKLGEQFFGKDISVQ

SEQ ID NO: 7004 - protein, 220 aa, Neisseria meningitidis
MIVSAFLPMVKAGFAVSLPLAAASFVIGMMIAVAVALVRIMPAGGIVRKILLKLVEFYISVIRGTPLLVQLVIVFYGLPSVGIYIDPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 7005 - protein, 251 aa, Neisseria meningitidis; identical to SEQ ID NO: 1436

SEQ ID NO: 7006 - protein, 460 aa, Neisseria meningitidis
MASIARDIFKAYDIRGIVGKTLTDEAAYLIGKAIAAKAAEKGITRIALGRDGRLSGPELMEHIRRGFTDSGINVLNVGMVATPMLYFAAVNECGGSGVMITGSHNPPDYNGFKMMLGGDTLAGEAIQELLSIIEKDGFAAAGKQGSVTEKDISGEYLKHITGHIRLKRPMNIAIDAGNGVGGAFAGKLYKGLGNKVTELFCDVDGTFPNHHPDPSKPKNLQDLIAALKNGDAEIGLAFDGDADRLGVVTKDGNIIYPDRQLMLFAQDVLNRNPGAKVIFDVKSTRLLAPWIKEHGGKAIMEKTGHSFIKSAMKETGAPVAGEMSGHIFFKERWFGFDDGLYAGARLLEILSASDNPSEVLNNLPQSISTPELNIALPEGSNGHQVIDELAAKAEFEGATEIITIDGLRVEFPDGFGLMRASNTTPILVLRFEADTQEAIERIQNQFKAVIESNPNLIWPL

SEQ ID NO: 7007 - protein, 169 aa, Neisseria meningitidis
MIILHTNKGDIKIELDFDKAPVTAKNFEQYVKDGFYDGVIFHRVIKGFMIQGGGMDENMNEKETRDPIQNEASNGLPNDKYTIAMARTSDPHSASAQFFINTADNAFLNFRSKELYGKTVVQDWGYAVFGKVVDGFDVVDAIEGVSTKRHGYHDDVPSEPVVIIKAEAV

SEQ ID NO: 7008 - protein, 471 aa, Neisseria meningitidis
MNLHAKDKTQHPENVELLSAQKPITDFKGLLTTIISAVVCFGIYHILPYSPDANKGIALLIFVAALWFTEAVHITVTALMVPILAVVLGFPDMDIKKAMADFSNPIIYIFFGGFALATALHMQRLDRKIAVSLLRLSRGNMKVAVLMLFLVTAFLSMWISNTATAAMMLPLAMGMLSHLDQEKEHKTYVFLLLGIAYCASIGGLGTLVGSPPNLIAAKALNLDFVGWMKLGLPMMLLILPLMLLSLYVILKPNLNERVEIKAESIPWTLHRVIALLIFLATAAAWIFSSKIKTAFGISNPDTVIALSAAVAVVVFGVAQWKEVARNTDWGVLMLFGGGISLSTLLKTSGASEALGQQVAATFSGAPAFLVILIVAAFIIFLTEFTSNTASAALLVPIFSGIAMQMGLPEQVLVFVIGIGASCAFMLPVATPPNAIVFGTGLIKQREMMNVGILLNILCVVLVALWAYAVLM

SEQ ID NO: 7009 - protein, 69 aa, Neisseria meningitidis
MHLFPIYPIFPLTYQSHLINKTDKSFTIYLHYIRLQIYSNQLQKRRFHKPFRIARHKRKTDFVALKEYS

SEQ ID NO: 7010 - protein, 120 aa, Neisseria meningitidis
MNLPRNRFILLSALWFAGSIYSLLFKAAETAPPPFPHFDKVAHLALFFAQIWLLTKAFRTDNRPIPYRSLMVFALCFALFSECAQAWFTATRTGSLGDVLADLTGAALALFTARAACRPD

SEQ ID NO: 7011 - protein, 192 aa, Neisseria meningitidis
MSNTIKMVVGLGNPGKEYEQTRHNAGFWFLDELAWKWKASFKEEKKFFGEVARAALPDGDVWLLKPATFMNRSGQAVAALAQFYKIKPEEILVVHDELDIPCGRIKFKLGGGNGGHNGLKDIQAKLGTADYYRLRLGIGHPGDRNLVVGYVLNKPSTEHRRQIDDAVAKSLQAIPDILAGKWEEATRFLHSK

SEQ ID NO: 7012 - protein, 92 aa, Neisseria meningitidis
MLEIEIVYGLPDRQVLKTMQLAEGTTVRAAALQSGLDGIFEDLNLHSAPLGIFGKAVKDDTPLRDGDRIEVYRPLLIDPKEARRKRVQNQEE

SEQ ID NO: 7013 - protein, 145 aa, Neisseria meningitidis
MPVKKVEKNILVLHGADKMFELVDKVEDYPHFLPWYSKTEVIGRSGNELKARLFMDYMHVRQSFATHNRNIPGREIRMELLEGPFKTLRGTWKFIDLGDDMCKIEFNLEYDFSNAVLSALISPVFNHLSTTLVEAFVKEADRRYA

SEQ ID NO: 7014 - protein, 655 aa, Neisseria meningitidis
MGNTFKSILVWVALGIGLMAAFNALDGKKEDNGQIEYSQFIQQVNNGEVSGVNIEGSVVSGYLIKGERTDKSTFFTNAPLDDNLIKTLLDKNVRVKVTPEEKPSALAALFYSLLPVLLLIGAWFYFMRMQTGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQILNVHSKKVPLDESVDLLSLARGTPGFSGADLANLVNEAALFAGRRNKVKVDQSDFEDAKDKIYMGPERRSMVMHEDEKRATAYHESGHAIVAESLPFTDPVHKVTIMPRGRALGLTWQLPERDRISMYKDQMLSQLSILFGGRIAEDIFVGRISTGASNDFERATQMAREMVTRYGMSDKMGVMVYAENEGEVFLGRSVTRSQNISEKTQQDIDAEIRRILDEQYQVAYKILDENRDKMETMCKALMEWETIDRDQVLEIMAGKQPSPPKDYSHNLRENADAAEDNAPHAPTREETEAPAPADTASTESEQQPENKA

SEQ ID NO: 7015 - protein, 206 aa, Neisseria meningitidis
MAVRSKSSKAWLHEHVNDHYVHMAQKDGYRARAAYKLLEINEKDKLIKPGTVLADLGSAPGSWSQVAAKLTGTSGAVFALDILPMEAIGGVSFIQGDFRENDVLAQFETLLDNRPLDLVICDMAPNMSGNAVSDQARSFYLCELALDFASQHLKTGGSFLVKVFQGAGYQEYMAAMREIFGTVQTRKPEASRNRSSEIYLLGKNKR

SEQ ID NO: 7016 - protein, 94 aa, Neisseria meningitidis
MTDTKLNTKEILELKARAHHLHPVVMVGQQGLTDAVIKETDAALTAHELIKVRVFGDDRAERIEICTALCEAVDAQLVQHIGKLLVLWRKNIEA

SEQ ID NO: 7017 - protein, 333 aa, Neisseria meningitidis
MQFPYRNVPASRMRRMRRDDFSRRLMREHTLTADDLIYPVFVLEGSAREEDVPSMPGVKRQSLDRLLFTAEEAVKLGIPMLALFPVVTANKTERAQEAYNPEGLVPSTVRALRERFPELGIMTDVALDPYTVHGQDGLTDENGYVMNDETVEVLVKQALCHAEAGAQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAIANGWLDGGKVVLESLLAFKRAGADGILTYYAIEAAKMLKR

SEQ ID NO: 7018 - protein, 385 aa, Neisseria meningitidis
MKFATKAIHSSYDCDEHNRALMPPIYQNSMFALHEIGENVPYRYSRLSNPTRQILEDTVADLEHGAAGFAFSSGMAGIDAVWRTFLRPGDTIVAVADIYGGAYDLLVDVYQKWGVNVVFADLGNPDNLDELLKAHKVKLVWLETPSNPLLRLVDIKVLAAKAKAAGALVGIDNTFATPYLQQPLDMGCDFVFHSATKYLCGHSDVLMGIVVAKTKELAQPLHDMMVHTGAVAGPLDCWLVLRGIKTLALRMNAHCQNALEIARRLEAHPAIEKVFHPGLPSHEHYELAKTQMPKGIGGVVTVYLKNDTREAANSVIKNMKLVKMASSLGGVESLVNHCYSQSHSGVPHDVKMEMGIKVGLLRFSIGIEDADDIWNDISAALDTTL

SEQ ID NO: 7019 - protein, 257 aa, Neisseria meningitidis
MNTIADVQSSRDLRNLPINQVGIKDLRFPITLQTAEGIQSTIARLTMTVYLPAEQKGTHMSRFVALMEQHAEALDFAQLRKLTTEMVALLDSRAGKISVSFPFFRKKTAPVSGIRSLLDYDVCLTGEIKDGAYGHSMKVMIPVTSLCPCSKEISQYGAHNQRSHVTVSLTADAEVGIEEVIDYVEAQASCQLYGLLKRPDEKYVTEKAYENPKFVEDMVRDVATSLIADKRIKSFVVESENFESIHNHSAYAYIAYP

SEQ ID NO: 7020 - protein, 221 aa, Neisseria meningitidis
MTVLSKEQVLSAFKNRKSCRHYDAARKISAEDFQFILELGRLSPSSVGSEPWQFIVVQNPEIRQAIKPFSWGMADALDTASHLVVFLAKKNARSDSPFMLESLKRRGVTEPDAVAKSLARYQAFQADDIKILDDSRALFDWCCRQTYIALANMMTGAAMAGIDSCPVEGFNYAEMERILSGQFGLFDAAEWGVSVAATFGYRVQEIATKARRPLEETVIWA

SEQ ID NO: 7021 - protein, 321 aa, Neisseria meningitidis
MSHTQLTQGERYHIQYLSRHCTVTEIAKQLNRHKSTISREIRRHRTQGQQYSAEKAQRQSRTIKQRKRQPYKLDSQLIQHIDPLIRRKLSPEQVCAYLCKHHQITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRALKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLIH

SEQ ID NO: 7022 - protein, 252 aa, Neisseria meningitidis
MNPKISSDHTEDAVRLSKRMAQLGLCSRREADGYIEQGWVTVNGKTAVLGQKVSPADRIELNKKAHEQQAARITILLNKPVGYVSAQAEKGYKSAAELITPENHWEGDTGRIRFDPKHKIGLAPAGRLDIDSVGLLVLTQDGRIAKQLIGENSGSEKEYLVRVRGKLDEKGLALLNHGLSLDGEKLRPAQVEWQNEDQLRFVLKQGKKRQIRRMCELVGLRVVGLKRIRMGKVKLGRLPPGKWRYLAPGESF

SEQ ID NO: 7023 - protein, 296 aa, Neisseria meningitidis
MNSPFHNIGIVTRPNTPDIQDTAHTLITFLKQHGFTVYLDEVGIKEGCIYTQDTVGCHIVNKTELGQYCDLVAVLGGDGTFLSVAREIALRAVPIIGINQGHLGFLTQIPREYMTDKLLPVLEGKYLAEERILIEAALIREGKTAERAIALNDAVLSRGGAGQMIEFEVFVNREFVYTQRSDGLIVSTPTGSTAYSLAAGGPIMQAGLHAFTLVPICPQSMTNRPIAIPDTSEIEILVTQGGDARVHFDGQTHIDVQNLDRITIRRYRNPLRILHPTDYQYFKTLRQKLHWGEQLV

SEQ ID NO: 7024 - protein, 188 aa, Neisseria meningitidis; identical to SEQ ID NO: 2910

SEQ ID NO: 7025 - protein, 265 aa, Neisseria meningitidis
MRAVPPPHISITGLGYLGLPLAQKFYQHGSRVAAVKRSLTSDDINLPIHLDTIDLNQDSAFQSANLARDTSFWRHHANKPVWFCLLPPSSLTHYADTVKQWAELARACNVQHLIFTSSTSVYGDTARECDEIALPDPQTESARQILAAEQHLLDSGVPNIDILRLGGLYCAERHPVGRLVQKQNIPGGNRPINIVHRNIAVESLFQTAFNPGGRRLKNIIEPRHPTRREFYTEEAAKLGLPAPDFAPDDSVGKIIRTVCDNGLSL

SEQ ID NO: 7026 - protein, 216 aa, Neisseria meningitidis
MPVTRPAKINTYTRIIDASLALFNEEGERNISTNHIAAHLGISPGNLYYHFRNKDEIIVQLFKRYSEALLAYLNEAVLPSDVEDSINYMAGIYDVMWEYRFLFSDVNTLLARSAELLGEHNTFTQAKVSPLLVNLLTQLNGLNIIQADQTAMNDLAVNMWMVTKYWFDFDSSLRGRTKLTEDSKARGIRRTLSLLRPYLLPEHRKKYDRKIGNGNP

SEQ ID NO: 7027 - protein, 346 aa, Neisseria meningitidis
MQPIRYRTDLTPYNTFGLRAQARAFIALEHADELRDIVRLLEFDRDTVLWLGGGSNILLMQDYAGLVVHMENKGIREIARSDGMVLIEAQAGEIWHDFVLHTVALGLSGLENLSLIPGTVGASPVQNIGAYGVEAKDVIHSVRCFDLDTETFVELANADCRFAYRESLFKQEGKGRYVIVSVVFALKTHFVPTLGYGDLAAAVAELSAGRVPTAKDVSDAVCAIRNSKLPNPNVLGNVGSFFKNPVVSAEKAATLLQRHPDMPRYPQPDGSVKLAAGWLIDQCRLKGFQIGGAAVHDRQALVLVNKNNASANDVRQLAQHIKFTVFARFQVELHAEPNWLPASFSL

SEQ ID NO: 7028 - protein, 459 aa, Neisseria meningitidis; identical to SEQ ID NO: 2904

SEQ ID NO: 7029 - protein, 62 aa, Neisseria meningitidis
MRNNGAHYIVKKCRAVRRRIQGIKVYSDCVYFMVKFGFNDLTALSRRTGAVRILNRKEAPPF

SEQ ID NO: 7030 - protein, 383 aa, Neisseria meningitidis
MQTWQLPEHIADVLPTNARQLESAREQLLALFRVHGYELVQPPLMEYAHSLLTHIDAGLSLKTILVTDRLSGRQLGIRADITPQVARIDAHLLSANQGINRLCYAGPVLHAQPDGLLNMREPLQAGAEMYGFADIRGDIELIDLMLKSMKIADMGKVLLSLGHIGIFRALSDAAHLDAGQSATLLALMQDKDTGAVEAQVKAWKLDGMWAKAFSLLPRLYGGREVLSDARGRLPDLSAVGGALGELQAVCDAFPDCEIHIDLSELRVDNYHTGLLYAAYAADFHDAVARGGRYDGLGGYFGRARPATGFSFDLRSFIGRLPAIERQPAVLVDAEDAEAAHEAVEALREQGQCVVIDYGIGHNVSEELAGRLKKTDGVWQVVKR

SEQ ID NO: 7031 - protein, 434 aa, Neisseria meningitidis
MAMAKNVVVIGAQWGDEGKGKIVDWLAEEAGGVVRFQGGHNAGHTLVVGGKKTILRLIPSGILHESLDCFIGSGVVVSPEALLGEIDELNAAGVKNVEGRLKIAPTCPLILPYHIALDQAREASRGKGKIGTTGRGIGPAYEDKVARRAIRAADLLHPEKLREKLDAVLAYYNVQLQHLHNAEPVKAEDVMAVIEKVAPRIAPMITDVSRVLNEKNKNGEKLLFEGAQGALLDIDYGTYPFVTSSNCLAGAASAGAGVGPQMLDYVLGIVKAYTTRVGSGPFPTELFDEVGVGLAERGHEFGSVTGRARRCGWFDAAALKRSIQINGISGMCITKLDVMDGVETINICVGYELPDGGKTDILPCGSDAVETCKPIYETMPGWRESTFGVKDYGALPENAKAYLKRIEEVCGAPVAIVSTGPDREETIVLHHPFA

SEQ ID NO: 7032 - protein, 104 aa, Neisseria meningitidis
MCVLLHRRLSHAGDESVYVAQSPLAASEGRGARERGGQVLSHWLSPYYLSNYGCIMRLCLFFVKHYTVKMCKYLVRTYTLFFTFSSIGYQCVQRKFENFYILVV

SEQ ID NO: 7033 - protein, 127 aa, Neisseria meningitidis
MPKSLSLQDVQLRFSSKFPDKTVLKFTKNYEPVTIQCPLHGSVVYGNLQAAMKSSTGCPECTRNPEKPSPNAVAIRLEDTETGEIYEFASTLAASKFIGCSNSTLAVRLSGRTPFDRLIRYRYRLVK

SEQ ID NO: 7034 - protein, 136 aa, Neisseria meningitidis
MALTFTQAVSKLTSKFPHLNLVEFNGVRYPTVIVCPIHGRVTCSTFKSMLDSKSGCPKCASYGVNSHKIPEDTIDKLSKNTVLEDTVTGETLTFPSRASAARSLGINPAAITDRIKGRVHTETLLAGRYKVHICTK

SEQ ID NO: 7035 - protein, 130 aa, Neisseria meningitidis
MAKSFNQAASELTDIFPNISLTGFDGVNYPVTVNCPMHGNVRYSTFNALIKSKYGCPECAKMSKTQTPPNVGKPLLILDTTTNETLTFPSVTAAGAALGVHFQQINHRLKGRTSPDNLISNRYKVLGYDR

SEQ ID NO: 7036 - protein, 130 aa, Neisseria meningitidis
MGKRMTFDTAKSRFQEKFPHLELLEFSGIYKPSSVRCPTHGVVQLLYYDTAIKSKYGCPECGKLKMKENTPPQNQKPVSILDTATGETLTFPSVQAAAKALNTPYGSIRTKLDGRSNPDNLVCNRYKVLL

SEQ ID NO: 7037 - protein, 186 aa, Neisseria meningitidis; identical to SEQ ID NO: 3574

SEQ ID NO: 7038 - protein, 347 aa, Neisseria meningitidis
MKCVYWNQTDGLRFYTAWHNSSKTNCTNCHLQANVLHTFAESDIHKPATFWDNPPKFQNITPYQKGTSVKRIFLFLATNIAVLVVINIVLAVLGINSRGGTGSLLAYSAVVGFTGSIISLLMSKFIAKQSVGAEVIDTPRTEEEAWLLNTVEAQARQWNLKTPEVAIYHSPEPNAFATGASRNSSLIAVSTGLLDHMTRDEVEAVLAHEMAHVGNGDMVTLTLIQGVVNTFVVFLSRIIANLIARNNDGSQSQGTYFLVSMVFQILFGFLASLIVMWFSRQREYRADAGAAKLVGAPKMISALQRLKGNPVDLPEEMNAMGIAGDTRDSLLSTHPSLDNRIARLKSL

SEQ ID NO: 7039 - protein, 215 aa, Neisseria meningitidis
MKALLLGAPGAGKGTQAQFITAAFGIPQISTGDMLRAAIKAGTPLGLEAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPKYIKVDGTQAVEAVKAEVLGALGK

SEQ ID NO: 7040 - protein, 246 aa, Neisseria meningitidis
MNPLISDFQTPQQRTPVIVALDFSNEKDTLGFVRNLDPTLCQIKIGKELFTATGRNLAESLINQGFKLFLDLKYHDIPHTVAQACKVAADMGVWMVDMHASGGRRMMEAAAEAVAGYGTKPLLIGVTVLTSMEQSDLAEIGLNTAPEEQVIRLAKLAQSSGLDGVVCSAQEAAPLRRELGQDFVLVTPGIRLDVAGNNDDQRRIMTPAEALAAGSTYLVMGRPVTQAADPVAVLREVNRVANLEAN

SEQ ID NO: 7041 - protein, 323 aa, Neisseria meningitidis
MSAKFQQETLKSRFAQAKVLVVGDVMLDRYWFGDVSRISPEAPVPVAKIGRIDQRAGGAANVARNIASLGGRAGLLSVTGNDEAADALDALMVQDGVASYLMRDKQIATTVKLRVVARNQQLIRLDFEEHPNCEVLEQIKQKYREILPEYDAIIFSDYGKGGLSHISDMIDWAKHAGKTVLIDPKGDDYEKYVGATLITPNRAELKEVVGSWKNESELTEKAQNLRRHLDLTAVLLTRSEEGMTLFSEGEPIYQPTRAQEVYDVSGAGDTVIAGMGLGLAAGCTMPEAMYLANTAAGVVVAKLGTAVCSFAELIKALSGQSTM

SEQ ID NO: 7042 - protein, 411 aa, Neisseria meningitidis
MTISTMAQTHDTRLQKTLLFPSQQGWKSKTFLKPDSHIRLATVFSGIGAVEQAFHRLNLNHTIVFSGDIDPYVKKSYLGNYKLNEDFWHNDITQFDARKFRNQVDILVGGSPCQAFSMVGKRAGLEDTRGTLFYEFARVVDEVQPKIFIYENVKGLLNHDNGKTWKVVKSVFYSLGYDLYFQIMNSKDYGIPQHRERIFVVGFHTPPINGFQFPEKIELEHTMQDFLEDYTDSKYFLREKGAKFVTSSKNRQKRYTQINGEIALCQKANQQFNWHGDFIFQAARESEFDDFIFDVNNVEEKYYLSEKIKNYVLAGGTKNFKTSTETDLPVARPLLQTMHKMHRAGVDNYVTHNRGRIRKLTPRECLRLMGFRDDFKILVSDTQMYRQAGNSIVVDVLIAILKQMDITLYGE

SEQ ID NO: 7043 - skipped

SEQ ID NO: 7044 - protein, 334 aa, Neisseria meningitidis
MTIIVTGAAGFIGSNIVKALNQRGITDIVAVDNLSKGEKFKNLAECEIAHYLDKHEFIRQVREHILPYQNIEAVFHQGACSDTMNHDGLYMMDNNYQYTLDLLDWCQDERIPFLYASSAAVYGKGEIFREERELEKPLNVYGYSKFLFDQVLRRRMKEGLTAQVVGFRYFNVYGQHEQHKGRMASVAFHHFHQYREHGYVNLFGSNDGYGNGEQTRDFVSVEDVAKVNLYFFDHPELSGIYNLGTGRSQQFNELAAATVNACRAAEGKPEMSLKELVEEELIRYIPFPDALKGKYQSFTQADITKLREAGYKEEFFDVKSGVDRYVKWMLENLA

SEQ ID NO: 7045 - protein, 514 aa, Neisseria meningitidis; identical to SEQ ID NO: 2892

SEQ ID NO: 7046 - protein, 336 aa, Neisseria meningitidis
MSIILYTANDGTAQFALQEFGGQLWLTQADMAELYQTTKQNISKHIKTILAEQELEEKATVNFQLTVQNENGRKVNRKIAHYSLPMIIAVGYRVRSARGIQFRQWATERLDEYLTKGFAIDDERLKGTGGGDYWKELLNRIRDIRSSEKALYRQVLDLYATSQDYNPKSSESQTFFAAVQNKLHYAASRQTAAELIYSRADSSKDFMGLTTFQGAIPTLNEAKIAKNYLTEDELFRLNRLVSAFFDLAEIKAQEQSPMYMRDWIAELDKFSGLYGQGTLQGAGSISRKQAEQKAEREYRAYEARILSPVEQAYLESVKALEKTAVQQIKQKKDRTK

SEQ ID NO: 7047 - skipped

SEQ ID NO: 7048 - protein, 380 aa, Neisseria meningitidis
MGKSLTEIAEELKGNDKKVQLIYAFNGTGKTRLSREFKNLIAPTSSEEPDGEPTRRKFLYYNAFTEDLFFWDNDLLANEAPRLKIQKNSFTDWLLRDNGLDGAVIKNFQYYTDDKLTPDFNDDFSEIAFYFARGNDEQIENIKISKGEESNFIWSIFYVLIRQVIAELNIPEDSEEGRSTDQFDDLEYIFIDDPVSSLDENHLIQQAVDLADLIKLSKPRLKFIITTHNVLFYNVLYNELKKLEKEKKSYLLLKNEDGSFDILEKQGDSNKSFSYHLHLKGVIEKAIENQQVERFHFMLLRNLYEKTANFLGYKQRSDILPEDSRRNYFQRIINFTSHSTLSNEAFAEPTPQEQETVKLLLQHLLDNYNFFQDDEQRDKP

SEQ ID NO: 7049 - protein, 128 aa, Neisseria meningitidis
MNLETKPIAETPNFIVLDQYEKIEQSGSYQSENRLEAELIADLQNQGYEYRKDLNSQSRLLENLRAQLQRLNDVAFSDGEWARFLTEYLDRPSENITDKTRKIHDDHIYDFAFDDGPWIRISSATLVY

SEQ ID NO: 7050 - protein, 321 aa, Neisseria meningitidis
MSYTQLTQGERYHIQYLSRHCTVTEIAKQLNRHKSTISREIRRHRTQGQQYSAEKAQRQSRTIKQRKRQPYKLDSQLIQHIDTLIRRKLSPEQVCAYLCKHHQITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRALKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLIH

SEQ ID NO: 7051 - protein, 921 aa, Neisseria meningitidis
MRIRRRLKNIYLLDKKNLARNHVQVINQFEQTGTHANRYDVTVLVNGLPLVQIELKKRGVAVREAFNQVHRYSKESFNSENSLFKFLQIFVISNGTDTRYFANTTKRDKNSFDFTMNWARSDNHPIKDLKDFTATFLQKSVLLGVLLHYSVFDANDTLLIMRPYQIAAAERILWKINSSAQAKNWSKPESGGYVWHTTGSGKTLTSFKAARLATESAFIDKVFFVVDRKDLDYQTMKEYQRFSPDSVNGSESTAGLKRNLEKDDNKIIVTTIQKLNNLMKGEDNLPVYHQRVVFIFDECHRSQFGEAQKNLKKKFKKFCQFGFTGTPIFPENALGAETTAGVFGRELHSYVITDAIRDEKVLKFKVDYNDVRPQFKAVEAEQDEKKLSAAENHKALLHPERIREITQYILNQFRQKTHRLNAGGKGFNAMFAVSSVDAAKCYYEAFKTQQAGSLHPLKVATIFSFAANEEQNAVGEIVDETFEPEAMDSSAKEFLQAAINDYNACFKTNFGTDSKAFQNYYRDLAKRVKNQEIDLLIVVGMFLTGFDAPTLNTLFVDKNLRYHGLMQAFSRTNRIYDATKTFGNIVCFRDLEQATIDAITLFGDKNTKNVVLEKSYEEYMNGYTDSQTGEARRGYLDVAKELRERFPDPDKIETEKDKKDFAKLFGEYLRAENVLQNYDEFAALRELQSVDAADEDAMKAFQEKYYLSDEDVQEMRQVPMPSERAVQDYRSAYNDIRDWLRRQKAGEQKEQSKIDWDDVVFEVDLLKSQEINLDYILQLVFEHHKKIKGKAELVEEIRRIIRASIGHRAKEGLIVDFINDTDLDKVPDVPAILETFYTYAQEVMRHEAAGLIAAEGLNETAAKRYLISSLKRGYASENGTELTETLPKMSPLNPQYLTKKQSVFQKIAAFVEKFAGIGTDI

SEQ ID NO: 7052 - protein, 769 aa, Neisseria meningitidis
MLAPELEQILQQLYREARKAHYEFISLEHLLLVLIEEDASVHNVLKLCGADLKVVSEQLAASVAENTPLIPEHLLDTVETRPTLGFQRVMQRAMVHTQSAGKAAVEPLDVLVALMSETDSHTVYFLKLQSVTRFEVLRCIAHGSPDEDEDEDEDEDDGNYSSDGMDDDNGNRTKPGKNPLSAYTVNLNAEVKAGRIDPLIGRKHEMERLVQILCRRRKNNPLLVGEAGVGKTALAEGLAHQIVNGGIPDALKDAEVYALDMGSLLAGTKYRGDFEARVKSVLKQLEKIPHAILFIDEIHTIIGAGSTSGGTMDASNLLKPALAKGSLRCIGATTYDEYRTIFDKDHALSRRFQKIDVVEPTVSETVQILRGLKPMFEAFHQVRYTQGALEAAAELSARYINERFLPDKAIDVMDEAGAEQRILPKSKQKKVIGKAQIETVIAKVARIPEKTVSHDDKQVLQFLGRDLKNMVYGQENAIDALVAAVKMSRSGLALPDKPIGSFLFSGPTGVGKTEVAKQLAYSMGVPLQRFDMSEYMERHAVSRLIGAPPGYVGFEQGGLLTEAINKQPHCVLLLDEIEKAHPDIFNVLLQVMDAGKLTDNNGKSADFRNVILIMTTNAGAESLSRPSLGFTAKRERGDEMQAINKLFTPEFRNRLDAIIPFAPLSEPVITKVVDKFLLQLEHRLLDKKVEAEFTSALHKYLAEKGFDPQMGARPMHRLIQEKIRKPLADELLFGKLSDGGFVRIDWDAAKEEAVLKFKKSKVKIKTASA

SEQ ID NO: 7053 - protein, 100 aa, Neisseria meningitidis
MTAQHQSDTLLHRLNTLPPKRYGVFLLNDDYTTMEFVVEILTEIFMLGQEQAVAVMLLVHHEGKGLCGTYTRDIAQTKQQQVMQRAKAEGHPLQCIVEEI

SEQ ID NO: 7054 - protein, 67 aa, Neisseria meningitidis
MATGIVKWFNDAKGFGFITPDEGGEDLFAHFSAINMEGFKTLKEGQRVSFDVTTGPKGKQAANIQAA

SEQ ID NO: 7055 - protein, 443 aa, Neisseria meningitidis
MLFNHTASELLDLCRRTLDLAKATGATAAEADFSESLGQSVSVRLGEIEQIEFQQDKSLDITVYVGKRKGRASTADFSEKALQDTVKAAIDIARHTAEDGCAGLADACLMAKHIGDPDLYHEWDLDTEAAVGLAKQCEQAALNEDERIENSEGAAVQTGHYQYVYGNTHGFAAHRQGTHHSISCSVVAADENGMQRDYWYDSACRHPDMDSPETIGQTAARRTLRRLGSRSIPTGSYPVLFDTTVSGGLIGHLVGALSGGALYRQSSFLIDSIGKKVLPDFLNLREEPHIPRSFRSSYFDAEGVATAPRFVIQNGIVEGYFLSSYSARKLGMQTTGNAGGAHNLYLNHTHETQSDLLKEMGTGLLVTELMGQGANTITGDYSRGAAGFWVENGVIAYPVHEITVAGRLQDMYRDIVGVADDALRRSSNKIGSILIAGMTVAGS

SEQ ID NO: 7056 - protein, 178 aa, Neisseria meningitidis
MRYWKNSRIKMFEQEDEWISKTQMKKQMNDLQDLGMALTKLSNDTLKKIGLDADLYEAVTAYKKITSNGALKRQAQFIGRLMRDTDPAPIEAFLAKLRGDDAAHNAFLQRVEQARVRLLADDGALTQFMSDFPHADAGKLRTLIRNTKKEQEQNKPPKNFRALFQELKTVMENGDAEI

SEQ ID NO: 7057 - protein, 238 aa, Neisseria meningitidis; identical to SEQ ID NO: 158

SEQ ID NO: 7058 - protein, 566 aa, Neisseria meningitidis
MSVKIQTRSVNTDVFNHLLTAGADPLIAQLCASRGVQSPAELDDKLASLLPYQSLTNCEAAARRLADAVGRKEKILIVADYDADGATACAVGMSGLAAMGAKVDFLVPNRFEHGYGLTPELAEIAAAQGVDLLITVDNGIASIAGVARAQALGLDVIVTDHHLPAETVPDCIIVNPNQKGCGFPSKSLAGVGVIFYVLMALRAELRRRNYFSDGIKEPNLGELLDLVALGTVADVVPLDHNNRILVSQGLKRMRSGKMRPGIRALFEVARRDWRKAQPFDMGFALGPRINAAGRLDDMSVGIACLLARDDSEAQELAAQLNNLNIERREIEQSMLQDALNDFPETLPSGQMTLVAYRDDFHQGVVGIVASRLKDRFYRPTIVFAPADNGEVRGSGRSIPNLHLRDALDLVSKRHPDLILKFGGHAMAAGLSILEHNIPAFQTTFEEAVREMVCEDDLSQTFITDGSLPACDITLEQAQNLARHVWGQGFAPPSFTDEFHVVRQQPLGAEGKHKKVWLQKDGCEFEAMFWRCSEDIPEYIRTVYRPVANEWRNNLELQLYIDYWEAA

SEQ ID NO: 7059 - protein, 453 aa, Neisseria meningitidis
MLKKWLNKMLPSGRSSKKAESKTVIPAERHNIRAEMLSFAAENVIRRLKGTGFQAYVVGGAVRDLLLGIEPKDFDVATDATPEQVHKLFRRSRIIGRRFQIVHVMNGAETIEVTTFRGGAKVHQNARGRIMKDNTYGSIEEDAMRRDFTCNALYYDPEKEEILDFHNGIADVAAHRLVMIGDAAERYQEDPVRILRAIRLSGKLGFELSEETAAPIAESICRLKHEPVARLFDEIMKLLFSGHARECLKRLNGFDIPDDIHLLLNALRVSDGIAGKMTVLALKNTDERLRADKSVSVGFVLAALMWPELERHWKSNLQQGLKPAPALSDAINTMRETVERGWGVPQRFSATMREIWMFQPQFENRKGARPHKLFAQARFRAAYDFLLLRAETGNADRALAEWWTAFQTASTEQRSEMTKNEAAARHEKNEGQAKKRRRRRRKPKPKVVGTDWE

SEQ ID NO: 7060 - protein, 107 aa, Neisseria meningitidis
MKKCILGILTACAAMPAFADRIGDLEARLAQLEHRVAVLESGGNTVKIDLFGSNSTMYVCSVTPFQKTFEASDRNEGVARQKVRQACNRETSAMFCEDEAIRCRKFD

SEQ ID NO: 7061 - protein, 317 aa, Neisseria meningitidis
MTHTVHLHLEETDNLALQRLCGSFDNNLDLLAKALDIHISRRFEHFTFNGAFAHAGKRALLKLLETAQTRDLNDGDIRLAAVEAQTEDAGHQEKNHDHAYYFRTKRGSIGGRTPRQNGYIRALLNHDIVFGLGPAGTGKTYLAVAAAVDAMEKHQVERIILVRPAVEAGEKLGFLPGDLTQKVDPYLRPLYDALYDLMGFDRVTKLIEKGLIEIAPLAYMRGRTLNGAYIILDEAQNTTPEQMKMFLTRIGFGAKAVITGDTSQIDLPKNIKSGLKDAREKLHNVEGLYFHTFTGEDVVRHPLVQKIVEAYESAEHD

SEQ ID NO: 7062 - protein, 344 aa, Neisseria meningitidis
MARHVFLPPLSVHRHRPHPLGVCGFESFQTLHPRKRAARPDSRPLYELCRHTCLQDFPKIRHPLCRHGTQQHHYARFGAPAPMAAYEKCGGTRRRTSRRQPPFRTRPATQIRLRMAVPPPTYWAEYSTDRLNKEKKNNKPHFVFCTVSHLRRLKGHDVLLTAFARALAQCPQLRLNIGGSGQEEQRLKQQAADLGITHAVTFLGALQPEAVLDLMRNSDAFVLASRTETFGVVYIEALSQGLPVIATRCGGAESIVSDGNGYLVPVDDDDALADALIKMCEHHSDFEPARLRENCLNEFGENAVIGRLIGIFRQAIAEYGKKIPVKYSGLTKIRTRRRSRRQYK

SEQ ID NO: 7063 - protein, 57 aa, Neisseria meningitidis
MPEPLHVLVIPSWYPQSEQDVDGIFFKIRHWHCRGKASKPPCLHRCSATCGKKQQAS

SEQ ID NO: 7064 - protein, 234 aa, Neisseria meningitidis
MLRLVLAASLSAVSFPAAAEALNYNIVEFSESAGVEVAQDTMSARFQVTAEGRDKNAVNAEFVKKFNKFIRKSKNGSFKTELVSRSAMPRYQYTNGRRIQTGWEERAEFKVEGRDFDELNRFIADIQADAALEYTDFHVSRERRNEVIDQVSKDAVLRFKARAEKLAGVLGASGYKIVKLNLGHIGSHIAGGGAAQAKMLRAMPMAASVNMEGADSAAPGVEEISISVNGTVQF

SEQ ID NO: 7065 - protein, 188 aa, Neisseria meningitidis
MSIKSDKWIRRMSEEFGMIDPFEPNQIKEADGKRIISYGTSSYGYDIRCANEFKIFTNINSTIVDPKNFDPKNFVTVEDDCCIIPPNSFALARTVEYFRIPRNVLTVCLGKSTYARCGIIVNVTPFEPEWEGYVTLEFSNTTPLPAKIYAGEGVAQVLFFESDEICETSYKDRNGKYMGQTGVTLPKA

SEQ ID NO: 7066 - protein, 138 aa, Neisseria meningitidis; identical to SEQ ID NO: 2806

SEQ ID NO: 7067 - protein, 299 aa, Neisseria meningitidis
MWFKQISFYPLNKEKLPEADVLADKLAEAEFTHCQGLDWFSEGFTAPVSFSPELVFPADFTLRVALKKEEKVLPAGVIRDILEEKVAEIQNNEARNVGRKEKQELKEQITDDLLPRAFTRSSRTEAVFNTRHGYLLVNNAASAKAENILTKLREALGGLEASLPNTKQSPSSLMTGWLLQGHCEGGFELDSDCELKGTGDIVPVVKVSKQDLTADEVVQHVKNGKTVTQLGLVWREQIAFILTQDFTLKRIQYLDVLQEEAESNGDDAAGLAFASQILMAESVSTMLEELVSYLGGWQD

SEQ ID NO: 7068 - protein, 485 aa, Neisseria meningitidis
MKPTIALVGRPNVGKSTLFNRLTRTKDALVHDLPGLTRDRHYGHGKVGSKPYLVIDTGGFEPVVDSGILHEMAKQTLQAVDEADAVVFLVDGRTGLTPQDKIIADRLRQSPRPVYLAVNKGEGGNRAVLAAEFYELALGDPYVISGAHGDGVYYLIEDILEKFPEPEAEEADARHPVFAVIGRPNVGKSTLVNAILGEERVITFDMAGTTRDSIHIDFEREGKPFTIIDTAGVRRRGKVDEAVEKFSVIKAMQAVEAANVAVLVLDAQQDIADQDATIAGFALEAGRALVVAVNKWDGISEERREQVKRDINRKLYFLDFAKFHFISALKERGIDGLFDSIQAAYNAAMIKMPTPKITRVLQSAIERQQPPRAGLVRPKMRYAHQGGMNPPVIVVHGNSLHAISDSYTRYLTQTFRKAFNLQGTPLRIQYNVSENPYENAEDKPKKKPLRRVSLSNRIEKREGRKEEKNRFKKKTKVSVKKQFSK

SEQ ID NO: 7069 - protein, 209 aa, Neisseria meningitidis; identical to SEQ ID NO: 2794

SEQ ID NO: 7070 - protein, 431 aa, Neisseria meningitidis
MAQKIQSVKGMNDLLPVKQKDFKLTAAFWQAFEDTVGRWTRAYGYQQIRTPIVEQTGLFVRSIGEETDVVGKEMYTFSDSNDSLSLSLRPEGTASCLRAVVEHNLLYNSPQKLWYMGPMFRRERPQKGRYRQFHQVGIEALGFEGPDIDAEIIAMSADLWEKLGIREYLTLEINSLGNREERAAHRAALVEYLTRYEDKLDEDSKRRLKTNPLRVLDTKNPDLQEICNAAPRLVDYLGEDSQNHYVRFKAMLDGLGIQYIENPRLVRGLDYYNQTVFEWTTDKLGAQATVCGGGRYDGLIEELGGKPAPSIGFAMGIERLLLLVSEYGSLEVNAAPDVYAMHQGEGADLQVMKYAQALRAQGFNVMQHSGYQSLKAQMKKADNSGARFALIVAQDELANGTVTLKDMNGAHGQQTVAAEDLTPTLQQWKNA

SEQ ID NO: 7071 - protein, 218 aa, Neisseria meningitidis; identical to SEQ ID NO: 3894

SEQ ID NO: 7072 - protein, 155 aa, Neisseria meningitidis
MQIDNISDEQVVIVRMSCYLKKDEIFKNIERYGYQSSDIKKISPPFPLNILPVPKPYYFYLYDTHLNQIYDLAWSCNDFLMFEIFILDRESIKYIDKDKLFKSRETLYSNFKSIKNQCKNYFFCGFDFDAPYFKSGVSQVADYNFVPDAFSLFFI

SEQ ID NO: 7073 - protein, 58 aa, Neisseria meningitidis
MGEYLEFEESGTKITVEIGSAWHFNETIRNINTHLRGTKLPGSNWRVQDKGHFHLWKR

SEQ ID NO: 7074 - protein, 66 aa, Neisseria meningitidis
MQLICADWTGIGNFMKTFEKTWSAQYRDMEISVRNFWNLERTGAEVYINGRRVYHNEAEMASASLR

SEQ ID NO: 7075 - protein, 125 aa, Neisseria meningitidis
MSFGYLIATSQPCELLTKSRGETFSLIMDKMDLWIYFRFCEGNIYTIRKNETESCLTERGGEWLKHIYEFNRGSFIFSYVLLKKRESEENFTEIVLKSIKNNKILTVKVRSGLHFDLRNIYRIEM

SEQ ID NO: 7076 - protein, 85 aa, Neisseria meningitidis
MDDVYRAFDSVGNILNFRIVEKEQKGFWVSTKIKTVVFDSADMSSDDLFLKCLQSSYKAYFETEPAGLDKRQLMKTLIQKCGFSC

SEQ ID NO: 7077 - protein, 181 aa, Neisseria meningitidis; identical to SEQ ID NO: 176

SEQ ID NO: 7078 - protein, 39 aa, Neisseria meningitidis
MTIFKLLDLQSDLPIEIGCATYVLSRALIFQPCNPKELL

SEQ ID NO: 7079 - protein, 90 aa, Neisseria meningitidis
MFAVIFFSTLGCILAWIRDIPKIKSKKILARSLYIIGIINVIISYVLIKNILVSVSDGGGIKYVAIYLSNLFFWTVLMYVLVKRLSKKPS

SEQ ID NO: 7080 - protein, 96 aa, Neisseria meningitidis
MDDLILYFLSGIFGNQVAEYIIKNNREIKVPFIVLYAIFFTLIYTVALLFLSLIYWVNGAEIAWKGIGIFSMSVSFCIVFCLYLIDKAGRCKDKKQ

SEQ ID NO: 7081 - protein, 157 aa, Neisseria meningitidis
MKKQITAAVMMLSMIAPAMANGLDNQAFEKYVFHTQADAPMQLAELSQKEMKETEGAFLPIVAGALMGGAISAWANHGISKIKTGQFASTRSTLAATAGGMIGGGYSSAMLRGAGITTSVFARSAWKGGNAIPNAVIRANGAALNQSSSAAMGKHRR

SEQ ID NO: 7082 - protein, 289 aa, Neisseria meningitidis; identical to SEQ ID NO: 2800

SEQ ID NO: 7083 - protein, 307 aa, Neisseria meningitidis
MKKRNNPLPLLNGVKPSYLVLPHEKQFYGLPLLHFLCIRFPFVGADDWRRRLNSGFVVGSDGAALDEHSLFEPGKVVFYYRETSRESEPRIPFEEKILHIDEHLIVVDKPHFLPVIPSGRFLRETLLTRLRLRPELQHLNVEDITPLHRLDKDTAGVMLLSHNPATRGAYQTMFQNKTVWKTYEALAPTRTDLPYPLDVVSRLVRGEKFFTTQEAEGEPNAHTTVELIENRGEFSLYRLTPHTGKKHQLRVHMMGLGMPLLNDALYPVPSEAGSEDYRKPLKLLAKKIAFADPLSGRERVFCSGFCL

SEQ ID NO: 7084 - protein, 213 aa, Neisseria meningitidis
MLKPETIHISGPAGILETIHIPSEQVPARGVAVINHPNPLQGGTNTNKVIQTAAKALSKLGFHCYLPNLRGVGGSGGTHDYGRGETQDCLAVIDYARAQHPEAPEFALSGFSFGGYVATFAAQARTPDLLLLIGAAVCHYTDRPEPSAVPNVAKTLMIHGAEDEVVEIGKALKWAEPQDLPVITIAGSTHFFHGKLIVLRDTILRFAPVCLNG

SEQ ID NO: 7085 - protein, 263 aa, Neisseria meningitidis
MARHPYRRLRPAKSGFPEVGISEEGNIRSLHLGSDTVQSSMNLDHPSELVLSYSRAMMGWLLFTDALPQHITQIGLGGGSFARWIDTYLPDTRQTAVDINPQVIAIARNLFELPFEGEKFEIIEADGAEYIKVFRHNTDVILVDGFDGEQIIDALVEEPFFRDCRNALSSDGIFVTNWWSGDKRYQRFIERLLSVFEGRVLELPAESHGNVAVMAFQSSPKEQNIDKLKKRADKLSNAYGLDFHRMLAGLKASNPNNGKHFHL

SEQ ID NO: 7086 - protein, 263 aa, Neisseria meningitidis
MITVNTLQKMKAAGEKIAMLTAYESSFAALMDDAGVEMLLVGDSLGMAVQGRKSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDDAGAAVVLMECVLAELAKKVTETVSCPTIGIGAGADCDGQVLVMHDMLGIFPGKTAKFVKNFMQGHDSVQAAVRAYVAEVKAKTFPAAEHIFAD

SEQ ID NO: 7087 - protein, 278 aa, Neisseria meningitidis
MQIIHTIRELRAWRKNAGKVAFVPTMGNLHEGHLALVREAKKRADSVVVSIFVNRLQFGQGEDFDKYPRTLQQDADKLAAEGIAVVFAPDEKELYPNVEQRYNVEPPNLQNELCGKFRPGHFRGVATVVSKLFHIVSPDIACFGKKDYQQLAVIKGFVEDLNFDVEIVPVDTGRAEDGLALSSRNQYLSAAERDEAPRLYRELKAVAESLVQGSLDYAGLEKRAVQSLTEYGWVVDYVEIRRADTLEVARAGDKKLVVLAAACLGTTRLIDNLEIKLP

SEQ ID NO: 7088 - protein, 614 aa, Neisseria meningitidis; identical to SEQ ID NO: 42

SEQ ID NO: 7089 - protein, 193 aa, Neisseria meningitidis; identical to SEQ ID NO: 3820

SEQ ID NO: 7090 - protein, 281 aa, Neisseria meningitidis
MNIADGRQAFSAPAKLNLDLRITGRREDGYHNIESIFCLIDLQDTVYLKPRDDGKIILHNPVDGMPQEVDLSYRAASLLQKYARNPAGVEIWLDKKIPTGAGLGGGSSDAATVLLVLNRWWQCGLTQRQLIDSGAALGADVPFFIFGKNAFARGIGDRLDEMDIPKQWYVIVKPPVHVSTAKIFTHESLTRNSASSIMPTFQNLQPFRNDMQAVVFKEYPEVWKAYSELSRYGFALMTGSGACVFTACQDRNSAYNIYRQVSDLYEAYLAEGLSKHPLLSV

SEQ ID NO: 7091 - protein, 327 aa, Neisseria meningitidis
MAAYDSLMVFTGNANPELAQRVVRHLDISLGNASVSKFSDGEVAVELLENVRGRDVFILQPTCAPTNDNLMEILTMADALKRASAGRITTAIPYFGYARQDRRPRSVRVPISAKLVANMLYSAGIDRVLTVDLHADQIQGFFDIPVDNIYATPILLNDIKQQRIENLTVVSPDIGGVVRARAVAKSLNADLAIIDKRRPKANVAEVMNIIGDIQGRTCLIVDDMIDTANTLCKAAVALKERGAERVLAYASHAVFSGEAVSRIASSEIDQVVVTDTIPLSEAAKNCDRIRQVTIAGLLAETVRRISNEESVSYLFNEEVMTGSMLLP

SEQ ID NO: 7092 - protein, 190 aa, Neisseria meningitidis
MTYEIQASVREAQGTGASRRLRREGQIPGILYGEGQEPVAIAVDHKTVFYALEKESFHTALIKLSLNGETKDVIVRDFQMHPFRREVQHIDFQAVKADQLVRIRVPLHIVNAENSQAVKLQGGRVSLLNTSVEVVALPANIPAFLDLDCAEVVAGDILHLSDIKLPEGVESVSLKRNENLAVATVTGKKR

SEQ ID NO: 7093 - protein, 389 aa, Neisseria meningitidis; identical to SEQ ID NO: 2610

SEQ ID NO: 7094 - protein, 508 aa, Neisseria meningitidis
MNTPLPYSDYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSHGGEVVLRGVSYNDAYDYAMELAEKEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGNETFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGDDEKAHIFVGLQAAGPQDLAVIGSRLDEAGLPNVDLTNNEIAKIHIRYMVGGRTDKVENERLVSFEFPERPGALARFLNHMQGGWNITLFHYRNHGADYGRILVGIDVPPHDAAAFDGFLESLGYSYHEETQNAAYKLFLA

SEQ ID NO: 7095 - protein, 357 aa, Neisseria meningitidis
MSITIQNLNKHFGNFHALKNINLNVPTGKLVSLLGPSGCGKTTLLRIIAGLENADGGNILFDGQDVTAKHVRERKVGFVFQHYALFRHMNVFDNVAFGLTVLPKSERPSKGQIRAKVEELLKLVQLSHLAKSYPHQLSGGQRQRIALARALAVEPKLLLLDEPFGALDAKVRKELRTWLRDIHHNLGVTSILVTHDQEEALEVSDEIVVMNHGKIEQTGSAEAIYRKPENAFVTEFLGETDAFEGRIEKGFWHYNGFAWKLDAQYKWQEQTATGYIRPHEWQIAAEHETPMICAEIEKIHAVGALTHILVKHDKQDVHITLAGSDAARYPIAEGKELKLIPKQVYVFSQNELIEYSI

SEQ ID NO: 7096 - protein, 286 aa, Neisseria meningitidis
MKPYSANPNLTEPRRLRVLLIAAALGFLLLMLVVPLVAVFYEALKGGWDLYLKSLNDPEAWSAIKLTLITALIVVPVNAVLGVAMAWLLTRFDFRGKQLLTTLLDLPFSVSPVVAGLMFVLLFGAHTALGGWLEAQGIQIIFAIPGIVLATLFVTFPFVAREIIPLMQAQGDSEEQAALILGASGWQMFWRVTLPNIKWALLYGIILTNARAMGEFGAVSVVSGHIRGETNTVPLLVEIFYNEYNFTGAFALSGVLALLALATLAVQNIITKLQDKKLAAAERNAI

SEQ ID NO: 7097 - protein, 278 aa, Neisseria meningitidis
MLALKTPGVLPGFKLSLGLTVLCLSLLVVLPFAMMAAKAAEIGWGGFWNTIAEPNVLAAVWLSLRMSFYAMLTNVVFGTLVAWVLVRYEFPGKGLANALVDLPFALPTAVTGIALATLYAPNGWIGRFFEPLGIKIAFTPVGIWIALVVVSLPFIVRAVQPVLEELSGEYEEAAATLGASRWTTFRRVLLPEITPALLTGAGMMFARATGEYGSVIFIAGNIPMVSEILPLIITGKLEQFDVQGASAVALFMLLVSFVILFALNVMQWALGRRSGAKG

SEQ ID NO: 7098 - protein, 110 aa, Neisseria meningitidis
MQILSFQPDIAERMLEGTEGESVNENAQFVRTDNGYWIAWHEGVAALLAPDMPPGIPCFWVEGAESLEELCVMVERGEFDEVEEFDGDDDEWLETAQGCGHHGDACACGH

SEQ ID NO: 7099 - protein, 169 aa, Neisseria meningitidis
MTMILSILSLFFIIRLLFLAVSIKHEKALIAKGAKQYGKTNSTLLAAVHTLYYLACFVWVWLSDTAFNGISLIGTLTVMASFVILSLIIKQLGEIWTVKIYILPNHQINRSWLFKTFRHPNYFLNIIPELIGIALLCQAWYVLLIGLPIYLLVLFKRIRQEEQAMATLF

SEQ ID NO: 7100 - protein, 195 aa, Neisseria meningitidis
MEHKLPQLPYELDALSPHLSKETLEFHYGKHHQTYITNLNNQIKGTEFENLPLEEIVKKSSGGVFNNAAQTWNHTFYWLGFTSKGQGKPAGELAAAIDAKWGSFEKFQEAFNACAAGTFGSGWAWLVKTPAGGLDLVSTSNAATPLTTENTPLLTCDVWEHAYYIDYRNSRPNYLKGFWEIVNWDEVAKRFAALS

SEQ ID NO: 7101 - protein, 468 aa, Neisseria meningitidis
MNDYAAMPSEDREVGALSLPPHSMEAEQSVLGGLMLENPAWDRIADVVSGEDFYRHEHRLIFRSIAKLINESRPADVITVQEDLQRNEELEAAGGFEYLITLAQNTPSAANIRRYAEIVRERSIMRQLAEVGTEIARSAYNPQGRDAGQLLDEAENKVFQIAESTAKSKQGFLEMPDLLKEVVQRIDMLYSRDNPDEVTGVPTGFIDLDKKTSGLQPGDLIIVAGRPSMGKTAFSINIAEHVAVEGRLPVAVFSMEMGGAQLVMRMLGSVGRLDQSVLKTGRLEDEHWGRLNEAVVKLSDAPVYIDETPGLTALELRARARRLARQFNNKLGLIVIDYLQLMAGSGRSDNRASELGEISRSLKALAKELQVPIIALSQLSRTVESRTDKRPMMSDLRESGAIEQDADLIMFMYRDEYYNQDSPMKGLAECIIGKHRNGPVGKIFLTWTGQFTKFDNAAYIPEEAKIED

SEQ ID NO: 7102 - protein, 222 aa, Neisseria meningitidis
MCTRKQQGFTLTELLIVMVIAAIMAMIALPNMSQWIASRRIASHAERIANLLRFSRGEAVRLNLPVYICPVQVKKDGTPNNKCDSGKKGQGMLAFGDKNGNKGYDNDTEDVLLRSVVLNDDINDKRINYAFNHIAFGQTQPTTDRVVWTFNQNGTFGYTKDQHLTKQSSFFYSDGYIQIVLTDAKAVSADEKKFRSAVVLINSSGRVEVCPRGDRRTMCQYK

SEQ ID NO: 7103 - protein, 204 aa, Neisseria meningitidis
MNMKNNDCFRLKDSQSGMALIEVLVAMLVLTIGILALLSVQLRTVASVREAETQTIVSQITQNLMEGMLMNPTIDSDSNKKNYNLYMGNHTLSAVDGDFAIDAMKTKGQLAEAQLKRFSYELKNALPDAAAIHYAVCKDSSGNAPTLSGNAFSSNCDNKANGDTLIKVLWVNDSAGDSDISRTNLEVSGDNIVYTYQARVGGRE

SEQ ID NO: 7104 - protein, 313 aa, Neisseria meningitidis; identical to SEQ ID NO: 1938

SEQ ID NO: 7105 - protein, 197 aa, Neisseria meningitidis; identical to SEQ ID NO: 1948

SEQ ID NO: 7106 - protein, 162 aa, Neisseria meningitidis; identical to SEQ ID NO: 340

SEQ ID NO: 7107 - protein, 79 aa, Neisseria meningitidis
MTDFRLGSFIGKSRNRSAVIPTKVGIQFFEFQSFPINCLSIECLDSRLRGNDEPIRTETCTASFPRKWESSFLSFSHFQ

SEQ ID NO: 7108 - protein, 140 aa, Neisseria meningitidis
MLIGLLPWALILGMQGGQKGMSWLEMLLMTSMNFAGGSEFATVNLWAEPLPILLIATVTFMINSRHILMGAALAPHLKGIPLKKAVPALFFMCDESWAMAFSEIQKRKAAGLPAFNMPFYSGLTKTSTALPRLSSKKTIL

SEQ ID NO: 7109 - protein, 150 aa, Neisseria meningitidis
MNIEVEMKVLDERMADVVPVYATEGSAGLDLRACLDEEVVLQPGETFLVPTGLAIYLANPAYAAVLLPRSGLGHKHGIVLGNLVGLIDSDYQGELKVSLWNRSSEPFTVKPFERIAQMVVVPIVQAGFKRVEEFVGSSRGEGGFGSTGSH

SEQ ID NO: 7110 - protein, 395 aa, Neisseria meningitidis
MNTLLNQLKPYPFARLREAMQGISAPEGLEAVPLHIGEPKHPTPKVITDALTASLHELEKYPLTAGLPELRQACANWLKRRYDGLTVDADNEILPVLGSREALFSFVQTVLNPVSDGIKPAIVSPNPFYQIYEGATLLGGGEIHFANCPAPSFNPDWRSISEEVWKRTKLVFVCSPNNPSGSVLDLDGWKEVFDLQDKYGFIIASDECYSEIYFDGNKPLGCLQAAAQLGRSRQKLLMFTSLSKRSNVPGLRSGFVAGDAELLKNFLLYRTYHGSAMSIPVQRASIAAWDDEQHVIDNRRMYQEKFERVIPILQQVFDVKLPDASFYIWLKVPDGDDLALARNLWQKAAIQVLPGRFLARDTEQGNPGEGYVRIALVADVATCVKAAETIVSLYR

SEQ ID NO: 7111 - protein, 259 aa, Neisseria meningitidis
MFFVLSPAKNLNEKDPAPVSEFTQPDLLAESDILMQQLRELAPQQIAELMHVSDKIALLNAQRNAEWNTPFTPENAKQAVFMFNGDVYEGMDANTLDIGQIRYLQNHVRLLSGLYGLLRPLDLIQPYRLEMGTAFANLRGKNLYEFWGDIITNLLNDTLAQAGSNTLVNLASQEYFKSVNTKKLRARLITPIFKDEKNGKYKIISFYAKRARGLMVRYAAEHHITDPEMLKNFNYEGYAFNDAASNESEWVFMRSEQIK

SEQ ID NO: 7112 - skipped

SEQ ID NO: 7113 - protein, 126 aa, Neisseria meningitidis
MPLKFQPRERSVIMCDFRGYEEPEMVKKRPVVVIARNRHNGKLVTVVPLSSTEPVPLADYHHKMSGNPLPDKPHIQCWAKCDMTATVGLARLDRYKPKGRDRCIPIISEEDFQAIKTAVAKAFKLY

SEQ ID NO: 7114 - protein, 62 aa, Neisseria meningitidis
MGSRARATGDDKPSVRVMGRGMRPLSYLQTPTNPQSAFQSRLFWTNPPLPPPVPVWLSLCPP

SEQ ID NO: 7115 - protein, 118 aa, Neisseria meningitidis
MAERNNAALQEAITIVNGLAKTDGCILATYTSDTPDKKKDREAILTVLNQREFVCAGVLGGALHEKMYKDFEYSMLLRDWDNLSSFIFEIRRIRSAPTAFQEFEAVARKWKKKPLKTK

SEQ ID NO: 7116 - protein, 305 aa, Neisseria meningitidis
MNVSVLNFGNTPVSFRQDGFLNATAIASHFGKLPKDYLKSEQTQQYISALAENLSVRRKILTEANQIVIVKRGGSEQGTWLHPKLAIHFARWLNPKFAVWCDEQIEILLNGKISDGIKTVTPKPTRALPDGLTGEQIEAVKKLHNALTKSAPKEAQARIAITLWSAVKSKFGCSYKEVPAEQFPEVLSVMGRVAVENGVLYGEVLDREPLPAPQPALPISGNALYDLAVAVRYGAWAIQMGRDVSLPLKQLGCKQAVTMWTVWAETRSRLKAAANALEALNAHADAEHAAKIRPMLPEIRNLSSV

SEQ ID NO: 7117 - protein, 94 aa, Neisseria meningitidis
MAFHHGRRCRITPLPETESLQESKKMNINELGARIDRPTIRELIAYATCRNRPISNSTLLRMEKDGRIPCRLKTPLTSPVWDTREVLEALGLQQ

SEQ ID NO: 7118 - protein, 63 aa, Neisseria meningitidis
MNTNQDTIPFGGNLVICCSTGNGGDGRFSCLITDQIPDLNLVRSGQAFPMFIYEYETREKRKA

SEQ ID NO: 7119 - protein, 97 aa, Neisseria meningitidis
MNFQEENENIKNDIEINLLHSAEADSVEAMMDLAVYGLAAMVAKHNKTRGEQLVLQAIAGHMRKLLAALPETESLVQTGKVYRRLEDLIFKTYLPEQ

SEQ ID NO: 7120 - protein, 86 aa, Neisseria meningitidis; identical to SEQ ID NO: 926

SEQ ID NO: 7121 - protein, 71 aa, Neisseria meningitidis
MTITEEYSIDIRVTSEQGKNDYGYPTERYGCDIINTDGELLVGIEPEYKTPFAAVRKALICLTKDNLKNAA

SEQ ID NO: 7122 - protein, 284 aa, Neisseria meningitidis
METQENMIKTALQAAQKPFFEFAPNNTPLVFTPDQDGGWRYKSHPELMQNPYRKCGKFLMHDTASLIKFVQKHKQDGTQIYIDADFKSGRIDVTAVINGHTQQAPGWLDFYAVYTPQHTTSASNWLNNNAHRMNQMEFSHFLTNNARNIVSKNPGNENSVYPTAAEVLDFALNLEYTEKTTFKQGYREQDGRINFTFQSEDSGQTEKNLKMFERFGIEFTPHQGGASYFVEALLKFRIDKNSGALVLWYELQQIDAVIEQAAKDISEAVQKAFPEIDIYFGVIA

SEQ ID NO: 7123 - protein, 119 aa, Neisseria meningitidis
METQEKKFVPASKQIPTVNSGWLDRELGEAMSEAVRACLAHGKQSEITVKLKIQPQNIQSGTVKISHDVATKLPKEKREGGIVFATPDGNIQADDPAQGKLKLKQVSNTSSTLKMVRSN

SEQ ID NO: 7124 - protein, 66 aa, Neisseria meningitidis
METITIPKENFDALLNLARTAVALNENFIPKINYGASTIPAAGFAALNEFGIARSTVESLEILKIK

SEQ ID NO: 7125 - protein, 174 aa, Neisseria meningitidis
MLLLRRDNIDRAFKIVKNRRFDSPWWPGEYDAGMNFLGVQGELKVHELHHRTATLCFEWLGEVSAPRRKENYKDLKPNVLYDFDGSGKHFANPDARYLLPVGSSGLILKHIQIDDEDTLLRLWCARNIPMPHRLSKIPMLRQYYLSKAWHEIYAINQHLRKTKLIVDVAYDPTD

SEQ ID NO: 7126 - protein, 238 aa, Neisseria meningitidis
MTMHETTDRLFEIAKEQGVLKPADIAERLNISQQALKNWESRGIAAKALPEVAKAFGVSETWLRTGEGSRTAPVLIDPDLPHEVKDIHRPMTWSSNDPLPDDDYVFVPYLKESCFKGGVGTYEIPDYNGYRLPFGKSTLKRKGINPDNVFCCTLTGDSMEEKIAEDAAIAVDTGETAIRDGKIYAFAQDGMFRVKYLIRQPGNSVLIRSHNSGFYGDENAPLDSLTVIGRVFWWSVLD

SEQ ID NO: 7127 - protein, 321 aa, Neisseria meningitidis
MSHTQLTQGERYHIQYLSRHCTVTEIAKQLNRHKSTISREIRRHRTQGQQYSAEKAQRQSQTIKQRKRQPYKLDSQLIQHIDPLIRRKLSPEQVCAYLRKHHQITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRTLKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLIH

SEQ ID NO: 7128 - protein, 208 aa, Neisseria meningitidis
MGTHRFPTQQPATQPDTDRNQEKRQNRVSARAASLRSSEMDILLKYWKPVGVLLLIVLIFTAWHFDRAEKYRMGREAAAAEISNRLKDGYIEQAKQARSAEQKAAAAFAERQTKLEEEKQNAEKTVAAMRLELNRLRHYAAAQNRNRNLPATATAATASDGASDSQGWLLFGQCAEKYAGLAETADGHAADLREWQAYGHAVSSQRAE

SEQ ID NO: 7129 - protein, 115 aa, Neisseria meningitidis
MYIPDKGDIFHLNFDPSSGKEIKGGRFALALSPKAFNRATGLVFACPISQGNAAAARSSGMISTLLGAGTETQGNVHCHQLKSLDWQIRKASFKETVPDYVLDDVLARIGAVLFD

SEQ ID NO: 7130 - protein, 78 aa, Neisseria meningitidis
MLRVQKWGNSAAVRLPADMLKQLDFKIGDALVAEVHNGELRVRAARRFRLADLLAEMEETPPRVEGWEILDDAGNEVV

SEQ ID NO: 7131 - protein, 163 aa, Neisseria meningitidis; identical to SEQ ID NO: 3532

SEQ ID NO: 7132 - protein, 46 aa, Neisseria meningitidis
MRVLMAGKVRKQIKQGGWLSVIALTSLFVSVFTLFYIFRHSVQFNL

SEQ ID NO: 7133 - protein, 122 aa, Neisseria meningitidis
MIDGELVALIHQTVLADEAGLKGRADMARLDGALSRIANWRQYENLEDIYEIAALYAQAIAKAHAFPDGNKRTALLTMLTYLDLQGISIAADQGLDDLIVSLAAGETDFKQLAETLRRLDKE

SEQ ID NO: 7134 - protein, 43 aa, Neisseria meningitidis
MQNQNTRPVKIELKGEAGKRVLLAAARRIAKTHQKAVKALADK

SEQ ID NO: 7135 - protein, 319 aa, Neisseria meningitidis
MSTFFQQTAQAMIAKHIDRFPLLKLDQVIDWQPIEQYLNRQKTRYLRDHRGRPACPLLSMFKAVLLGQWHNLSDPELEHSLITRIDFNLFCRFDELSIPDYSTLCRYRNRLAQDDTLSELLELINRQLTEKGLKVEKASAAVVDATIIQTVGSKQRQAIEVDEEGQVSGQTTLSKDKNARWTKKNSLYKLGYKQHTRTDAEGYIEKLHITPANAHECKHLSPLLEGLPEGTTIYADKGYDSAENRQHLEEHQLQDGIMRKACRNRPLTETQTKRNRYLSKTRYVVEQSFGTLHRKFRYARAAYFGLICARCRLKGSPDA

SEQ ID NO: 7136 - protein, 741 aa, Neisseria meningitidis
MTQKSTIVYTHTDEAPALATQSLLPIVQAFARHADIDVKTSDISLSGRILAAFPEYLTEAQRVPDALAELGELVKQPDANVIKLPNISASVPQLTAAIKELQSKGFAVPDYPADPQTDEEKAVRERYDRIKGSAVNPVLREGNSDRRAPKAVKNFAKKNPHSMGAWTKDSKTHVATMQSGDFFHNEQSVIVPEATSVSIVFTDKQGNKKELREPVALKAGEIIDATVMSKKALLAFLAEQVKDAKAKGVLFSLHMKATMMKVSDPIIFGHAVKVFFAPVFEKFGDKLAAAGVNVNNGFGNLLANLDKLDADTRTAVEAEIAAVYAANPDLAMVDSDKGITNLHVPSDVIVDASMPAMIRNSGRMWDKNGKAQDTKAVIPDSSYAGVYQATIDFCREHGAFDPTTMGTVPNVGLMAQAAEEYGSHNKTFEIEADGQVQVIDAAGKVLMQHDVEAGDIWRMCQTKDAPVKDWVQLAVNRARLSNTPAVFWLDENRPHDKSLLAKVKAYLAELDTNGLDIRVLAPEEAAKFSLGRLKNGEDTISVTGNVLRDYLTDLFPILELGTSAKMLSIVPLMNGGGMFETGAGGSAPKHVQQFLEENHLRWDSLGEFLALAVSFEHLAQKTGNAKAQVLADTLDAATEKLLLNDKSPKRKAGELDNRGSHFYLTLYWAQELAAQDKDAELKAAFTPLAAALTADEAKIVAELSAVQGKAADIGGYYAANPEKAAQVMRPSVTFNQALNAL

SEQ ID NO: 7137 - protein, 66 aa, Neisseria meningitidis
MPPHIRHSTSDRRQTRENHFPLPFTPPRSNTPRSNKARTKPPKYAIIATHIPRAMCSKRKNQPTRE

SEQ ID NO: 7138 - protein, 371 aa, Neisseria meningitidis
MGLKKACLTVLCLIVFCFGIFYTFDRVNQGERNAVSLLKEKLFNEEGEPVNLIFCYTILQMKVAERIMAQHPGERFYVVLMSENRNEKYDYYFNQIKDKAERAYFFHLPYGLNKSFNFIPTMAELKVKSMLLPKVKRIYLASLEKVSIAAFLSTYPDAEIKTFDDGTGNLIQSSSYLGDEFSVNGTIKRNFARMMIGDWSIAKTRNASDEHYTIFKGLKNIMDDGRRKMTYLPLFDASELKTGDETGGTVRILLGSPDKEMKEISEKAAKNFKIQYVAPHPRQTYGLSGVTTLNSPYVIEDYILREIKKNPHTRYEIYTFFSGAALTMKDFPNVHVYALKPASLPEDYWLKPVYALFTQSGIPILTFDDKN

SEQ ID NO: 7139 - protein, 152 aa, Neisseria meningitidis
MKTQISLAAAAITLLLSACGGSGIPSQPKGEISENRTAAFKSMMPEFTRMGKMVKDEEPYDVEKFKQAAASFAESSKKPFTLFESDPQGNGRALPAVWSDGAKFEAEKTKFAAAVEKLNAAAQTGKLDEIKAAYGETGASCKSCHDSFRAPE

SEQ ID NO: 7140 - protein, 273 aa, Neisseria meningitidis
MAVLITGASAGFGEAMCRAFVGAGYRVIGAARRADRLQALADELGALFYPLEMDVSRRESVENALNGIPDEFSDIDCLINNAGLALGLDTADKADFEDWETMIQTNVLGLTFLTRKILPQMVERGGGYVMNLGSIAGNYAYAGSNVYGATKAFVRQFSLNLRAELADKNIRVTNIEPGLCGNTEFSNVRFKGDDERAAGVYEGVEFIRPEDIAETALWLYQRPAHMNVNTIEIMPVAQTFAGMKVIKKAVPEVREDFEKQSMSLFSRIRSWFK

SEQ ID NO: 7141 - protein, 148 aa, Neisseria meningitidis
MQHEEGNRQRPQGELLLRTVAMPRDTNPNQDIFGGWIMSQMDLGGGILAAEIARGRIVTVAVQEMNFIRPVKVGNVVCCYGHCVRVGNTSLQLKVDVWVKTLMNDCVTEDRYLVTEAVFTYVAIDAEGNPRPIPKEGNPKLAGLLPTP

SEQ ID NO: 7142 - skipped

SEQ ID NO: 7143 - protein, 310 aa, Neisseria meningitidis
MYEIKQPFHSGYLQVSEIHQIYWEESGNPDGVPVIFLHGGPGAGASPECRGFFNPDVFRIVIIDQRGCGRSRPYACAEDNTTWDLVADIEKVREMLGIGKWLVFGGSWGSTLSLAYAQTHPERVKGLVLRGIFLCRPSETVWLNEAGGVSRIYPEQWQKFVAPIAENRRNRLIEAYHGLLFHQDEEVCLSAAKAWADWESYLIRFEPEEVDEDAYASLAIARLENHYFVNGGWLQGDRAILNNIGKIRHIPTIIVQGRYDLCTPMQSAWALSKAFPEAELRVVQAGHRAFDPPLVDALVQAVEDILPHLL

SEQ ID NO: 7144 - protein, 398 aa, Neisseria meningitidis
MPSEPFGRHNATNTLISITQDDTMTHIKPVIAALALIGLAACSGSKTEQPKLDYQSRSHRLIKLEVPPDLNNPDQGNLYRLPAGSGAVRASDLEKRRTPAVQQPADAEVLKSVKGVRLERDGSQRWLVVDGKSPAEIWPLLKAFWQENGFDIKSEEPAIGQMETEWAENRAKIPQDSLRRLFDKVGLGGIYSTGERDKFIVRIEQGKNGVSDIFFAHKAMKEVYGGKDKDTTVWQPSPSDPNLEAAFLTRFMQYLGVDGQQAENASAKKPTLPAANEMARIEGKSLIVFGDYGRNWRRTVLALDRIGLTVVGQNTERHAFLVQKAPNESNAVTEQKPGLFKRLLGKGKAEKPAEQPELIVYAEPVANGSRIVLLNKDGSAYAGKDASALLGKLHSELR

SEQ ID NO: 7145 - protein, 291 aa, Neisseria meningitidis
MLQGSLVALITPMNQDGSIHYEQLRDLIDWHIENGTDGIVAVGTTGESATLSVEEHTAVIEAVVKHVAKRVPVIAGTGANNTVEAIALSQAAEKAGADYTLSVVPYYNKPSQEGIYQHFKTIAEATSIPMIIYNVPGRTVVSMTNDTILRLAEIPNIVGVKEASGNIGSNIELINRAPEGFVVLSGDDHTALPFMLCGGHGVITVAANAAPKLFADMCRAALQGDIALARELNDRLIPIYDTMFCEPSPAAPKWAVSALGRCEPHVRLPLVPLTENGQAKVRAALKASGQL

SEQ ID NO: 7146 - protein, 463 aa, Neisseria meningitidis; identical to SEQ ID NO: 2522

SEQ ID NO: 7147 - protein, 250 aa, Neisseria meningitidis
MANQRPIYGFHAVNARLWQNPKSIVELYIQEGKSDARTREVLEKAANENIRVYFADADRLNAISKGARHQGVVGFIDASKNHVHLEDVLENLSEPPLLLILDGITDPHNLGACLRTADAMGVHAVIAPKDKSAGLNATVSKVACGAAETVPYITVTNLARTLRELKEYGIWIIGTDMSGESDLYHCNLPDSAAWVMGNEGDGMRRLTREHCDMLVSIPMFGTVESMNVSVSAGMVLSETRRQRVLKNEKV

SEQ ID NO: 7148 - protein, 162 aa, Neisseria meningitidis; identical to SEQ ID NO: 2516

SEQ ID NO: 7149 - protein, 239 aa, Neisseria meningitidis
MLTTPPLAPKTVAALHRLGIRTLEELRQNGSVKAFLLLKASGLTLTKSTLWQLESLLDGTPPQEMSQAHKARLLAELKNHPPVAAFPPQEEMEHFMCEALRQAEQSSADGEIPVGAVIVSDGKIIASAHNTCIADCNVSRHAEINALAQAGREIQNYRLDGCDIYITLEPCAMCASALIQARIRRVIYGAAEPKTGAAGSIVNLFADKRLNTHTAIRGGILQEECRAVLSRFFQNKRKG

SEQ ID NO: 7150 - skipped

SEQ ID NO: 7151 - protein, 313 aa, Neisseria meningitidis
MPTPKAFALLGPTAGGKTALALKIAETLPVEIISLDSALVYRDMDIGTAKPSASERAFVPHHLIDIIPPTESYSAARFVEDCTRLVGEISSRGRFALIVGGTMMYFRALTQGLNDLPEADACLRADLDEQKQMYGLDFLYRTLQKVDPETACRLKPNDSQRIGRALEVYYLTGKPMSTHLGSLTSHTLPFDLHTAALIPENRARLHENIALRFHLMLEQGFIGEVENLRRRYPGLTAYSPAIRCVGYRQAWKYLDGKTDFPAFVEKGIAATRQLAKRQLTWLRKTPLDCVADPFSDCTSCTRLIEAAKRFFGA

SEQ ID NO: 7152 - protein, 434 aa, Neisseria meningitidis
MDILVLRVDVPKEGFARKLGAHETVFAADDGAVGKVQQLVEVLLRHERDFDEADGCRLKNIAVVLQGILRNNAALFEAVDDLRPRQQQCHRAACLSPHFQPLCPNIAPIAEKQPFGGVFFGQHQPLSQGFSIETDGFAVITFAYQPAAFFAETHKPKIFLNTLLRRRHQMQPFIAFLRAQIFPIQPKRLVSADNVQHIFGQVAGKSFDDDIGNRRGINICRIGMPSADMNILMNAGNIGQIRAKRTQGGHIVRPQMHLPTEFAVQNTGEPPRNADVAEIVDDLAKNPTDKRRSIHRNNGNGLKRAKIVEQIHNQQNNRNKQQHSLTFQIKLLFQMMLDGVEKDEFKQKRRFAGKDDAVDQMLEFVFGRIGGENGKRRQRDEADGKPADKQVSGHCKAFKKAKRHYRPKRTPCLTDAPEMPSEALPQENAAPPNL

SEQ ID NO: 7153 - protein, 186 aa, Neisseria meningitidis
MKTAQELRAGNVFMVGNDPMVVQKTEYIKGGRSSAKVSMKLKNLLTGAASETIYKADDKFDVVILSRKNCTYSYFADPMYVFMDEEFNQYEIEADNIGDALKFIVDGMEDQCEVTFYEGNPISVELPTIIVREVEYTEPAVKGDTSGKVMKTARLVGGTEIQVMSYIENGDKVEIDTRTGEFRKRA

SEQ ID NO: 7154 - protein, 278 aa, Neisseria meningitidis; identical to SEQ ID NO: 3282

SEQ ID NO: 7155 - protein, 193 aa, Neisseria meningitidis
MNLRDDLQLIYDRIPEGSRVLDLGCGDGELLAALVEHKKCSGYGIEIDTNSVIAAMSRGVNVIQADLEEGLTAFNDQSFDVIVLSQTIQAMQNTEKILRCLMRVAKQAIVSFPNFGYWRNRVQIALGGHMPVSERMPYHWYDTPNIHWCTLKDFDLLCAKNNIRILERAVMTGNRQVKHFPNLLGSLAFYRVG

SEQ ID NO: 7156 - protein, 379 aa, Neisseria meningitidis
MSQNASVGIVMPQKIPFEMPLVLENGKTLPRFDLMIETYGELNAEKNNAVLICHALSGNHHVAGRHSAEDKYTGWWDNMVGPGKPIDTERFFVVGLNNLGGCDGSSGPLSINPETGREYGADFPVVTVKDWVKSQAALADYLGIEQWAAIVGGSLGGMQALQWTISYPERVRHALVIASAPKLSTQNIAFNDVARQAILTDPDFNEGHYRSHNTVPARGLRIARMMGHITYLAEDGLGKKFGRDLRSNGYQYGFGVEFEVESYLRYQGDKFVGRFDANTYLLMTKALDYFDPAADFGDSLTRALQNVKAKFFVASFSTDWRFAPERSHELVKALIAAQKSVQYIEVKSAHGHDAFLMEDEAYMRAVAAYMNNVYKECQQ

SEQ ID NO: 7157 - protein, 41 aa, Neisseria meningitidis
MQVLSSLKTAKQRHRDCQIVRRRGKVYVICKSNPRFKARQR

SEQ ID NO: 7158 - protein, 91 aa, Neisseria meningitidis
MKPNIHPDNYRTVLFFDSSANEGWLIRSCAETHGKTMVWTDGKEYPLFSLDTSSASHPVYTGKQRNVNTEGRASKFNQRFQSVMSSFRKDK

SEQ ID NO: 7159 - protein, 292 aa, Neisseria meningitidis
MNYAKEINALNNSLSDLKGDINVSFEFFPPKNEQMETMLWDSIHRLQTLHPKFVSVTYGANSGERDRTHGIVKRIKQETGLEAAPHLTGIDASPDELRQIAKDYWDSGIRRIVALRGDEPAGYEKKPFYAEDLVKLLRSVADFDISVAAYPEVHPEAKSAQADLINLKRKIDAGANHVITQFFFDVERYLRFRDRCVMLGIDVEIVPGILPVTNFKQLGKMAQVTNVKIPSWLSQMYEGLDDDQGTRNLVAASIAIDMVKVLSREGVKDFHFYTLNRSELTYAICHILGVRP

SEQ ID NO: 7160 - protein, 758 aa, Neisseria meningitidis
MTTLHFSGFPRVGAFRELKFAQEKYWRKEISEQELLAVAKDLREKNWKHQVAANADFVAVGDFTFYDHILDLQVATGAIPARFGFDSQNLSLEQFFQLARGNKDQFAIEMTKWFDTNYHYLVPEFHADTEFKANAKHYVQQLQEAQALGLKAKPTVVGPLTFLWVGKEKGAVEFDRLSLLPKLLPVYVEILTALVEAGAEWIQIDEPALAVDLPKEWVEAYKDVYATLSKVSAKILLSTYFGSVAEHAALLKALPVDGLHIDLVRAPEQLDAFADYDKVLSAGVIDGRNIWRANLNKVLETVEPLQAKLGDRLWISSSCSLLHTPFDLSVEEKLKANKPDLYSWLAFTLQKTQELRVLKAALNEGRDSVAEELAASQAAADSRANSSEIHRADVAKRLADLPANADQRKSPFADRIKAQQAWLNLPLLPTTNIGSFPQTTEIRQARSAFKKGELSAADYEAAMKKEIALVVEEQEKLDLDVLVHGEAERNDMVEYFGELLSGFAFTQYGWVQSYGSRCVKPPIIFGDVSRPEAMTVAWSTYAQSLTKRPMKGMLTGPVTILQWSFVRNDIPRSTVCKQIALALNDEVLDLEKAGIKVIQIDEPAIREGLPLKRADWDAYLNWAGESFRLSSAGCEDSTQIHTHMCYSEFNDILPAIAAMDADVITIETSRSDMELLTAFGEFQYPNDIGPGVYDIHSPRVPTEAEVEHLLRKAIEVVPVERLWVNPDCGLKTRGWKETLEQLQVMMNVTRKLRAELAK

SEQ ID NO: 7161 - protein, 54 aa, Neisseria meningitidis
MNKYRLKAFQTVFCPDLRRKGAVAGKSFHCSLFFSNSALYVGNRQIGVVFDSFK

SEQ ID NO: 7162 - protein, 245 aa, Neisseria meningitidis
MALQDRTGQKVPSVVFRTRVGDTWKDVSTDDLFKGKKVVVFSLPGAFTPTCSSSHLPRYNELFGAFKENGVDAIYCVSVNDTFVMNAWAAEEESDNIYMIPDGNGEFTEGMGMLVGKEDLGFGKRSWRYSMLVNDGVVEKMFIEPEEPGDPFKVSDADTMLQFVAPDWKAQESVAIFTKPGCQFCAKAKQALQDKGLSYEEIVLGKDATVTSVRAITGKMTAPQVFIGGKYIGGSEDLEAYLAKN

SEQ ID NO: 7163 - protein, 467 aa, Neisseria meningitidis
MKKIQADVVVIGGGTAGMGAFRNARLHSDNVYLIENNVFGTTCARVGCMPSKLLIAAAEARHHALHTDPFGVHLDKDSIVVNGEEVMQRVKSERDRFVGFVVADVEEWPADKRIMGSAKFIDEHTVQIDEHTQITAKSFVIATGSRPVILPQWQSLGNRLIINDDVFSWDTLPKRVAVFGPGVIGLELGQALHRLGVKVEIFGLGGIIGGISDPVVSDEANAVFGEELKLHLDAKTEVKLDADGNVEVHWEQDGEKGVFVAEYMLAAVGRRPNVDNIGLENINIEKDARGVPVADPLTMQTSIPHIFIAGDASNQLPLLHEAADQGKIAGDNAGRYPNIGGGLRRSTIGVVFTSPQIGFVGLKYAQVAAQYQADEFVIGEVSFKNQGRSRVMLVNKGHMRLYAEKATGRFIGAEIVGPAAEHLAHLLAWAHQMKMTVPQMLDMPFYHPVIEEGLRTALRDADAKLKA

SEQ ID NO: 7164 - protein, 125 aa, Neisseria meningitidis
MSAKPRPVYLDLPNIRLPIPGIVSILHRISGVGLFIMLPFLLYFLSGTLSQESAFETYRAIVSHPLVKLVLIGVLWAYLHHSLAGIRFLFLDAHKGLELNTARNTAKAVFASALVLTVVLGALLW

SEQ ID NO: 7165 - protein, 113 aa, Neisseria meningitidis; identical to SEQ ID NO: 1096

SEQ ID NO: 7166 - protein, 587 aa, Neisseria meningitidis; identical to SEQ ID NO: 1052

SEQ ID NO: 7167 - protein, 235 aa, Neisseria meningitidis
MEKMSFEIYRYNPDVDAKPYMQRYELELEPTDVKLLDALVRLKAQDDTLSFRRSCREGICGSDGMNINGKNGLACLTDLRGLKQPVKIRPLPGLPVIRDLIVDMTQFFKQYHSVKPYVVNDNPIDADKERLQTQEERKELDGLYECILCACCSTACPSFWWNPDKFVGPSGLLNAYRFIADSRDTITNERLDNLNDPYRLFRCHTIMNCVDVCPKHLNPTRAIGKIKEIMLKRAV

SEQ ID NO: 7168 - protein, 82 aa, Neisseria meningitidis
MMVFDDIAKRKIRFQTRRGLLELDLIFGRFMEKEFEHLSDKELSEFSEILEFQDQELLALINGHSETDKGHLIPMLEKIRRA

SEQ ID NO: 7169 - protein, 27 aa, Neisseria meningitidis
MRHLKSACRQISKCKSRLKAKNVLRMQ

SEQ ID NO: 7170 - protein, 427 aa, Neisseria meningitidis
MSKSIKLNVPGQAGLELPVLEASIGHDVVDIRGLTKNTGLFSFDPGFVSTASCESKITYIDGDQGLLYYRGYPIEQLAEKSDYLEVCYLLIYGELPTPEQKAEFDNTVRRHTMVHEQLTWFFRGFRRDAHPMAMMVGVVGALSAFYQDSLDISNPEHRKIAIYRLISKIPTIAAMCYRYSNGLPFNYPKNNLSYSENFLHMMFATPCEDYKPNPVLARALDRIFILHADHEQNASTSTVRLAGSSGANPFACIAAGIACLWGASHGGANEAVLKMLDEIGDVSNVAAYMEGVKQRKYRLMGFGHRVYRNMDPRASIMRETCYEVLKELGLEDSPKFKLAMELEQIALKDPFFIERKLYPNVDFYSGIVLSALGIPTEMFTVIFALSRSVGWISHWHEMISDPSLKIGRPRQLYTGSERRDYVPPGER

SEQ ID NO: 7171 - protein, 942 aa, Neisseria meningitidis
MMDEKLNFSYLFGSNAPYIEELYEAFLENPDAVDEKWKQYFTDLSKQPGTVAVDVAHTPIRESFVTLAKKKIASAVAGGADEAMLKKQVSVLRLISAYRIQGVGAAQLDPLKRIPPRDIEALDPKFHGLSDADMALQFNMGEGDFANRGKLPLSQIISNLKQTYCGHIALEYIYIPNTEERRWVRNYFESVLSTPHYNADQKRRILKEMTAAETLERYLHTKYVGQKRFGVEGGESAIAGLNYLIQNAGKDGVEEVIIGMAHRGRLNVLVNILGKKPGDLFAEFEGRAEIKLPSGDVKYHMGFSSDIATPHGPMHVSLAFNPSHLEIVNPVVEGSARAKQKRLGENGRDKVLPVLIHGDSAFIGLGVNQATFNLSKTRGYTTGGTVHIVINNQIGFTTSDIRDTRSTVHCTDIAKMVSAPVIHVNGDDPERVCFAIQAALDYRKKFHKDIVIDVVCYRKWGHNEGDDPTLTQPMMYKKVSQHPGARALYTEQLIAEGVVTQAEADGYIQAYRDALDKGEHVEQTTLSNFQRTQIDWSKYQGKDWREHIETGLPAADIERLTEKFTAVPEGFALHPTAKRVIEARKAMASGKQAIDWGMAETLAYASLVTKGHGVRISGEDSGRGTFSHRHAVLHDQKREKWDDGTYVPLRHMGEGMGEFLVIDSILNEEAVMAFEYGFACSAPDKLTIWEAQFGDFANGAQVTIDQFLSSGETKWGRLCGLTTILPHGYDGQGPEHSSARVERWLQLCSENNMQVIMPSEASQMFHLLQRQVLGSYRKPLVIFMSKRLLRFKGAMSPLENFTEGSTFRPVIGDTAERASNDSVKRVVLCAGQVYYDLEAGRAERKLEDDVAIVRVEQLYPFPYDEVKAELAKYPNAKSVVWAQEEPKNQGAFYQIRHRIEDVISEEQKLSYAGRPSSASPAVGYSSKHIAQLKQLVEDALAL

SEQ ID NO: 7172 - protein, 393 aa, Neisseria meningitidis
MIIDVKVPMLSESVSEGTLLEWKKKVGEAVARDEILIDIETDKVVLEVPSPQAGVLVEIVAQDGETVVADQVLARVDTAATAAAEAPAAAPAEAAPAAAPAATQNNAAMPAAAKLAAETGVDVNALQGSGRDGRVLKEDVQNAAAKPAGAAAPAVALPAGARPEERVPMSRLRARVAERLLASQQENAILTTFNEVNMKPIMDLRAKYKEKFEKEHGVKLGFMSFFVKAAVAALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPARLLLDL

SEQ ID NO: 7173 - protein, 477 aa, Neisseria meningitidis
MSQYDVVVIGAGPGGYVAAIRAAQLGFKTACVDAGVNKAGNAPALGGTCLNVGCIPSKALLQSSEHFHAAQHEFAEHGITVGDVKFDAAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALEFFASSEDIARIIHAHPTLSEVVHEAALAADKRALHG

SEQ ID NO: 7174 - protein, 95 aa, Neisseria meningitidis
MNKEIVGIFFIPAGIISMCMAALWQMYVMMTETYTLNRFKDKELVWRVALLFISFSLAVYLLCPNSRKKGIVFFILGGGGAAMYLLARMWLPFSK

SEQ ID NO: 7175 - protein, 388 aa, Neisseria meningitidis
MNLHEYQAKELLASYGLPVQGGILAHNGEEAAAAYDKLGGKFAVVKAQVHAGGRGKAGGVKVVKSREEAKEVAESLIGTNLVTYQTDANGQPVNSVLVCEDMYPVQTELYLGAVVDRSTRRITFMASTEGGVEIEKVAAETPEKIFKVTVDPLVGLQPCQAREVAFQLGLKDKQINEFVKLMTGAYKAFVENDFALFEVNPLAVRENGALACVDGKIGIDSNALYRLPKIAELRDKSQENERELKASEFDLNYVALEGNIGCMVNGAGLAMATMDIIKLKGGQPANFLDVGGGATKDRVVEAFKLILEDKSVQGVLINIFGGIVRCDMIAEAIVAAVKEINVNVPVVVRLEGNNAELGAKILNESGLKLTSADGLNDAAEKIVAAVNA

SEQ ID NO: 7176 - protein, 296 aa, Neisseria meningitidis
MSVLINKDTKVLVQGFTGKNGTFHSEQALAYGTKVVGGVTPGKGGQTHLNLPVFNTMKEAVKETGADASVIYVPAPFVLDSIVEAVDSGVGLVVVITEGVPTLDMLKAKRYLETNGNGTRLVGPNCPGVITPGECKIGIMPGHIHTPGRIGIISRSGTLTYEAVAQTTKLGLGQSTCIGIGGDPIPGMNQIDALKLFQEDPDTDAIIMIGEIGGTAEEEAAEYIQSNVSKPVVGYIAGVTAPKGKRMGHAGAIISGGKGTAEEKFAAFEKAGIAYTRSPAELGTTMLEVLKAKGLA

SEQ ID NO: 7177 - protein, 531 aa, Neisseria meningitidis; identical to SEQ ID NO: 3530

SEQ ID NO: 7178 - protein, 949 aa, Neisseria meningitidis
MCNHHPQHSHDNDTIRIRGARTHNLKNIDLDIPRHKLVVVTGLSGSGKSSLAFDTLYAEGQRRYVESLSAYARQFLQMMDKPDVDLIEGLSPAISIEQKSTSHNPRSTVGTVTEIHDYLRLLYARVGTPYCPEHKLPLSSQTVSQMVDAVLKLPEDTRVMILAPTVRERKGEFVDFFADLQAQGFARVRVDGEVYQLDEVPKLEKNIKHNIDVVIDRVKVKADIKQRLAESFETALRHGNERALAMEMDSGEEHWFSARFACPVCSYSLPELEPRLFSFNNPMGSCPTCDGLGNTNFFDPEKVVAHPELSLATGAIDGWDKRNQFYFQMIQSLARHYGFDVQAAWETLPEKVKKVVLHGSGKEVIDFTYLSERGTTFNRSHAFEGIIPNLERRYRETDSETVREKLREYQNHRACPSCGGARLRKEARYVYVSGEPLHEVSAWPLTKTHQFFETLDLDGNKKQIAEKILKEITERLGFLINVGLDYLNLSRSAETLSGGEAQRIRLASQIGSGLTGVMYVLDEPSIGLHQRDNDRLLATLKRLRDLGNSVIVVEHDEDAIREADFVVDMGPGAGEHGGNVLIADTPENVAQCENSVTGQYLSGKKSIAVPSERTPVNPDRMLVLKGARGNNLKNVTLELPLGLITCITGVSGSGKSTLINDTLAKITARELNRAQEEPAPFDDIHGLEHLDKVINVDQSPIGRTPRSNPATYTGLFTPIRELFAGVPLSRERGYNVGRFSFNVKGGRCEACQGDGVIKVEMHFLPDVYVPCEVCHGKRYNRETLEIQYKGKNISQVLDMTVEEAREFFDAVPTVSRKLQTLMDVGLGYIRLGQSATTLSGGEAQRVKLALELSKRDTGRTLYILDEPTTGLHFADIALLLEVIGRLKGKGNSIVIIEHNLDVIKTADWIVDLGPEGGDGGGRIIAKGSPEQVAKVKGSYTGKYLKVVLR

SEQ ID NO: 7179 - protein, 265 aa, Neisseria meningitidis
MNRLYPHPIIAREGWPIIGGGLALSLLVSICCGWWSLPFWVFTVFALQFFRDPAREIPLNPEAVLSPVDGRIVVVERARDPYRDVDALKISIFMNVFNVHSQKSPADCTVTKVVYNKGKFVNADLDKASTENERNAVLATTASGREITFVQVAGLVARRILCYTQAGAKLSRGERYGFIRFGSRVDMYLPVDAQAQVAIGDKVTGVSTVLARLPLTAPQTESEPESEPALQTAPVETAANPSAEQRQIEAAAAKIQAAVQDVLKD

SEQ ID NO: 7180 - protein, 758 aa, Neisseria meningitidis; identical to SEQ ID NO: 1586

SEQ ID NO: 7181 - protein, 90 aa, Neisseria meningitidis
MRPREPGAEPRVLTSTPFCHLFDRSGTCRFYALINFGYPAAEHNGQTQRNLRQHQPRPRRTADTNGHRPMPQPFHLKNFCLCPLSVLKIL

SEQ ID NO: 7182 - protein, 196 aa, Neisseria meningitidis
MLLFIDNYDSFTYNIVQYFTELGQEVAVRRNDDITLEEIEALNPQYLVIGPGPCSPKEAGISVAAMRHFAGRLPIMGVCLGHQTIGEAFGGRIVRAKTLMHGKVSPVSHSGKGMFKGLPNPVTCTRYHSLVIDRNTMPECLEVTAWTEDGEIMGVRHKEYAVEGVQFHPEALLTEHGHDMLNNFLIEFQNFKPQKI

SEQ ID NO: 7183 - protein, 352 aa, Neisseria meningitidis
MITPQQAIERLISNNELFYDEMTDLMRQIMRGQVLPEQIAAILTGLRIKVETVSEITAAAAVMREFATKVPLENAEGLVDIVGTGGDGAKTFNISTTSMFVAAAAGAKVAKHGGRSVSSSSGAADVVEQMGANLNLTPEQVAQSIRQTGIGFMFAPNHHSAMRHVAPVRRSLGFRSIFNILGPLTNPAGAPNQLLGVFHTDLCGILSRVLQQLGSKHVLVVCGEGGLDEITLTGKTRVAELKDGKISEYDIRPEDFGIETRRNLDEIKVANTQESLLKMNEVLEGREGAARDIVLLNTAAALYAGNVAASLSDGISAAREAIDSGRAKSKKEEFVGFQPQQRCHFLGKMELG

SEQ ID NO: 7184 - protein, 29 aa, Neisseria meningitidis
MIMELLWQNISTSRRELTKLFLYKNLGLY

SEQ ID NO: 7185 - protein, 57 aa, Neisseria meningitidis
MLPIIRKKVKPDGIVYTDTFRSYDVLDISEFSHLRKFNGIPKEHLGLHLKKCQWHFK

SEQ ID NO: 7186 - skipped

SEQ ID NO: 7187 - protein, 96 aa, Neisseria meningitidis; identical to SEQ ID NO: 6701

SEQ ID NO: 7188 - protein, 65 aa, Neisseria meningitidis; identical to SEQ ID NO: 6700

SEQ ID NO: 7189 - protein, 94 aa, Neisseria meningitidis; identical to SEQ ID NO: 6699

SEQ ID NO: 7190 - protein, 92 aa, Neisseria meningitidis; identical to SEQ ID NO: 6698

SEQ ID NO: 7191 - protein, 105 aa, Neisseria meningitidis
MNKPFITQAQLALYKYQPSSKYFGQSMAVIAQSEFVEFAKINKSENVIDCFSFFWNRRIKHDIWLISFSDNSEMVIKESLKDGHKIYKFEFCEIVDNCNFDDVFV

SEQ ID NO: 7192 - protein, 131 aa, Neisseria meningitidis; identical to SEQ ID NO: 6696

SEQ ID NO: 7193 - protein, 157 aa, Neisseria meningitidis
MTMQVFLTIPGYDVEAEIEKFVWMDAVIWQMPGWWMHEPWTVKKYIDGVLTAGHGKLYQSDGRHSVNPTEGYGTGGLLQGKKHMLSLTWNAPIEAFTREGDFFEGKGVDVLYMHFHKANEFLGMTRLPTFLCNDVVKNPQVEKYLADYQAHLEKVFG

SEQ ID NO: 7194 - protein, 461 aa, Neisseria meningitidis
MSSGLVTAAYIVAAILFIFSLAGLSKQETAKQGCYSGIAGMAVALFVTVFSDNTHGLGWIIIAMLIGAAIGIYKAKKVEMTEMPELIALLHSFVGLAAVLVGFNSYIAPGNVSHDMHTIHLVEVYLGIFIGAVTFTGSLVAFGKLNGKISSSPLQLPAKHKLNALALAVSFVLLLVFVGIDGSGFILLIMTLIALAFGWHLVASIGGADMPVVVSMLNSYSGWAAAAAGFMLSNDLLIVTGALVGSSGAILSYIMCKAMNRSFVSVIAGGFGSDSGTLSSGSQEIGEYREVKAADIAEMLKGANNVIITPGYGMAVAQAQYPVAEITELLRKNGTEVRFGIHPVAGRLPGHMNVLLAEAKVPYDIVLEMDEINDDFPETDVVLVIGANDTVNPAAQTDPNSPIAGMPVLEVWKAKEVVVFKRSMNTGYAGVQNPLFFNENSVMCFGDAKKTVDDILSELKK

SEQ ID NO: 7195 - protein, 127 aa, Neisseria meningitidis; identical to SEQ ID NO: 1628

SEQ ID NO: 7196 - protein, 513 aa, Neisseria meningitidis; identical to SEQ ID NO: 1622

SEQ ID NO: 7197 - protein, 277 aa, Neisseria meningitidis
MPHALVLQFPSAAALPSDFPLRLPEPDCADEKRMRFIVEEGFSLSEKDAALLGSRQIDHAVLPDMDFDELGLIVSDMDSTLITIECVDEIAAGVGLKNKVAEITERSMRGELDFEQSLRSRVALLAGLDERVLADVYENVLKLSPGAEFLLDECKRHDVKFLLVSGGFTFFTERLQQRLGFEYQHANVLEIENGRLTGRLKGRIIDAQAKADLLREYRSRLGLQPHQVLAVGDGANDIPMLKEAGIGVAYRAKPKARAAADACINFGGLERVRGLFG

SEQ ID NO: 7198 - protein, 380 aa, Neisseria meningitidis
MHFIQHTAYGYGADGVYTSFREGVAQASGMRRVAVLTLCGAVAGSGWWLLKRFGKPQIEIKAALKQPLQGLPFLTTVFHVLLQIITVGLGSPLGREVAPREMTAAFAFAGGKRLGLDEGEMRLLIACASGAGLAAVYNVPLASTLFILEAMLGVWTQQAVAAALLTSVIATAVARIGLGDVQQYHPANLTVNTSLLWFSAVIGPILGVAAVFFQRTAQKFPFIKRDNIKIIPLAVCMFALIGVISVWFPEILGNGKAGNQLTFGGLTDWQHSLGLTAVKWLVVLMALAVGAYGGLITPSMMLGSTIAFAAATAWNSVFPEMSSESAAIVGAAVFLGVSLKMPLTAIAFILELTYAPVALLMPLCTGMAGAVWVAKKMGFK

SEQ ID NO: 7199 - protein, 526 aa, Neisseria meningitidis
MSSIKRALISLSDKTGAVEFAQTLHKLGVEILSTGGTAKLLADAGVPVIEVADYTGFPEMLDGRVKTLHPKIHGGILGRRDLDEHVAKMEEHGIGNIDLVCVNLYLFAATIAKPNCTLEDAIENIDIGGPTMVRSAAKNWKHVAIVTDTADFPAIAAELEANNGALSDKTRFNLSRKAFSHTAQYDGMISNYLTSLSDDVLSGTPEIAGFPGRFNQSWIKVQDMRYGENPHQRAAFYRDIDPAAGSLAAYKQLQGKELSYNNIADADAAWEAVKSFDVPACVIVKHANPCGVAIASNTLDAYKLAYATDTTSAFGGIIAFNREVDGATVKQITDNQFMEVLMAPKFTAEALEIAAAKKNVRVLEVPLEAGANRFELKRVGGGLLVQTPDIHRISRADLKVVSKRQPTEQEWNDLLFVWNVAKYVKSNAIVFGKGGQTYGIGAGQMSRVDSTRIAARKAQDAGLDLNGACAASDAFFPFRDGVDVIAEQGIKAIIHPAGSMRDQEVFDAADEHGIAMVVTGIRHFRH

SEQ ID NO: 7200 - skipped

SEQ ID NO: 7201 - protein, 165 aa, Neisseria meningitidis
MSVRFAKNIGLILYIVFYGFEMRRALIAKIKIAQKELGLDDGTYRAVLERVTGKRSCADMDVSELESVVADMRSHGFKPKAKGNPHGKPHLRRTSSAAMLDKVEALLTVGGKHWNYAHAMARRMFGKDKVEYLDDTQLHKLVAALQIAENRKTEKAGGDDGVRKS

SEQ ID NO: 7202 - protein, 143 aa, Neisseria meningitidis
MMGFEKVEHLLPDTVLDIVDVIGLAATEQLVKAIGGARFKFGKGKVDTERLAILVEAIGEVKTHELLQVYGGEELYVPRCGKALIQLRNHRFYQEFVKLRDIDKKSGLMAMTKLCPKYGISSRTGYTIINEMSRPAAQQAALF

SEQ ID NO: 7203 - protein, 181 aa, Neisseria meningitidis
MGKTVTLTAGHSNTDPGAVNGSDREADLAQDMRNIVASILRNDYGLTVKTDGTGKGNMPLRDAVKLIRGSDVAIEFHTNAAANKTATGIEALSTPKNKRWCQVLGKAVAKKTGWKLRGEDGFKPDNAGQHSRLAYAQAGGIVFEPFFISNDTDLALFKTTKWGICRAIADAIAMELGAAKV

SEQ ID NO: 7204 - protein, 67 aa, Neisseria meningitidis
MKKSLIALCVAHCAKLKNDFGVPPLPEIKITPSPVRVGSLKQHPSLRLGKSGVAAAKRAARKRKNRR

SEQ ID NO: 7205 - protein, 54 aa, Neisseria meningitidis
MGQVAFYEKMIGLWSAKSREASEQADLAAFEFAEGELANYREMLKRHLQTKSVE

SEQ ID NO: 7206 - protein, 134 aa, Neisseria meningitidis; identical to SEQ ID NO: 3436

SEQ ID NO: 7207 - protein, 370 aa, Neisseria meningitidis
MSTFFRQTAQAMIAKHINRFPLLKLDQVIDWQPIEQYLNRQKTRYLRDHRGRPAYPLLSMFKAVLLGQWHSLSDPELEHSLITRIDFNLFCRFDELSIPDYSTLCRYRNWLAQDDTLSELLELINCQLTEKGLKVEKASAAVIDATIIQTAGSEQRQAIEVDEEGQISGQTTPSKDSDARWIKKNGLYKLGYKQHTRTDAEGYIEKLHITPANAHECKHLSPLLEGLPEGTTVYADKGYDSAENRQHLEEHQLLDGIMSKACRNRPLSEVQTKRNRYLSKTRYSGLNLNQDKATKPQTVQIVRQGEATPYWFKFNPLYVVEQSFGTLHRKFRYARAAYFGLIKVSAQSHLKAMCLNLLKAANRLSAPAAA

SEQ ID NO: 7208 - protein, 591 aa, Neisseria meningitidis; identical to SEQ ID NO: 896

SEQ ID NO: 7209 - protein, 56 aa, Neisseria meningitidis
MAQYMCGPCGWIYDEEHGDPEHGIAPGTKFEDIPDDWKCPECGVGKEDFYLLDFVI

SEQ ID NO: 7210 - protein, 363 aa, Neisseria meningitidis
MNAQTLIANVAEFVKTKLKPIVDDIDRKGYYPEAFMRELGAIGGFGAVGTEAEGGNGLGLATQIAVLREIGKECGATSFSAWCQAACAWYLHQTPNRAVKDKYLADILQGKVLAGTGMSNTVKHLADIEKHNLQAERVEGGYTVNGALPWVSNIGEDHIWANTAQIGDGYVMFITGGQWEGVSLQNCPEFCALEGTRTFSLNFKDVFIPDEDIIAAPEQFADYIQSIKAGFILLQIGIGAGVIDGSLGIIRLANVVNAEVNNYLNDGYDSLKTRLDGAWAETERLAGLAWSGTPDNLATLKLREAAAVLALAAAQSAALHSGAKGYLMRSPAQRRVREAMFVAIVTPAIKHLRKEIAAIEAAK

SEQ ID NO: 7211 - protein, 227 aa, Neisseria meningitidis
MPSEKCSDGISYNLLFAAHNQSVFPIPFRNAYHAPVPNICEQGKKMARLTVHTLETAPEAAKARVEAVLQNNGFIPNLIGVLSNAPEALAFYQEVGKLNAANSLTAGEVEVIQIIAARTNQCGFCVAGHTKLATLKKLLSEQSVKAARALAAGEFDDAKLGALAAFTQAVMAKKGAVSDEELKAFFDAGYNQQQAVEVVMGVALATLCNYVNNLGQTEINPELQAYA

SEQ ID NO: 7212 - protein, 123 aa, Neisseria meningitidis
MKPYKIYTHPALPPQAVKQGWSWPGLLFGTLWACFKRMWGLGLGLTGAIFVLAVFAQLVYGDTPATDSAFNVLGLAVSVWFGAKGNSLYARHLLSRGYTELPETVEAANPQAALAQYFGRGGR

SEQ ID NO: 7213 - protein, 563 aa, Neisseria meningitidis
MSASQLLSRLTQTVGEKYIITDPAKTEQYRQGYRFGEGKALAVVRPGSILEMWKILQACVEADVIVITQAANTGLTGGSTPDGNDYDRDIVIVNTMRMNIIQTINNNEQVVCLPGSTLNQLELLLKPLGREPHSVIGSSCIGASVLGGVCNNSGGALVQRGPAYTEMALFAQINEEGRLELVNHLGIDLGNTPEEILTNLQGHHYQNKDITQDAGKGHDHAYCEHVRQVDEPTAARFNADPARHYEASGCAGKLMVFAVRLDTFPQEKQTAVFYIGTNDINELTDIRRAALGEFESLPVSGEYIHRHAFDIADVYGKDTFYVIKKFGTHQLPKLFDLKARVDRFGKKVSFLPKHFSDKAMQFVSKFLPDHLPKSMRDYRDKYEHHLILKMGGKGVDEARAFLKEYFAHHGGAFFECNAEETQAAMLHRFAVASAAIRYRAVHDDEVEDLVALDIALRRDDRDWFEKLPPEIDNKIIHKLYYGHFMCHVFHQDYIIKKGNDCMALEHEMLHLLDQRGAQYPAEHNVGHLYEAKPALKQFYRKLDPTNSFNPGVGKTSKKKNWAE

SEQ ID NO: 7214 - protein, 1277 aa, Neisseria meningitidis
MTTTTAPQRIREIPYNYTSYTDREIVIRLLGDEAWQILQDLRGQRKTGRSARMLFEVLGDIWVVVRNPYLVDDLLEHPKRRAALVREMRHRLNEIRKRRDDNRQVDVLVAAAEKAVERFDSSFDETSQKRRQILERLSKITKPHNIMFDGLARVTHVTDATDWRVEYPFVVVNPDTEAEIAPLVRALIELDLVIIPRGGGTGYTGGAIPLDANSAVINTEKLDKHRGVEYVELAGLDGKHPIIRCGAGVVTRRVEETAHQAGLVFAVDPTSADASCVGGNVAMNAGGKKAVLWGTALDNLAYWNMVNPQGEWLRIERVRHNFGKIHDEETAVFDVHTLDSDGINIVKTERLEIPGHKFRKVGLGKDVTDKFLSGLPGVQKEGTDGIITSVAFVLHKMPKYTRTVCMEFFGTVATATPSIVEIRDFLLAHESVRLAGLEHLDWRYVRAVGYATKAAGKGRPKMVLLADVVSDDEAAVEAAAEHICELARARDGEGFIAVSPEARKTFWLDRSRTAAIAKHTNAFKINEDVVIPLERLGEYSDGIERINIELSIQNKLKLCAALEQYLSGKLPIDKMGTDLPTAELLGERGKHALAHVSAVKTRWEWLLANLDTPLADYKARYGAAVHAAPEAKNNESCFIAFRDFRLRVSVKADVMKPLSEIFSGKTDTKIIQGLGKIHAKTVRSRVFVALHMHAGDGNVHTNIPVNSDDAEMLQTAYRSVERIMKIARSLNGVISGEHGIGITKLEFLSDEEMQPFWDYKNQVDPKHTFNRHKLMKGSDLRNAYTPSFELLGAESLIMEKSNLGTIADSVKDCLRCGKCKPVCSTHVPRANLLYSPRNKILGVGLLIEAFLYEEQTRRGVSIKHFEELMDIGDHCTVCHRCVKPCPVNIDFGDVTVAVRNYLADSGHKRFAPAAAMGMAFLNATGPKTIKALRAAMIQIGFPAQNFAYKIGKLLPIGTKKQKAEPKATVGKAPIKEQVIHFINRPLPKNVPAKTPRSLLGIEDGKSIPIIRNPAAPEDAEAVFYFPGCGSERLFSQIGLAVQAMLWHVGVQTVLPPGYMCCGYPQDAGGNKAKAEEMSTNNRVAFHRMANTLNYLDIKTVVVSCGTCYDQLEKYRFEEIFPGCRIIDIHEYLLEKGVKLDGVKGQQYLYHDPCHTPIKTMNATQMASSLMGQKVVLSDRCCGESGMFAVKRPDIATQVKFRKQEEIEKNLKELPQGEPVKMLTSCPACLQGLSRYADDNNMPADYIVIEMAKYILGENWLDEFVKKANNGGVEKVLL

SEQ ID NO: 7215 - protein, 333 aa, Neisseria meningitidis
MIDRQTNEPKQKTRIILAPMQGLVDDVMRDLLTRIGGYDECVSEFVRITHTVHSRSIWLKYVPEIANGNKTFSGTPCTVQLLGSDADNMAANALEAVRFGANKIDLNFGCPAPTVNKHKGGAILLKEPELIFHIVKTLRGRLPAHIPLTAKMRLGYEDKSRALECACAIAEGGACGLTVHARTKAEGYEPPAHWEWIRKIRDSVNIPVTANGDVFSLQDYIGIKTISGCNSVMLGRGAVIRPDLARQIKQYENGGPVKDTDFAEVSKWIRQFFELCLTKEANNKYPLARLKQWLGMMKKEFAAAQNLFDRVRTVKDADEVRNILAEFEREMNT

SEQ ID NO: 7216 - skipped

SEQ ID NO: 7217 - protein, 190 aa, Neisseria meningitidis
MGKPGKSSRPSALLSARWQDIDLTARLWHIPAADMKTKHPFTVLLSDWAVEILRELHTQTGDNIHLFPGIRPRRKPAPHPDHISIKFAHNAIRRLGYDGSTPGKSKHTMHGFRHLFTNISLTAGKDTLTTDLALGHISRAALQRAGFSSLHHYLTADSYRLQERRELAEWYSRRHRQAYEAAAQNTCNKT

SEQ ID NO: 7218 - protein, 291 aa, Neisseria meningitidis
MNTEIEIIATDKVSNQAAMRSVLVMEQWGNGETYSEERWVERGRQAVRQTMEGMFELGRALIILKEHTEHGRFMEIVKSQFGLGIAETSRLMSATRRFATPQMQKAAPKLMDLGKSKLLELLVEEDVTLVGLAEGEEVNGMTFDDVDRMTVRELRVALRESRENLAAKDEVMKTKTAKIDELAEKLAKKQTVVREPKAEDVGSELAMQLTSLEVGIRSQVSRLKDLFDQLNAHSEAHGISHQAKMVGTLNQIILDCEQLRESYALPTEAPTDNVPEWLGGETGEGDESGND

SEQ ID NO: 7219 - protein, 98 aa, Neisseria meningitidis
MRMAESKRVQRLLRVFIALDEHPIIGLSNKDLSVGLGLTPSQVSRDIDDLVASGLVIKLENGNYAYGIKTLQIAERFRQQHERLQSKIAEIGKRVDVD

SEQ ID NO: 7220 - protein, 81 aa, Neisseria meningitidis
MINHECINQPYGRILKFSRVQAKEMLTADELKENFAKNGQTLAQWARENGFKPRDVYLVIGGQRKGNYGKGHEIAKKLGLK

SEQ ID NO: 7221 - protein, 74 aa, Neisseria meningitidis
MEKPLNFKPISYPQTRESAAGWFKRNGVCKAHWAKYFNLERTTVEHLLRGKLKGNFGKSHEAAVLLGMKEKSDD

SEQ ID NO: 7222 - protein, 59 aa, Neisseria meningitidis
MNTLKAHARQLMMDHIHPATRKSLFTLKQAKTLLLHNRPDVYRAKRPKNKHIISHERHK

SEQ ID NO: 7223 - protein, 123 aa, Neisseria meningitidis
MNNSSFFGNRLKEERKKLKMTQAEIAEKCGVSGRMWGDYERGISQPKAELFFQFEKVGIDVQYVMHGRRGETAVMPSETLNAEEQELLVLFREAAAADREMILMVARRAEKKAQTALGKVSNG

SEQ ID NO: 7224 - protein, 207 aa, Neisseria meningitidis
MDQFELCQKEHVNPFALSKQYLLVVTFVKSSSKNFQAALLWARSAKLFENLEIGKETIYCCAFDKTAEQAGMAGVFLNYIENWNGKQIYINGRIHSGSIYDLLGVLDCYQKSQSCPNPKSHCCFVSDDIFLWHGSRPTFEISLDLTGKKKETSSAKKFVMPCINFRHHRIEKETYLGNWNEQIAALAVKQNIDWCPSFDIENFRQYE

SEQ ID NO: 7225 - protein, 64 aa, Neisseria meningitidis
MNNYYLYRNCSSDVLWVKRIQRQIDGSLLLISDNSTYPPMPLALAEHPDIQIIGQVVQVSKDLN

SEQ ID NO: 7226 - protein, 187 aa, Neisseria meningitidis; identical to SEQ ID NO: 3578

SEQ ID NO: 7227 - protein, 315 aa, Neisseria meningitidis
MMIEKSISIVDGKEYSVFAVSHEFRYTFDEPILVADLISSLKAYETLTSSYLPAILNQLFDVKIQKIKVAVSEIERGSFLEKLIFNLFFKDEDAYNEFCLKIRKFLGTENQDGSINMSKIIMFAMTTLLGVGAGYLLFKNPPQEKQAITNNIVTVINADSSVALDGEHLVSVVKEVTGSSKQKTAENVAKVYAPASKNNGSITLGTDDVRIEPVAQQTVATLPKDVDLRDTPLTEDYTDIDVQIRATDRDKNSGWYAVIDQIVPSRVRLELPEDIDLNRLANNATIRANVTVEFDLKQNGSRKPKKIILTSLSTD

SEQ ID NO: 7228 - protein, 167 aa, Neisseria meningitidis
MSDKFNQFINRVLSHEGGYANHPKDPGGETNWGITKRTAQANGYNGSMRAMTREQAISIYRKAFWERYRADQMPEAVAFQFFDACVNHGYGNAARMLQRAAGVPDDGVIGAVSLKAINSLPENDLLLRFNAERLVFYTKLGTFTSFGKGWVRRVAQNLIHASADNTD

SEQ ID NO: 7229 - protein, 57 aa, Neisseria meningitidis
MSKKSLIALMTAAMQPDFSHSDLGIRYAMPTQGCWTQAHRKSGVAAAKRAAKKKRHK

SEQ ID NO: 7230 - protein, 197 aa, Neisseria meningitidis
MGKRRRSRHDLEVRAGGGRARMALVGLWRIGRRVCINQTRHRGDSAVGRNQKIRKSGRGAAMIEFVRAKKRLLWAFVLLLVWTCGYRYAADKAEAKQTALIATYRHSSMVAAEQYALQLKKAQDERQRWYDFSQKQGRKPVKKQYPPQTKKAGYLKTKEELLAELACLKAEMVALKKPDALIHGKEVRQKERNSSQG

SEQ ID NO: 7231 - skipped

SEQ ID NO: 7232 - protein, 201 aa, Neisseria meningitidis
MNTDFQNILKQLGKQAQKEAAEKQAAEKNKQKQEQDFDFSQAVGQLSPLKNRQQYYAPPDKTPIKVRPKDNRADEENYFYIGSTYNDPPASFSKNGQGKNDIQRLKNGYYPVVTDVDLHGYTQEEAQKVLNEFIAFTQKRGVCGEIIHGSGLGSKGYKPVLKNMTRNWLMQHPDVLAYAEPREGNDGCVRILLKRKLRQQD

SEQ ID NO: 7233 - protein, 351 aa, Neisseria meningitidis
MKTYAPALYTAALLTACSPAADSNHPSGQNAPANTESDGKNITLLNASYDVARDFYKEYNPLFIKTYQSEHPGTSVSIQQSHGGSSKQALSVANGLQADVVTMNQSSDIDLLEKKGLVEKGWQQALPDHAAPYTSTMVFLVRKNNPKQIRDWNDLAKDGVNIVIANPKTSGNGRYAFLGAYGYGLKTTNGNEQEAQKLVASILKNTPVFENGGRAATTTFTQRNIGDVLITFENEANYVSKKLTQGQFEIVYPSYTISAESPVAVVNSVVAKKGTQKTARAYLEYLWSEPAQELAASLYLRPRNPEVLARHKADFPDLDTFSPEKKFGGWDNIMKTYFADGGIFDRLTAQK

SEQ ID NO: 7234 - protein, 160 aa, Neisseria meningitidis
MSLLTLLRPATVQDCKDIFKVHLHSVQYTCILSYNEHALKVWEGLLNTESYLPTISDPDKALWVAEYKGNIQGFFQIDCQEAQLDALYVHPLFHNLGLGTALLHQAETIAHKSGLSFLKLYASLNSVPFYLLNRYESLGSAVLQLDPSIKIKCELMRKHL

SEQ ID NO: 7235 - protein, 378 aa, Neisseria meningitidis; identical to SEQ ID NO: 3114

SEQ ID NO: 7236 - protein, 181 aa, Neisseria meningitidis
MTYEKLYELRQTLRPTTKDGLYTDNEKNREILTVRWSGNTENPKNFSAVAIGINPSKANDERSDKTLTQLARFLDMYGFTNFKMLNIFSSYSTQQTGIRANTQTDFSKFKGCLEDADMIILAWGTDRGAYKDEKNRILEFLKAEKFMEKVFCISETGNSSDTRHPSRISYSYQLVQFEESA

SEQ ID NO: 7237 - protein, 491 aa, Neisseria meningitidis
MISKQEYQAQAAQGYNRIPLVQELLADLDTPLSLYLKLANRPYTYLLESVVGGERFGRYSFIGLPCSHYLKASGKHVDVYQNGEIVEQHDGNPLPFIEAFHNRFKTPEIPSLPRFTGGLVGYFGYETIYNFEHFAHRLKNTTKADPLGTPDILLMLSQELAVIDNLSGKIHLVVYADPSQPDGYERARERLEDIRTQLRQSCAIPLSLGSKHTEAVSEFGEEPFKACVNKIKDYIFAGDCMQVVPSQRMSMEFTDSPLALYRALRTLNPSPYLFYYDFGDFHIVGSSPEILVRRERNDVIVRPIAGTRLRGKTPAEDLANEQDLLSDAKEIAEHVMLIDLGRNDVGRISKTGEVKVTDKMVIEKYSHVMHIVSNVEGRLKDGMTNMDILAATFPAGTLSGAPKVRAMEIIEEVEPSKRGIYGGAVGVWGFNNDMDLAIAIRTAVVKNNTLYVQSGAGVVADSDPASEWQETQNKARAVIHAAQMVQEGLDK

SEQ ID NO: 7238 - protein, 321 aa, Neisseria meningitidis
MSYTQLTQGERYHIQYLSRHCTVTEIAKQLNRHKSTISREIRRHRTQGQQYSAEKAQRQSQTIKQRKRQPYKLDSQLIQHIDPLIRRKLSPEQVCAYLCKHHQITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRALKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLIH

SEQ ID NO: 7239 - protein, 319 aa, Neisseria meningitidis
MSKKTKQELENNKLSKRLRHAVGDAINDFNMIEPDDKIMVCLSGGKDSYALLDILRQLQASAPIDFQLVAVNLDQKQPGFPEEVLPTYLESIGVPYKIVEEDTYSTVKRVLDEGKTTCSLCSRLRRGILYRTAKELGCTKIALGHHRDDILATLFLNMFYGGKLKAMPPKLVSDNGEHIVIRPLAYVKEKDLIKYAELKQFPIIPCNLCGSQPNLQRQVIGDMLRDWDKRFPGRIESMFSALQNVVPSHLADTELFDFVGLERGQSLKHGGDLAFDSEKMPERFSDGSEEDESEIKIEPQKAERKVINILANKPKTCGS

SEQ ID NO: 7240 - protein, 288 aa, Neisseria meningitidis
MMKTLLPFFGVVRVSGEDRQTFLHGQLSNDINHLQTGQACYATYNTPKGRVIANMIVVNRGGDLLLIMAQDLLEATVKRLRMFVLRAKAVFEILEDYAVGAELEASAEPLAAQEPSLAFTAECGSDGICSVVLPHRGILHIAPKNALPPYDAAAENAWRLHEIRSGYPWICAATKETAVAQMLNQHIIGGVHFKKGCYPGQEIIARAQYRGQVKRGLAVLSGNSAVEAGTLLTADGEEAGIVLDSVQDSENFTALTVIKFSAAQKTLTVPNGGIFKAVHLFFKTENAE

SEQ ID NO: 7241 - protein, 120 aa, Neisseria meningitidis
MDIRYFGTTPRYSEAVGANGLIFLSGMVPENGETAAEQTADVLAQIDRWLAECGSDKAHVLDAVIYLRDMGDYAEMNGVWDAWVAAGRTPARACVEARLARPEWRVEIKITAVKRDAATA

SEQ ID NO: 7242 - protein, 159 aa, Neisseria meningitidis
MSKHTYPITPAVRVLRENGIEFEPFTYAYEEHGGTAQFARLFGKDEHLVIKTIVLQDENGKGLIVLMHGDKQISTRNLARHLGAKHIEPATPVQANKWTGYLVGGTTPFGIRTKLDIYVEQSVMDLETIYINGGKRGFIIGIRPGDLNILNPKTIQAAV

SEQ ID NO: 7243 - protein, 240 aa, Neisseria meningitidis
MDKDLYAVLGVSPQAGADEIKRAYRKLAMKYHPDRNPGNPKAEEKFKEIQRAYDTLSDLSKRMQYDASFRRHEERGRQEEAFRREQARREQFYREQMRREQAFRQAFERQASRSCHTYEPSGGGSGRNYVLAAYILFGLGAIMLFMPIVGVIFAYMPIVGVILAYMKRNSLDSIVYAAHTEYLIKTFWRTFWLYILGALTALLGIGVLIIIATNVWYFYRIIAGFIRFNGGRAVAPEKWI

SEQ ID NO: 7244 - protein, 291 aa, Neisseria meningitidis
MAYLLISIVFSVSVSILLKMARKKKIDIAQAVAVNYVVAVILTLLVLKPDIGNIGAFLPTWPLFAALGVLLPSVFVIMGKSVEAAGIVKSDAAQRLSLFLPIVAALTLFGEKLSEGKLIGLCLAFAALFCLLWKHSGGKKSGSAWRQAALLLGVWAGYGIIDILFKQLAKSGTAFAGNLLVAFVLAGVLMFACLFAKSVRWRVESVVGGIFLGGLNFMNIVTYITAHQMMKDNPTLVFAGMNIGVIVLGTLSGALFFKEKINTINTAGIVLALCSIACLFYWGEVKVLFGI

SEQ ID NO: 7245 - protein, 465 aa, Neisseria meningitidis
MTVRIEHDLLGDREIPAEVYWGIHTLRAIENFKISTQKISDVPQFVRSMVMVKKATAQANGELGAVKPEIAAAIEKACDEVLLNNRCLDQFPSDVYQGGAGTSVNMNTNEVIANLALEVLGYEKGRYDIVNPMDHVNASQSTNDAYPTGFRLAVYYSIGELLDKLTVLKNAFAAKAEEFKDVLKMGRTQLQDAVPMTAGQEFQSFQVLLEEEILNLDRTRQLLLEVNLGATAIGTGVNTPKGYAELVVKKLSEVSGLPCKLTENLIEATSDCGAYVMVHGALKRTAVKLSKICNDLRLLSSGPRAGLKEINLPELQAGSSIMPAKVNPVIPEVVNQVCFKVIGNDTTITFAAEAGQLQLNVMEPVIAQCMFETISLLGNAAVNLSDKCVKGITVNREICERYVFNSIGLVTYLNPYIGHHNGDLVGKICAQTGKGVREVVLERGLLSEEELNRILSPENLMNPHL

SEQ ID NO: 7246 - protein, 187 aa, Neisseria meningitidis; identical to SEQ ID NO: 3900

SEQ ID NO: 7247 - protein, 356 aa, Neisseria meningitidis
MTKHIAILRGDGIGPEIVAETVRVLDKLIAQGLDAGYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSIGMLPSASLDENGKGLYEPSHGSAPDIAGQNKANPLATILSLAMLLRYSLNDEARAQQVENAVQKVLQQGLRTSDIYEEGTKLVSCSEMGDAVLAAL

SEQ ID NO: 7248 - protein, 243 aa, Neisseria meningitidis
MVKLTAQQIFDKLLNEEKILSVNGQIRFFLGDVDIIVKQKDVVGNIIQEWLGGWLRKREIEFDVSTNTQMPPDFFLNKKDRSRELLEVKAFNRNASPGFDIADFKMYSDEIIHKPYMLDVDYLIFGYDMDDNGNVTIKDLWLKKVWQITRSMDGWAINLQVKKGVVHKIRPGVWYSINKKNMPMFECLEDFVSAIEETVYQNPATRHNASLWKKKFEEAYKKHYNRSISIPRWHEIAHKYKKK

SEQ ID NO: 7249 - protein, 423 aa, Neisseria meningitidis
MQQIKFIDLFSGMSGIRKGFEQACRKQSVACECVFTSEIKPAALEVLKQNYPDEVPYGDITKIETGDIPDFDILLAGFPCQAFSFAGKRLGFEDTRGTLFFDVARILKAKKPKGFILENVEGLVTHDRKDPTQKIGRTLTVILETLETLGYYVSWKVLNAKDFGIPQNRKRIYLTGSLKSKPDLSFETTLSPKLKNILESGLPTESSPFIKKLLKKFPPSELYGKSVKDKRGGKNNIHSWDIELKGTVTEEEKQLLNMLLKERRKKKWASEIGIDWMDGMPLTKAQISTFYKHPNLQNILDSLTDKGYLVLEHPKQKIGGRRIKDESLPKGYNIVSGKKSFEINKILDPNDVAPTLVAMDMEHLFVVDNGGLRTLTGKEGLRLFGYPDDYSFDIPKKDKYDLLGNTVAVPVIKAVSERLLHTL

SEQ ID NO: 7250 - protein, 213 aa, Neisseria meningitidis
MKAFTKITAIVAPLDRSNVDTDAIIPKQFLKSIKRSGFGPNAFDEWRYLDHGEPGMDNSKRPLNPDFSLNQPRYQGAQILLTRKNFGCGSSREHAPWALDDYGFRAVIAPSFADIFFNNCYKNGLLPIVLTEERVDRLFKEVEANEGYQLSIDLAEQTLTTPSGETFTFDITEHRKHCLLNGLDEIGLTLQHADEIHAFEEKRRQSQPWLFNG

SEQ ID NO: 7251 - protein, 84 aa, Neisseria meningitidis
MNKLFITALSALALSACAGTWEGAKQDTARNLDKTQAAAERAAEQTGNAVEKGWDKTKEAVKKGGNAVGRGISHLGGKIENATE

SEQ ID NO: 7252 - protein, 469 aa, Neisseria meningitidis
MTAQTLYDKLWNSHVVREEEDGTVLLYIDRHLVHEVTSPQAFEGLKMAGRKLWRIDSVVSTADHNTPTGDWDKGIQDPISKLQVDTLDKNIKEFGALAYFPFMDKGQGIVHVMGPEQGATLPGMTVVCGDSHTSTHGAFGALAHGIGTSEVEHTMATQCITAKKSKSMLISVDGKLKAGVTAKDVALYIIGQIGTAGGTGYAIEFGGEAIRSLSMESRMTLCNMAIEAGARSGMVAVDQTTIDYVKDKPFAPEGEAWDKAVEYWRTLVSDEGAVFDKEYRFNAEDIEPQVTWGTSPEMVLDISSKVPNPAEETDPVKRSGMERALEYMGLEAGTPLNEIPVDIVFIGSCTNSRIEDLREAAAIAKDRKKAANVQRVLIVPGSGLVKEQAEKEGLDKIFIEAGFEWREPGCSMCLAMNADRLTPGQRCASTSNRNFEGRQGNGGRTHLVSPAMAAAAAVTGRFTDIRMMA

SEQ ID NO: 7253 - protein, 449 aa, Neisseria meningitidis
MKLPVMSPEHSAQLQAFEAKILSNHAKIEAWFRTQWSVHRPPFYGSVDIRNAGYKISSIDMNLFPGGFNNLNPNFIPLAAVAAQDAVQRACETAKSVLIIPENHTRNTFYLQNVYALGEILRSAGYEVRLGSLNPEVTEPTEFETALGDKILLEPLLRTRDRVHLADGFSPCVVLLNNDLSAGIPDILKGISQTVLPPLHGGWTTRRKTNHFGAYNQVTAEFAKLIGIDEWQINPYFEKIGGLDFQGREGEDALAEAVERVLAKIQAKYDESGITDKPFVIVKADAGTYGMGVMSVKSADEVRGLNRKNRNKMAKVKEGLEVSEVIVQEGIYTYETLNGAVCEPVVYMMDRFVIGGFFRVHEGRGADENLNAGGMVFVPLSNSIPTGNGDNSQEAPEACKRVFEQWDSLGMPRSEKDCDVDNEHNRLYVYGVMARLSLLAASIELEETA

SEQ ID NO: 7254 - protein, 225 aa, Neisseria meningitidis
MSIKQWPEGERPREKLLERGAAALSDAELLAILLRVGTRGMSAVDLARYLLQEFGSLGRLMSAEVGKLSAYKGMGTASFTQFAVVREIGRRILAEELQESIVLSDPDTVADYLRFHLGQEKVEVSVALLLNRQNQLIAVRELSRGTVAENTIYIREIVKLALDEYADSLIIAHNHPGGSPEPSQEDIMFTRRLAQAMSLVDVSLLDHFIVTSQSVCSFRQLGLMP

SEQ ID NO: 7255 - protein, 241 aa, Neisseria meningitidis
METQNKPTVTDIDRPILVPPGGHKKVLLHSCCAPCSGEVMEAMLASGIDYTIYFYNPNIHPHKEYMLRKEENVRFAEKFGIPFIDKDDDYENDRKEWFAKAKGMEFEPERGIRCTMCFDMRFEKAAQYAHEHGFPVFTSSLGISRWKNMAQINDCGHRAAAPYDDVVYWDFNWRKGGGSARMIEISKRENFYQQEYCGCAYSLRDSNAHRKSQGRIPIKLGVLYYGDESTQYEPAPIRVDK

SEQ ID NO: 7256 - protein, 426 aa, Neisseria meningitidis
MKSLFIRLLLLGSAAGVFYHTQNQSLPAGELVYPSAPQIRDGGDALHYLNRIRAQIGLHKLAHAPVLENSARRHASYLTLNPEDGHGEHHPDNPHYTAQKLTERTRLAGYLYNGVHENISTEEEAAESSDSDIRTQQRQVDGLMSAIYHRLSLLDRHTDEAGAAFVRENGKTVLVFNQGNGRFERHCAQGRNQPEAGRKYYRNACHNGAVVYTDEAMPAQELLYTAYPVGSGALPYFHGERPDPVPEYEITGNPASIDFSEAAGKITMKSFKLYQGKNEIRPVRVLTAGNDPNGRLTAYQFALFPLKPLEYGTLYTAVFDYVRNGRRAQAKWQFRTRKPDYPYFEVNGGETLAVRKGEKYFIHWRGRWCLEACTRYTYRQRPGSRLSIGRHEAGGIVFSVDGMAGSRITLAPEGETERGVTLYLQD

SEQ ID NO: 7257 - protein, 392 aa, Neisseria meningitidis
MTGRTGGNGSTQAQPERVMLVGVMLDKDGTGSSAARLNGFQTALAEAVELVKAAGGDSVRVETAKRDRPHTALFVGTGKAAELSEAVAADGIDLVVFNHELTPTQERNLEKELKCRVLDRVGLILAIFARRARTQEGRLQVELAQLSHLAGRLIRGYGHLQSQRGGIGMKGPGETKLETDRRLIAHRINALKKQLANLKKQRALRRKSRESGTIKTFALVGYTNVGKSSLFNRLTKSGIYAKDQLFATLDTTARRLYISPECSIILTDTVGFVSDLPHKLISAFSATLEETAQADVLLHVVDAAAPNSGQQIEDVENVLQEIHAGDIPCIKVYNKTDLLPSEEQNTGIWRDAAGKIAAVRISVAENTGIDALREAIAESCAAAPNTDETEMP

SEQ ID NO: 7258 - protein, 823 aa, Neisseria meningitidis
MKKTCFHCGLDVPEHLHLTVRYENEDRETCCAGCQAVAQSIIDAGLGSYYKQRTADAQKTELPPQEILDQIRLYDLPEVQSDFVETHGGTREAVLMLGGITCAACVWLIEQQLLRTDGIVRIDLNYSTHRCRVVWDDGKIRLSDILLKIRQIGYTAAPYDAQKIEAANQKERKQYIVRLAVAGLGMMQTMMFALPTYLYGGDIEPDFLQILHWGGFLMVLPVVFYCAVPFYQGALRDLKNRRVGMDTPITVAIIMTFIAGVYSLATNAGQGMYFESIAMLLFFLLGGRFMEHIARRKAGDAAERLVKLIPAFCHHMPDYPDTQETCEAAVVKLKAGDIVLVKPGETIPVDGTVLEGSSAVNESMLTGESLPVAKMPSEKVTAGTLNTQSPLIIRTDRTGGGTRLSHIVRLLDRALAQKPRTAELAEQYASSFIFGELLLAVPVFIGWTLYADAHTALWITVALLVITCPCALSLATPTALAASTGTLAREGILIGGKQAIETLAQTTDIIFDKTGTLTQGKPAVRRISLLRGTDEAFVLAVAQALEQQSEHPLARAILNCRISDGSVPDIAIKQRLNRIGEGVGAQLTVNGETQVWALGRASYVAEISGKEPQTEGGGSAVYLGSQSGFQAVFYLTDPLKDSAAEAVRQLAGKNLTLHILSGDRETAVAETARALGVAHYRAQAMPEDKLEYVKALQKEGKKVLMIGDGINDAPVLAQADVSAAAAGGTDIARDGADIVLLNEDLRTVAHLLDQARRTRHIIRQNLIWAGAYNIIAVPLAVLGYVQPWIAALGMSFSSLAVLGNALRLHKRGKMQSEKMPSEQ

SEQ ID NO: 7259 - protein, 68 aa, Neisseria meningitidis
MRKKIKKWIYAINGIMMSIWIIFFPNTGSVYDGGRTTIFNENHPFHFIFCITFLIGTIFLIYHEYNDN

SEQ ID NO: 7260 - protein, 258 aa, Neisseria meningitidis
MAAFNTQKVLSVHHWTDAYFTFTCTRDESLRFENGQFVMVGLMVDGKPLMRAYSVASANWEEHLEFFSIKVQDGPLTSRLQHLKVGDDVLISKKPTGTLVAGDLNPGKHLYLLSTGTGIAPFLSITKDPEIYEQFEKIILVHGVRYKKDLAYYDRFTKELPEHEYLGDLVKEKLIYYPIVSREEFEHHGRLTDLMVSGKLFEDIGLPKINPQDDRAMLCGSPAMLKDTCKVLDDFGLTVSPKTGVRGDYLIERAFVDQ

SEQ ID NO: 7261 - protein, 264 aa, Neisseria meningitidis
MTLPMQETRFSILLDELAAKQEAAIAPHLLADGTKVWIRKAGRHNARWRYALLGMVARYLKLGVLKPVPSLGGEPAIATESKRLYELRSAGIAVPELLAVRKNALMFGNLEGIPLDAQIRQEAEAGKSDAWLAGLEAIARVHKKRQFLSQAFARNMMSDGKNISFLDFEDDPSEVLTIAQCQARDWLCYIHSTALILKNGGLLEAAAEKWGGVLSDQPAEIQKLIAATVKPILPIRRLEHPRWGRDALRLAASISLISLADMPP

SEQ ID NO: 7262 - protein, 469 aa, Neisseria meningitidis
MKYISTRGETAHKPFSEVLLMGLAPDGGLMLPEHYPQIGRETLDKWRGLAYPELAFEIMRLFVTDIPEDDLRDILNRTYTEAAFGTKEITPVRTLSDGIKIQALSNGPTLAFKDMAMQFLGNAFEYVLNKEGKKLNILGATSGDTGSAAEYALRGKKGVNVFMLSPDGKMSAFQRAQMYSLQDENIHNIAVKGMFDDCQDIVKAVQNDAAFKEKYHIGTVNSINWGRIVAQVVYYFAGYFNATSSNDETVSFCVPSGNFGNVCAGHIAKQMGLPIRRLIVATNENDVLDEFFKTGAYRPRNSAHTYVTSSPSMDISKASNFERFVFDLMDRDPAEINTLWAEVAAGKGFDLRFALDKVGGKYGFTSGKSTHADRLATIKQVYEQDQELIDPHTADGVKVAREVREEGEMVVCLETALAAKFDATIREAVGDAAIPRPAALEGLENLPQRVQTVPNSADAVKGIIEQTLA

SEQ ID NO: 7263 - protein, 123 aa, Neisseria meningitidis
MNKTLSILPVAILLGGCAAGGGNTFGSLDGGTGMGGSIVKMAVGSQCRAELDKRSEWRLTALAMSAEKQAEWENKICACVAQEAPERMTGNDVMQMLAPSTRNQALAALTAKTVSACFKHLYR

SEQ ID NO: 7264 - protein, 489 aa, Neisseria meningitidis
MEKHNGTYRDLHRPASEFATRDEYLEHELQIMQPKRWRPNLPFRDYRFEWEDLIPAMAGTIGKVVMVGAVAAAFAAPLGLPDSFVLENVRYELLIAAAFILLVSGFFLPGANLPGTHGPLIPMIPIVVSAGGHPLAFGISIAVLGLLMALFRGGSIMAKLTSNGVCGGLLLYLGFIGTTGQVKKLFSWAGGFNMPYIAFTVIIVTIVMYALLEHWKKRWLAVPLGCLIAGVVAFALGAPFEFHTAPGLPPMSPAYWWGENSGWHLGLPTAESFLVVFPFAVLAVAMWSPDFLGHQVFQKISYPEKTDKVLMNIDDTMTSCSVRQAVGSILGGANFTSSWGTYIVPASIAKRPIPGGAVLTAVLCIIAGLWGYPMDLAIWQPVLSVALVVGVYLPLLEAGMEMTRKGKTTQSAAIVVFSSALVNPVFGWALTMLLDNLGLIGCKERSAQLGFAGRVLIPAVGFLILCVAMGAVGMLPGIPPFLEHFKSLG

SEQ ID NO: 7265 - protein, 304 aa, Neisseria meningitidis
MDAVQLKSFVAVAHEGNLTQAAKRLFLSQPAVSAQIKALEEYVGTPLFRRTGKGMVLTRAGEILLPEAESLLQYKHKLEHFAKTLAGDYSEETSLGIIHPIDSAKLVALTDNIGQTAPKTRLHIQYGMSGEILSRIQHKTLHGGFILGNAAQRGIRSVFLQNLTYALICPQSQYPHLTRSLPQSLQECVWIEMSGVSGSRKHLHQFWRSNRLSPKKQILCDYPQTIIDLVAGGIGVAMVPGNKAEAAAKEGAGVAIIESCRHSMPLNFIYAEEYEDNPHVSLLLECIEKVWGVQAVQPPVVSDN

SEQ ID NO: 7266 - protein, 321 aa, Neisseria meningitidis; identical to SEQ ID NO: 6441

SEQ ID NO: 7267 - protein, 636 aa, Neisseria meningitidis
MNILSVENASFAIGHVALLDKTSFQLDSGEKVGLIGRNGAGKSSFLKILAGLQKLDDGQIIVQNNLKIVYVPQESFFDKDATVFDTVAEGLGEIRDLLRRYHHVSHELENGSSEALLKELNELQLEIEAKDGWKLDAAVKQTLGELGLPENEKIGNLSGGQKKRVALAQAWVQKPDVLLLDEPTNHLDIDAIIWLENLLKAFEGSLVVITHDRRFLDNIATRIVELDRGILRSYPGSFSKYSEKKAQELAVEAEHNRLFDKFHAQEEAWIRKGIEARRTRNEGRVRRLEELRRQRAERRNVQGQVNFKLDSGEKSGKIIAELEHASFAYGGKVIMDKFSAILQRGDKIGLIGPNGIGKTTFLKLILGELQPTYGRIRIGSKQEVAYFDQFRSALNENDTVFYTLGQGNDYVEVGGKKKHVMSYLEDFLFHPARAQSPVSSLSGGERNRLLLAKLFTRPANILVLDEPTNDLDIDTQELLEDLLRDYQGTVFLVSHDRMFLDNVITQSIVFEGQGRLKEYIGGYQDYIDAKSREDKIQTASAPKASDAEPAKEKPKANRTVKLSYKEQRELDALPDEIAALEAEQAEINTQLSYPEIFKDYEKAGALQNRAEEIEMLLLEKLERWELLETKRNGNAV

SEQ ID NO: 7268 - protein, 214 aa, Neisseria meningitidis
MLASAIDFILHIDQHLLALSAQYGVWIYAILFLIVFCETGLIVTPLLPGDSLLFAAGGIAALGGMDIHLMVALLSLAAILGDALNFTVGKYFGGRLFANPDSKIFRREYLDKTHRFYEKHGGKTIIIARFMPIVRTFAPFVAGMGKMHYAKFIRYNIIGGLLWVILFSYAGYFFANFPVVKNNLGLVMGGIIIVSVLPGAVEIARAKLAVKSKR

SEQ ID NO: 7269 - protein, 272 aa, Neisseria meningitidis
MKKTVFTCAMIALTGTAAAAQELQTANEFTVHTDLSSISSTRAFLKEKHKAAKHISVRADIPFDANQGIRLEAGFGRSKKNIINLETDENKLGKTKNVKLPTGVPENRIDLYTGYTYTQTLSDSLNFRVGAGLGFESSKDSIKTTKHTLHSSRQSWLAKVHADLLSQLGNGWYINPWSEVKFDLNSRYKLNTGVTNLKKDINQKTNGWGFGLGANIGKKLGESASIEAGPFYKQRTYKESGEFSVTTKSGDVSLTIPKTSIREYGLRVGIKF

SEQ ID NO: 7270 - protein, 311 aa, Neisseria meningitidis
MFKAVLLGQWHSLSDPELEHSLITRIDFNLFCRFDELSIPDYSTLCRYRNWLAQDNTLSELLELINRQLTEKGLKVEKASAAVIDATIIQTAGSTQRQVIEVDEEGQINGQTTPSKDSDARWIKKNGLYKLGYKQHTRTDAEGYIEKLHITPANAHECKHLPPLLEGLPKGTTVYADKGYDSAENRQHLEEHQLLDGIMRKACRNRPLTETQTKRNRYLSKTRYSGLNLNQDKATKPQTVQIVRQGEATPYWFKFNPLYVVEQSFGTLHRKFRYARAAYFGLIKVSAQSHLKAMCLNLLKAANRLSAPAAA

SEQ ID NO: 7271 - protein, 416 aa, Neisseria meningitidis
MFSKSVTLAQYDPDLAAAIAQEDQRQQDHVELIASENYVSCAVMDAQGSQLTNKYAEGYPGKRYYGGCEYVDIVEQLAIDRVKELFGAAYANVQPHSGSQANQAVYASVLKPGDTILGMSLAHGGHLTHGASVNISGKLYNAVTYGLDENEVLDYAEVERLALEHKPKMIVAGASAYALQIDWAKFREIADKVGAYLFVDMAHYAGLVAGGEYPNPVPFCDFVTTTTHKTLRGPRGGVILCRDNTHEKALNSSIFPSLQGGPLMHVIAAKAVAFKEALQPEFKQYAKQVKINAAAMAEELVKRGLRIVSGRTESHVFLVDLQPMKITGKAAEAALGKAHITVNKNAIPNDPEKPFVTSGIRIGSAAMTTRGFNEADARVLANLVADVLSNPEDEANLAKVRKQVTALCNKYPVYGA

SEQ ID NO: 7272 - protein, 70 aa, Neisseria meningitidis
MVYQRVMADKDVVGAGYLIDFAQTAENLPFNVLLLISLVLNKGNETLKTSMLNKLPDNAKENLRIMGYLP

SEQ ID NO: 7273 - protein, 606 aa, Neisseria meningitidis
MPCMNHQSNSGEGVLVAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGILNEFSPNQVGYDAEGLRLLGDASRLAFADRDVYLGDPDFVPVPIRQLISKDYLKHRSQLLEQSDKALPSVSAGDFIHEWVSSQAIELPSTSHISIVDKAGNVLSMTTSIENAFGSTLMANGYLLNNELTDFSFEPIKQGKQVANRVEPGKRPRSSMAPTIVFKAGKPYMAIGSPGGSRIIGYVAKTIVAHSDWNMDIQNAISAPNLLNRFGSYELETGTTAVQWQQALNDLGYKTDVRELNSGVQAIIIEPSRLVGGADPRREGRVMGD

SEQ ID NO: 7274 - skipped

SEQ ID NO: 7275 - protein, 72 aa, Neisseria meningitidis
MFPEYRDLISKLKQENSRFARLFDEHNELDDKITGLVNNPVTSGAETIDELKKAKLKLKDELYAILQKAAGK

SEQ ID NO: 7276 - protein, 324 aa, Neisseria meningitidis
MDTLTRFLPEHLQQNQLPEALGGVLLSVVSACTEINAKVRLGALAGVLGMAGTGNIQGEDQKKLDVIANNIMIDTLKANSAVAGLASEEEDTFVNAGENGRYLVLFDPLDGSSNIDVNISVGTIFSILEKPEGALATESFLQTGRQQLAAGYVLYGPQTQLVFTFGHGVYMFTLNAENEFVLTKENPKVPESTKEFAINMSNRRHWLPPVQQYIDELLAGETGTRGKNYNMRWVASMVAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 7277 - protein, 281 aa, Neisseria meningitidis
MLSYRHAFHAGNHADMLKHFTLFLVLQYFNRKDKPYWYIDTHGGAGVYNLEGSEAQKVGEYRQGIALLRQAQNLPAELSDFAAHIQKILPSPKLYCGSPWLAQSLTRVGDKLRLFELHPTDFVHLQNNMGEAGLGKRGQVLREDGYKGLISLLPPPPRRATVLIDPPYEEKQDYRRVTETLKAALKRFESGCYLIWYPCLSREESRKLPEELKKLLPDNYLHAELHVHAPKADGFGMHGSGMFVINPPYLLAEQLAANLPALTRLLAQDEGSRYLLDSKIR

SEQ ID NO: 7278 - protein, 200 aa, Neisseria meningitidis
MFNIPAVAVSYLIGSLSFAVIVSKYYGMDDPRTYGSGNPGATNVLRSGKKKAAALTLLGDAAKGLVAVLLARVLQEPLGLSDSAIAAVALAALVGHMWPVFFGFKGGKGVATALGVLLALSPATALVCALIWLVMAFGFKVSSLAALTATIAAPVAASFFMPHVSWVWATVAIALLVLFRHKSNIVKLLEGRESKIGGSR

SEQ ID NO: 7279 - protein, 118 aa, Neisseria meningitidis
MDKIFLHGMKADTLIGVYGWERERLQTLIVDLDIGVPEKAGSDDDIANTVHYAEVCETLRRHLKEQDFLLLEALAEYIADLVLGYFGAVWVRVKIVKPGILEGVREVGVEIERGKRED

SEQ ID NO: 7280 - protein, 178 aa, Neisseria meningitidis
MDLREVKLGGETIYEGGFVSISRDKVRLPNGNEGQRIVIRHPGAACVLAVTDEGKVVLVRQWRYAANQATLELPAGKLDVAGEDMAACALRELAEETPYTADSVRLLYSFYTAVGFCNEKMYLFEAEGVRLGSTLANDEDEITETVLMSKEEVRQALANDEIKDGKTLIGLQYWLMKD

SEQ ID NO: 7281 - protein, 119 aa, Neisseria meningitidis
MLSNIIPLSIGAALGATARWLLNLAVPASIPPATGNLFANWIGAFLIGIFAETVNHPQWKLLLITGFLGSLTTLSGFSLETVTLLQLNRPASALANIFLHTAGSLLLTWLGLKIGAAVK

SEQ ID NO: 7282 - protein, 226 aa, Neisseria meningitidis
MIFQTVWFSDMVLSVSWIVLILILAASAPSAFRSLARYRSALPLCTVIFSAAWCLNASAGGGQLAQMNYHLLAVNLVALMMGTSAALWLAALLMLPYCLLFAGSVGAYPPNALVLILPALTVNRLSRMLVNRLPPNIFIFIFVNGFLASAAGILLTGLVLTGILDAANAFPSEILWTTALPVFILLAWAEAFLSGISTAIFVALKPHWINTFDDNRYLKSDRGIWR

SEQ ID NO: 7283 - protein, 1014 aa, Neisseria meningitidis; identical to SEQ ID NO: 490

SEQ ID NO: 7284 - protein, 420 aa, Neisseria meningitidis
MSNTQKQLALAKAAKKSVNTADTEEKNRALLAMADSLEAATADILAANRQDLEAAAGNIPESMTDRLLLDGKRICAMADGIRAVAALPNPVGEILETSTLPNGLEIVKKRVAMGVIGIIYESRPNVTSDAAALALKSGSAVVLRSGKDAFQSARAIVAALKTGLAQTRIDPDALQLIEDTGRESSYEMMRAKDYLDLLIPRGGAGLIRAVVENAVVPVIETGTGIVHIYIDKDADWDKALRIVYNAKTSRPSVCNSMEVLLVHEDIAADFLPKLERLLVRDRIEAGLPPIRFRLDPQAARHIGGEAAGADDFDTEFLDYILAVKTVASVEEAVWHIETHSTHHSDGIVTENRHAADYFTTHIDSAAVYVNASTRFTDGGEFGLGCEMGISTQKLHARGPMGLKELTSYKYIVQGTGQVRE

SEQ ID NO: 7285 - protein, 369 aa, Neisseria meningitidis; identical to SEQ ID NO: 1502

SEQ ID NO: 7286 - protein, 517 aa, Neisseria meningitidis
MTQTNRVIIFDTTLRDGEQSPGAAMTKEEKIRVARQLEKLGVDIIEAGFAAASPGDFEAVNAIAKTITKSTVCSLSRAIERDIRQAGEAVAPAPKKRIHTFIATSPIHMEYKLKMKPKQVIEAAVKAVKIAREYTDDVEFSCEDALRSEIDFLAEICGAVIEAGATTINIPDTVGYSIPYKTEEFFRELIAKTPNGGKVVWSAHCHNDLGLAVANSLAALKGGARQVECTVNGLGERAGNASVEEIVMALKVRHDLFGLETGIDTTQIVPSSKLVSTITGYPVQPNKAIVGANAFSHESGIHQDGVLKHRETYEIMSAESVGWATNRLSLGKLSGRNAFKTKLADLGIELESEEALNAAFARFKELADKKREIFDEDLHALVSDEMGSMNAESYKFISQKISTETGEEPRADIVFSIKGEEKRASATGSGPVDAIFKAIESVAQSGAALQIYSVNAVTQGTESQGETSVRLARGNRVVNGQGADTDVLVATAKAYLSALSKLEFSAAKPKAQGSGTI

SEQ ID NO: 7287 - protein, 220 aa, Neisseria meningitidis
MDSRKFTEASKRRLSELLDAKSEQGNTMRCDEVQGFMTALLSGPDKLTPLDWLPEVLGDESQFTAAERSEIERLVLAMAMETTAAMSDKKLPDLWLYENEDGGSDFYTWCNAYLYGLDIVPTDWFEAVDDEAFEELFYPIMALGGIYDEEENGAIRLQFTEGELAELESELPYALADIYRYWQAVINKPQTVRREGEKTGRNDPCPCGSGRKYKACCGKN

SEQ ID NO: 7288 - protein, 283 aa, Neisseria meningitidis; identical to SEQ ID NO: 1514

SEQ ID NO: 7289 - protein, 376 aa, Neisseria meningitidis
MIKISTRFDAGSVVVKDLTDPSNIRLALRPDNASDFAQWFYFRLQGAAYQNCIMHFENAAEAAYPKGWEGYQACASYDRRNWFRVPTSYENGVLTVNHTPLSNSVYYAYFEPYSEEQHLNLLGDAQGSGLCRIDDLGSTVQGRDINLLTIGNQVESDLKIWITARQHPGETMAEWFIEGLLGRLLDPQDPTARALLDRATFYIVPNMNPDGSALGNLRTNAAGANLNREWENPTVEKSPEVFFVREKMLETGVDLFLDIHGDEGLPFVFVAGTEGVPNYNPRIAALEAQFKNALLNASPDFQDEYGYEKDAPGEANMTLATNWVGNRFNCLAYTLEMPFKDNANLPDDDFGWNGQRSLRLGEAALSAILNVIGDLR

SEQ ID NO: 7290 - protein, 298 aa, Neisseria meningitidis; identical to SEQ ID NO: 1520

SEQ ID NO: 7291 - protein, 222 aa, Neisseria meningitidis
MKNLAIFDLDNTLINTDSDHAWPQYLIKKGLVDAAETEAQNEKFYRDYQNGCLDIDAFLKFHLAPLARYSKEELAEFHREFMAEYIIPHISPMQRMLVQSHQMAGDETLVISSTNEFIITPVCHLFGITNIIGTQLETGSDGRYTGNYIGTPSLKEGKITRLNQWLAERGETLQSYGKTYFYSDSKNDLPLLRLVSEPVAVNPDAELEKEAKEKGWPVLNFK

SEQ ID NO: 7292 - protein, 222 aa, Neisseria meningitidis
MNQLIFDFAAHDYPSFDKFLGTENAELVYVLRHKHGQFIYVWGEEGAGKSHLLQAWVAQALEAGKNAAYIDAASMPLTDAAFEAEYLAVDQVEKLGNEEQALLFSIFNRFRNSGKGFLLLGSEYTPQQLVIREDLRTRMAYCLVYEVKPLTDQEKIDALASMAAARQVTVDSEIFEYLLKHWRRDMDSLMMMLDTLDNYAVTMGKRITLPLLRQLLKQQETQ

SEQ ID NO: 7293 - protein, 183 aa, Neisseria meningitidis
MSGININLKNGDSLLIRGPSGCGKTSLLRALAGLWPFGSSGKVSRPPHQDILFLPQRPYTAQGSLRDAVCYPDIDKQHPELAEAMNTCRLGYLVDKLDKTDDWQHKLSPGELQRVAFVRALLSKPKIVLLDEATAALDEPTEALLYRALKQKLPDSIIISIGHRSTLNAFHNMRLDVGNVACG

SEQ ID NO: 7294-7296 - skipped (3 entries)

SEQ ID NO: 7297 - protein, 661 aa, Neisseria meningitidis
MKISASDIAKLGIPSLPTDRQGIEYHAKKNNWQHCFEQKGRGRPKKLYEIASLPAEIRAAIMKRQSDELAEKMPKMLPKVRPGTAMSAQALAEAAKLLNEKQRSVADARCAVVAAVLGIKYEYDCSAKAAVAQFLGLLAEGKLDAVTLGNLEKANDRSRTAKVGERTLDGWISAYLKAENATERLVALAPKTTKAVKPIESYGWLPMFMQFHNIPSAPKLAHSYRWFVQWAEAENMPVNDVPNLSMVRRVWEKLPLIMQERGRKTGAAYKSLLPYVKRDWGALKPNDVWIGDGHSFKAKVAHPVHGRPFKPEVTVIIDGCTRFVVGFSVSLAESCVAVSDAMRIGVKHFGLPIIYYSDNGGGQTGKTIDHEITGITSRPGIRHETGIAGNPQGRGIIERWWKDNLIEMARQYETFAGAGMDSSTKNLMYRKMESAFNALEKGKDLTEEQQKYLKKLPSWSRFIADVVKCIDEYNNRPHGELPRHPDGGHYTPKAYREMRLEQDGIAPDMLSAQELATMFMPQEVRKVQRGWLDLFNNSYFSTELAEYHKDEVRVSYDLSDASAVNVFDMDGKFITKAQANGNTREAFPTARIDQLAEKRRKGKIKRAENAIKLANAEVNPALEQAAVWDELGHLGGNDIEAEYAVLPKTGTDDFVLFEADR

SEQ ID NO: 7298 - protein, 66 aa, Neisseria meningitidis
MMDKQQNAAFSAELVEKLKLKRALGRIQRAQAKIQGVPAERNQAQTFLPALEGNCEPAQSKSALDG

SEQ ID NO: 7299 - protein, 390 aa, Neisseria meningitidis
MKQINQALQQKLVEFKEKSGMNQTQLARGIGTSPASISMYLNGTYAEKGGNYETIEPKIEAFLEMQDSKAQREELVLGFVSTKTTRRIAEVMRDAHEGGETVVIYGQAGLGKTQAVKNYCEKNPAAILIEANPSFTALVLMRKLATAAKVSAMGSLNDLFESVSDRLRDSGRLIVVDEAENLPLRALEIVRRLHDETGCGLVLSGMPRLVANLRGKHGELVQLYSRVSVALNLGESLPDDELFEIAKAALPDAVKHLLPDSVQALITVIGFNETLELVRLMGGTTYPLRQGYTKNSQSRVAYLEEIIGSEAAGRLVEAMAPCNLFIPRCETALYELRNRKIRSQFDRQTAGGTPAYEAVNDLALAHRLSDRHVWRILKQADKEAEQENLF

SEQ ID NO: 7300 - protein, 173 aa, Neisseria meningitidis
MECHADVWHFILEKNMKKFYFVLLALGLAACGQEQSQKADAEQYFFANKYQFADEKQAFYFERAARFRVLQQGLGGDFERFLKGEIPNQENLAKYRENITQAVAYYADTNGDDDPYRVCKQAAQDAEILMKSMVTSGGGGTTDLDKESYQNYRKSMQECRKTITEAEANLPKK

SEQ ID NO: 7301 - protein, 181 aa, Neisseria meningitidis
MSKIICLTAGHSNTDPGAVNGSDREADLAQDMRNIVASILRNDYGLTVKTDGTGKGNMPLRDAVKLIRGSDVAIEFHTNAAANKTATGIEALSTPKNKRWCQVLGKAVAKKTGWKLRGEDGFKPDNAGQHSRLAYAQAGGIVFEPFFISNDTDLALFKTTKWGICRAIADAIAMELGAAKV

SEQ ID NO: 7302 - protein, 78 aa, Neisseria meningitidis
MRILDIFKNPATGNVSHSKLWANVACAAGTFKFVMLPDPSAEIWAVYLGIVGGYAVARSFVSVKRQEVENESRETAGE

SEQ ID NO: 7303 - protein, 101 aa, Neisseria meningitidis
MSLLKTVKMQAAVALTALALTACSSTTAPSATEIKVVEKAVMPTPPAALMVAPVRPNPPKDGKTATLLEHAAEFGGYVAELENQNQAWRDWAGNHSRKVGN

SEQ ID NO: 7304 - protein, 56 aa, Neisseria meningitidis
MYFEIYKDAKGEYRWRLKAANHEIIAQGEGYTSKQNCQHAVDLLKSTTAATPVKEV

SEQ ID NO: 7305 - protein, 112 aa, Neisseria meningitidis
MTYRELVERQLAVRHADLELGLSRAREQEPFVIHVSDLLDKAGIEYAVRMDKDFQTTFHLEYPITNYDTFKRAVWQTLGAYYCVCNDGDGLEIASNRPDGYAVRIVFGDVPV

SEQ ID NO: 7306 - protein, 88 aa, Neisseria meningitidis
MDFEFGFRTLWPIATAAFWFWVNGISGRLKEADKRIDDLKEELHAVKLSYHTKADAKADSTNIAAALERIENKLEKVNEKLDRKADKS

SEQ ID NO: 7307 - protein, 65 aa, Neisseria meningitidis
MSDPILDALARIENKTDQTLKNQKEMQAEIAQIRQDTKRTAITFGALGGGVITVGWELLKAKMGL

SEQ ID NO: 7308 - protein, 168 aa, Neisseria meningitidis
MAHPQEIREKLRRLYVSGEQTLETAALMCEIPQTTARAWKRADKEKGDDWDKMRAAYTLAGGGIEDLSRAMLAGFMVQYNSTMTMLQDSSTEDLPPSDRAKLLASLADAFTKTVSANARVMPETSKLATALELIEFLMAFVQEKHPKHLPAFVEVLEPFGVEVEKKFG

SEQ ID NO: 7309 - protein, 196 aa, Neisseria meningitidis
MNWLNRGIQEKILRVLSDNYPNCLKATKVYNSLFPSSSLPITSNIPVDKQGLGLALTLGCEIQSQHLATLQSDEFQYFLKNIYYLEESGLIEITSIDSLHKNFDCKINHKGIDFLTDDGGLSAILGVVTVKLHSDTIQALIAAKIDQAEISDSEKSWLKKELGKIKDTALSTLTENAINAIPAATLITLLKKFVGL

SEQ ID NO: 7310 - protein, 516 aa, Neisseria meningitidis
MDGFDASPKAIAARRAKVFDPVGGYEYFVNTYFPHYIRSPEKSELHAFLFSRLPEIIRSPKGENEAVGAPRGEGKSTKVTQLFTLWCIVTGQKHYAVIVMDSIDQAYPMLEAIKAELEFNPRLKTDFPEVCGQGRVWQAGTIVTANDVKVQVAGSGKKLRGLRHGPYRPDLTVLDDIENDEQVRNPEQRDKLNAWLTKTVLPLGGVGQKYDVIYIGTILHYDSVLNRTLNNPFWHGIKFKAMKRWPDRMDLWDRWEELFRNDGETVAEAFYQANKDEMERGAVTSWAARGVLALMKIRARDGHATFDSEYQNDPVSGEDAPFAKSMKFWNDLPSDLVYFGALDPSLGKAGASRDPSAIIIGGYQRVTGKLYVVEAQIKKRLPDLIIEDVIRLHRQYRCKLWFVETVQFQEFLKDELVKRSAARGIPVPARAVKPVSDKLLRIETLQPHMANGLILLNESQQTLIQQFRHFPKADHDDGPDAVHMLWSGAVANCVPIEWQSPTDNDFDDEIKSKWSR

SEQ ID NO: 7311 - protein, 522 aa, Neisseria meningitidis
MAKKNNKTKIQKPEAALQTDVAQITATGRVIAEHPSNFITPQKMRALFEDAESGDIRAQHELFADIEERDSDIAANMGTRKRALLTLNWRVAPPRNATPEEEKLSDQAYEMMDSLPTLEDLIMDLMDAVGHGFSALEVEWVFSDGLYLPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGTTATSNPFLQMADWCEKSAARLILGQTLTSGADGKSSTNALGNIHNEVRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 7312 - protein, 431 aa, Neisseria meningitidis; identical to SEQ ID NO: 3372

SEQ ID NO: 7313 - skipped

SEQ ID NO: 7314 - protein, 353 aa, Neisseria meningitidis; identical to SEQ ID NO: 3416

SEQ ID NO: 7315 - protein, 321 aa, Neisseria meningitidis
MSYTQLTQGERYHIQYLSRHCTVTEIAKQLNRHKSTISREIRRHRTQGQQYSAEKAQRQSRTIKQRKRQPYKLDSQLIQHIDPLIRRKLSPEQVCAYLCKHHQITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRALKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLVP

SEQ ID NO: 7316 - protein, 160 aa, Neisseria meningitidis
MLPHTGLFLLGKVALQMRIRRRLKQGVIMAKTNNKPETAETAAPSFEDIKAELDAVQAELAAARNDVEMLTTALEKAEDDKKALSAELAELKVQHTQRAADALADSRDVMLVSTGADGKEFWRGGLLFDGGWREVKRAEVGEAVWKAICAEPMLQRKAVE

SEQ ID NO: 7317 - protein, 140 aa, Neisseria meningitidis
MAYATVEDMVARFGELEVLQLTDRNNEGLIDREVAQTALVDATAEIDAYLGRFRRPFEDLPPILVRLCCDIARYRLTAAQGVLITDEIRNRYKIDVLDLLRAMAKGEVQLGVDDSGEEVAAGEDGIVFVNGKNKVFGRDH

SEQ ID NO: 7318 - protein, 197 aa, Neisseria meningitidis; identical to SEQ ID NO: 3430

SEQ ID NO: 7319 - protein, 65 aa, Neisseria meningitidis
MSKIKVTAADGLRVPTEHNPHEYIGQEPVEVDGNSLYYRRMIDDGDLVVVEDAAPNTKTRNTKGE

SEQ ID NO: 7320 - protein, 469 aa, Neisseria meningitidis
MPHIDFDTIPGSIRVPGQYIEFNTRNAVQGLPQNPQKVLMVAPMLTAGIQPALEPVQLFSDAEAADLFGQGSLAHLMVRQAFANNPYLDLTVIGIADHSAGVQATATVTLSGTATAPGVVEITIGGKQVSTAVNTGETAATVADRLKTAITAADVTVTASGSGAAVTLTAKHKGEIGNESGLTVSTGNTGLTYQANAFTGGAKNADIATALSKVAGKHYHIICSPFSDDANAKALSNHITNVSNAIEQRGCIGVLGMSAALSTATTATGEINDGRMTCAWYKGAVEPNGIIAAGYAAVLAFEEDPAKPLNTLEIKGLAVTPDAQWPLFAECNNALYNGLTPLTVVNNRVQIMRAVSTYTKSANNTDDPALLDITTIRTLDYVRRSVKERIALRFPRDKLSDRLLPKVKSEILDVLIKLDQAEIIENAEANKGKLVVARAQNDPNRVNAIIPADVVNGLHVFAGRIDLIL

SEQ ID NO: 7321 - protein, 125 aa, Neisseria meningitidis
MSDATYADAVIMEMNGRDIEIVSIKPQTTTGRKPVKTMNRNGRVNGYCDGVTEHKLSVTAAIPIDGTEIDWDNITKAKITIYPINDEDRRTSYLDCFTVDTGEQYEVDNEARIDIEMIALHKIKE

SEQ ID NO: 7322 - protein, 121 aa, Neisseria meningitidis
MITVKLTHGLTYNGKVVSELRLKPLTVGGELAAFALIDDLPELPENATKAELLQRDVLETLTYWSQQIEAQGIPSDILTAQWLMENLSTEDYHTVMAAQEDLRLKPSAATASPDAPSAAEQ

SEQ ID NO: 7323 - protein, 200 aa, Neisseria meningitidis; identical to SEQ ID NO: 4002

SEQ ID NO: 7324 - protein, 718 aa, Neisseria meningitidis
MKLSLVLTARDDGARRLLADTQRQLDRTAKSRAQLERQSHTYALTGIRSEKQIQREIMLTQAAFNRLARSGKASQNDLARAAVATRNRIRELNAELKQGTGFADKMGKIGRFGAAAVAGGAAAYTVLKPAMDNRKQLDENINRVSRQAFIEDNSKSAAWIATEGAQQIKDLALELVEKNGGTHDKALDLISGMMTTGLNFAQTKNEAQAAYAFALASEGSGEDTAKLIKTLKDGGMSGKDLQLGLEHVLQSGLDGTFEVRDMVRELPSLLSAAQQAGMNGVGGLDYLLSLLQSAANKSGSPAEAATNVQNLLSKTLSPDTIGRLKKMANPNDPKKGVDWIGSVVQGKQNGENAVQVLSRLADAMLVKDKQYQDYKKRAAAGDKTAAEQANMLKGALLAQLLPDLQAKQGLLAATDMTQIREYMASLAGVTLDNGKIAKNNEARMLSAAAQQEQQESLAMLRESLTGTLVDMETSFKKLAAEYPNATLALQALTTAATAASAAMLLTAGGGKGAGFLKDVGSKALGWGKASAGGVAAGATAAGGKLLSWGKSAGSGLMNNPALVKRAGLLGMLLYSESLGDGTLPKGLRGTKTTPEMINRLKNNGIRFEPAPKREQARGGVPQYLAAPSAQPTDKMLSPLFSTQTAAYQAAIQQQTAAYQAALAQDTAAVTTGLAQVQSAMASASQTINTNVSLNIDGRVIANEVSRYQVAMFGRGAGQ

SEQ ID NO: 7325 - protein, 443 aa, Neisseria meningitidis; identical to SEQ ID NO: 3412

SEQ ID NO: 7326 - protein, 381 aa, Neisseria meningitidis; identical to SEQ ID NO: 3378

SEQ ID NO: 7327 - protein, 222 aa, Neisseria meningitidis; identical to SEQ ID NO: 3426

SEQ ID NO: 7328 - protein, 115 aa, Neisseria meningitidis
MDKELNPSIGDYTGRTVDTLQNAVYIRLMTPLGSWWADKTLGSLLHLLQREKDLQRVSLLAEQYADEALQPIVKSGRADKITVRAEQPHDGRLILHIRMDTAAGGFDYRHEVPVI

SEQ ID NO: 7329 - skipped

SEQ ID NO: 7330 - protein, 186 aa, Neisseria meningitidis; identical to SEQ ID NO: 3382

SEQ ID NO: 7331 - protein, 657 aa, Neisseria meningitidis
MHPIETPDKTFHDGDGVSELGTILPAWWLNQVQSELLAVLTAAGIQPDKSQPNQLLAALNRLAVVITGDQTVNGQKTFTAQTQFQSGIHLSANQTNWNGGHKAYIGADADNAHIVFGDDTLRLHGANNRISYNNHDIFHKANKPRFAEDIQGKPNTLSGYGIGNFKVETFRGDLNTLKTDGIYSLPTAVGSSNLPVENTACHIQVIAGTKHGWCRQLGYPAYTSDVYERHQTSSANDNWSAWKKLNSDGIPVGAIVSFPKAVQNPAGYLKANGTTFAQNTFPDLYRALGNSNRLPDLSRTDIGITAWFPSDQIPTGWLAFDDIRTRVTETAYPELYRLLTGKYGSIQNVPQAEDRFIRNAGNSLAVGTKQEDEIKRHVHKVFSHWTNHTDAAALGYEDRNERQRSALVSTWTDENLNDNGFLTPRSDSKMATGGDENRPKALVLKLCIKAADTLGEAVFWIKSHGETINAGALDAGTLAQGLQDKADRDHTHTAAQIQGLDEKISTAVAAQFTRQTIGGVDIVRFPDGTMIQTGSYRFTRSGGPIENEVVFPVAFADGNVKCFVSERHSERVTGDRRQHNWLFIRAKNHAAAIITNWYEGSCDWMAIGKAASGNAASSPIGPEIPETNEEPQRESGRTSTGPRNRRRRDGLLEALQD

SEQ ID NO: 7332 - protein, 175 aa, Neisseria meningitidis
MPRQSCHSSSFPPLSSFPRKRESRPPDATGIYRKNRNPRHRHSRESGNPAPKRGRNLSEKTETPAAVIPAQAGIQTPNAAGIYRKKQKSPPPSFPRRRESRPQTRQESIGKNRPPATVIPAQAGIQTPNAAGIYRKRLKPNGLDSRLRGNDGGRGFGIPAFAGMTESGGNNERRE

SEQ ID NO: 7333 - protein, 49 aa, Neisseria meningitidis
MQKRNTGKTPKQLVTIRLSADVVEKFRAGGKGWQTRINEVLRQYIAQLK

SEQ ID NO: 7334 - protein, 95 aa, Neisseria meningitidis
MKIEFDSEKNQRNIEERNLPFESVGQIRWTTAVIVPDVRFDYPEPRYVAAAYLGDTQRLHIVCFTPIKDGIRVISFRKANKREVKKYATSILNKR

SEQ ID NO: 7335 - protein, 201 aa, Neisseria meningitidis; identical to SEQ ID NO: 3432

SEQ ID NO: 7336 - protein, 98 aa, Neisseria meningitidis
MDAKHRLKKYVYHLLVAIDQLFNALTGGAADETLSSRTYRRARLAQKPKTRWKILYTLINGVFFDRHHCRQAYISELKGRQHDARFNQSRAAGEKGTR

SEQ ID NO: 7337-7338 - skipped (2 entries)

SEQ ID NO: 7339 - protein, 65 aa, Neisseria meningitidis
MRILILASRTAQNRAAGFNIRTRFGFCILQNPNLLFKFKLNSGVVVWYSGLTKIRTRRRSRRQYK

SEQ ID NO: 7340 - protein, 215 aa, Neisseria meningitidis; identical to SEQ ID NO: 1854

SEQ ID NO: 7341 - protein, 123 aa, Neisseria meningitidis; identical to SEQ ID NO: 3472

SEQ ID NO: 7342 - protein, 223 aa, Neisseria meningitidis
MKTVSTAVVLAAAAVSLTGCATESSRSLEVEKVASYNTQYHGVRTPISVGTFDNRSSFQKGIFSDGEDRLGSQAKTILVTHLQQTNRFNVLNRTNLNALKQESGISGKAHNLKGADYVVTGDVTEFGRRDVGDHQLFGILGRGKSQIAYAKVALNIVNVNTSEIVYSAQGAGEYALSNREIIGFGGTSGYDATLNGKVLDLAIREAVNSLVQAVDNGAWQPNR

SEQ ID NO: 7343 - protein, 239 aa, Neisseria meningitidis
MATLSDKTILVTGASQGLGEQVAKAYAAAGATVILVARHQKKLEKVYDAIVEAGYPEPFAICFDLISAEEKEFEHFAATIAEATQGKLDGIVHCAGYFYALSPLDFQTVAEWVNQYRINTVAPMGLTRALFPLLKQSPDASVIFVGESHGETPKAYWGGFGASKAALNYLCKVAADEWERFGNLRANVLVPGPINSPQRIKSHPGEAKSERKSYGDVLPAFVWWASAESKGRSGEIVYL

SEQ ID NO: 7344 - protein, 437 aa, Neisseria meningitidis; identical to SEQ ID NO: 3998

SEQ ID NO: 7345 - protein, 68 aa, Neisseria meningitidis
MKAVRDIALWLAVTVWINFFPDSYRYDTVPQGRYGYWHADHPWYPYARFLLPLFLACILFYRHFRKRK

SEQ ID NO: 7346 - protein, 290 aa, Neisseria meningitidis
MKGLDYCRQKAEESRSSFLSGFRFLTQEKRDAVTVLYAFCRELDDVVDECSNPDVAQATLNWWRGDLDKVFGGAMPEHPVNQALRQVKETFKLPKYELEALIDGMQMDLVQARYGSFEELKLYCHRVAGVVGCLIARILGFSDDQTLEYADKMGLALQLTNIIRDVGEDARRGRIYLPMEEMRRFDVPASVILQCSPTGNFAELMAFQIKRARETYREAVSLLPDADKKAQKVGLVMAAVYYELLNEIDRDGAQNVLKYKIALPSPRKKRIALKTWLFGFKPRPGTPERA

SEQ ID NO: 7347 - protein, 620 aa, Neisseria meningitidis
MALLQISEPGMSAAPHRHRLAAGIDLGTTNSLVATVRSGSAACLPDAEGRVTLPSVVRYLENGGIEVGKTALSAQKTDPLNTVSSAKRLIGRTLADLHQNTHYLPYRFGDNQRVIELHTRQGVKTPVEVSAEILKTLKSRAEETLGGDLVGVVITVPAYFDDAQRQATKDAARLAGLNVLRLLNEPTAAAIAYGLDNASEGTFVVYDLGGGTFDVSVLQLTKGLFEVKATGGNSALGGDDFDHRLFCRLLEQNGLSQLNEQDSQLLLSLVRAAKEQLTTQTEARIQATLSDGMAIDTSISRAEFHNLTQHLVMKTLEPVTQALKDAGVGKNEVKGVIMVGGSTRMLHVQQAVATFFGQTPLNNLNPDEVVALGAAIQANVLAGNKTDGEWLLLDVTPLSLGLETYGGLAEKIIPRNSTIPTARAQDFTTFKDGQTAMTIHVVQGERELVADCRSLAKFTLRGIPPMAAGAARIRVTFQIDADGLLSVSAQEQSTGVQAQIEVKPSYGLDDDTITQMLKDSMSNAAEDMAARARAEAVVEAESLTDAVNAALELDSDLLDAEELQQIRQGIADLQGRLKDGKAEDIRAAAAKLGSITDNFAAKRMNRNIQRALTGQSVDNI

SEQ ID NO: 7348 - protein, 218 aa, Neisseria meningitidis
MEKSGIVYLMKTVIKGVYKIGISDVSNFEGRMRHLENNGYANVAGLERILAVKTDNYKEKENLLHEIFSKSRIGDTELFAVDENLVKRLFLSLRGEIVFPKNETAESEFEKSVHERRQEGNAGSGRKQLLDLVRRGHREYPYALPRLLAGAAFYKPKKSKIRLFKEAYFGKSGTRLTDEIADGIHIYTCFSRADLEKAYSEYLELFKSESDAEGRKPQ

SEQ ID NO: 7349 - protein, 253 aa, Neisseria meningitidis
MMGDSVIYYVEQADEPVNRADERARKTFKYFWRELFWERRRIISALDFAMVKVPFFQDGEDGEICEHMWIDDIYFDGLYIYGVLNNEPGELTNVEQGESVCVPVDDISDWMFVCNGIPYGGFTIQAMRGQMTEEERTEHDAAWGIDFGDPGQILLVYEEKEHPENLEEHPMCRNCIDDFRQQLSQNSDYLREQDEDGYTPLHHEAIAGNALMVQAMLEYGANPASTTSEGYTALDFACLTGWQNVADLLEPRH

SEQ ID NO: 7350 - protein, 113 aa, Neisseria meningitidis
MPKITVLPHTTLCPEGAVIDNAPEGKTVLDVLLDHDIEVDHACEKSCACTTCHVIIRKGFDSLEEPTELEEDLLDQAWGLEADSRLSCQAVVAGEDLIVEIPKYTINHAREEH

SEQ ID NO: 7351 - protein, 47 aa, Neisseria meningitidis
MHRYLSVLQPEKPPAGYSGLNLNQYSVASPCRTICTVCGSPPCPDFC

SEQ ID NO: 7352 - protein, 227 aa, Neisseria meningitidis
MTRCGIRDGLCFFLPACRIFPSLRETERDGGAADKLEIASFKLRTGGGHAFYRNRETAARPGKAFRNLRVDEPTLGAQHCRIATGSRFIQGNQVAPVLVVKANRYSGEDMLPVQYLIQFAYQQNQAVKLLHLRQGIRMVGSGINQFGQFCGKHIVHQSSLSVETPLFGAVESDLFGRDNSSQIRTTHRLVLDVLSGELKHSAILKGRQFCRNIFYTASMPDDKRKFI

SEQ ID NO: 7353 - protein, 65 aa, Neisseria meningitidis
MKWTDTQRIAEELYDLHGETIDPRTVRFTQLRDLIMALPEFDDDPARCGERILEAVQQAWIDEAE

SEQ ID NO: 7354 - protein, 133 aa, Neisseria meningitidis
MKDKHDSSAMRLDKWLWAARFFKTRSLAQKHIELGRVQVNGSKVKNSKTIDIGDIIDLTLNSLPYKIKVKGLNHQRRPASEARLLYEEDAKTATLREERKQLDQFSRITSAYPDGRPTKRDRRQLDRLKKGDW

SEQ ID NO: 7355 - protein, 319 aa, Neisseria meningitidis
MKPVFLDFEQPIAELTNKIDELRFVQDESAVDISDEIHRLQKKSNDLTKSIFSKLTPAQISQVSRHPQRPYTLDYIEALFTDFEELHGDRHFADDYAIVGGLARFNGQSVMVVGHQKGRDTKEKIRRNFGMPRPEGYRKALRLMKTAEKFGLPVMTFIDTPGAYPGIGAEERGQSEAIGKNLYELTRLRVPVLCTVIGEGGSGGALAVALGDYVNMLQYSTYSVISPEGCASILWKTAEKAADAAQALGITADRLQKLDLVDTVIKEPLGGAHRDFGQTMKNVKAVLEKQLHEAQSIPLADLLSRRFDRIMAYGKFSEQ

SEQ ID NO: 7356 - protein, 426 aa, Neisseria meningitidis
MKDCFPQGLNGKKTAVALSGGLDSVVLLHLLVRAGKKGGFIPDALHIHHGLSPRADDWADFCQNYCDMLGVGLETVKVCVEKNGLGIEAAARQKRYAAFAEKGFDVLALAHHRDDQIETFMLAVARGGGLRALAAMPAVRPFGEKGIIWRPLLPFSRQDIWDYAQKHGLPNIEDESNTDTAYLRNRFRHRILPELSAQIPHFGRHVLNNVRALQEDLALLDEVVVQDCRWVCGAGYFDTARWLTFSPRRKTHILRHFLKENGIPVPNQNALADIARVLTEAKTGRWNLQGFELHHYAGRLFVFRLEKTDKLRFLKDRQISGNLREILTGQGFVLKRHPFGLPEHLLEQDGILRTVAASDTLAMGGIHKDVKKILQGKRVLPVLRPIWPLVADSGNRPLALANCCADFQYSVSDGILPVHPDFPILF

SEQ ID NO: 7357 - protein, 203 aa, Neisseria meningitidis
MPSEEVRKLTAVLPEDGFFSVSDGILKKISSLTCADDVLALIDIPDAGALPAGGDCVVLDGVQDPGNVGTVLRSAAAAGIGAVILGKGCADAWSPKVLRAGMGAHFLSEIYPQADLEIWLVRYKGRVFATALREEKQAVLYGEDLCEPTAWVFGNEGAGVGKAVLDRADKCVRIPMHDATESLNVAMAATICLFEQMRQRAAY

SEQ ID NO: 7358 - protein, 78 aa, Neisseria meningitidis
MYRFYAAVAVFLCGCFEAQEGGIAEGRAVETHLIVQCRGGGGFGLGVVEMVLTDIAQNRANGIRTNKEFGKKFVKSTN

SEQ ID NO: 7359 - protein, 121 aa, Neisseria meningitidis
MWGRYEKLRIFYDPTRAIYDSGADYLTREKHRLVVIANSAWGLLLNLSCYYDEVLEKRKIPFGKQEIDDDMDKVSALKRKFKDISEIKVGDGWEYPFNYEQGMKELDEVLLKYIPFFEEER

SEQ ID NO: 7360 - protein, 101 aa, Neisseria meningitidis
MRVSKIIGSMLLVTAVQTVFSANVYACRHNGKTSYSQTPGKHCTNAGLGRDRVYSSVRPAVKDRAEDAGVGDYSDTVRDEHVQNPKGNAQKDGSAAGIKPH

SEQ ID NO: 7361 - protein, 458 aa, Neisseria meningitidis; identical to SEQ ID NO: 868

SEQ ID NO: 7362 - protein, 350 aa, Neisseria meningitidis
MTVSPVALRRKTECKPHPTARYWKKCDVEALFGLPFLDLIYQAAEIHRQNFNPREIQLSTLLSIKTGGCPEDCAYCPQSAHHNTNLGKEQMMDVDEIVEKAKIAKSRGASRFCMGAAWRGPKPKDVETVSAIIKAVKGLGMETCGTFGMLEEGMAEDLKEAGLDYYNHNLDTDPDRYNDIIHTRQHEDRMDTLGKVRNAGLKVCCGGIVGMNETRAERAGLIASLANLDPQPESVPINRLVKVEGTPLADAEDLDWTEFVRTIAVARITMPQSYVRLSAGRSNMPEAMQAMCFMAGANSIFYGDKLLTTGNPDEDGDRILMEKLNLYPLQFEPEGEVAEVEKASGIKVDY

SEQ ID NO: 7363 - protein, 211 aa, Neisseria meningitidis
MNIKYSGIENRFETAILKKNGVRSGFVSFAPNLAAVKLNDYAKVRKRITKTKQKADIVIVMFHGGAEGKQAEHLPFDTEIFYGENRGNVVEFARLAVDSGADVVFGQGPHVTRAVELYRDRFISYSGGNFATYGAINTSGISGIAPIFKIITDKQGRFVSGNIIPITQVGDKIPKIDPEKTVIGRIIYLNRSDFPKGNGLDVSPDGSITRR

SEQ ID NO: 7364 - protein, 51 aa, Neisseria meningitidis
MSPTPIMETVSAVFSSGASCPSTSPVFETGAGFEPSIGSTGIPFRQDAPRA

SEQ ID NO: 7365 - protein, 47 aa, Neisseria meningitidis
MHSIFWGFAHFFGVPPSSNSVPSRLPTVMSASCKADSTFFRILVSGR

SEQ ID NO: 7366 - protein, 619 aa, Neisseria meningitidis
MPEYRSKTSTHGRNMAGARALWRATGVMETDFGKPIIAVANSFTQFVPGHVHLHNMGQLVAREIEKAGAIAKEFNTIAIDDGIAMGHSGMLYSLPSRDLIADSIEYMVNAHCADALVCISNCDKITPGMLIAAMRLNIPTIFVSGGPMEAGKVIGVANIQPERRLDLIDAMIESADDNVSNRQVEEVEQNACPTCGSCSGMFTANSMNCLTEALGLSLPGNGSYLATHAGRKELFLEAGRMIVEITKRYYEQNDETVLPRSIATKKAFENAMTMDIAMGGSTNTILHLLAVANEAGVDFKMADIDRLSRVVPCICKTAPNNHDYYMEDVHRAGGIFAILKELDKAGKLHTDVHTIHAPTLKDAIEQWDVTNPENTRAIERFKAAPGGVRTTQAFSQNRMWKTLDLDREKGCIRDVAHAYSQDGGLAVLFGNIAERGCVVKTAGVDESILKFTGRARVFESQEDAVEGILGNQIVAGDIVIIRYEGPKGGPGMQEMLYPTSYLKSKGLGKACALLTDGRFSGGTSGLSIGHASPEAAEGGAIGLVHEGDTVEIDIPNRSIHLAISDEELAARRAEMEARGSKAWKPKNRDRYVSAALRAYGAMATSADKGAVRDVAQIER

SEQ ID NO: 7367 - protein, 589 aa, Neisseria meningitidis
MTVQTKTKGLAWQEKPLSDNERLKTESNFLRGTILDDLKDPLTGGFKGDNFQLIRFHGMYEQDDRDIRAERAEAKLEPLKFMLLRCRLPGGIIKPSQWIELDKFARENSHYRSIRLTNRQTFQFHGVPKAKLQTMHRLLHKLGLDSIATAADMNRNVLCTSNPIESELHRQAYEYAKKISEHLLPRTRGYLDVWVDGKKVQSSDDFLQEDEPILGKTYLPRKFKTAVVIPPLNDVDCYGNDLDFVAVSDGNGQLAGFNVLAGGGLSMEHGNTKTYPNISLELGFVPPEHALKAAEAVVTTQRDFGNRSDRKNARTRYTIQNMGLDNFRAEVERRMGMPFEPVRPFKFTGRGDRIGWVKGIDGNWHLTLFIESGRLVDEGGKQLLTGVLEIAKIHKGDFRITANQNLIVANVAEADKAKIEEFARTYGLIRNDVSKLRENAMSCVSFPTCPLAMAEAERVLPDFIGELDKIMAKHGTSDDYIVTRITGCPNGCGRAMLAEIGLVGKAVGRYNLHIGGDREGVRIPRLYKENITLPEILAELDDLIGKWAAERNIGEGFGDFAIRTGIVKPVLNAPVDFWDASKAVAIARA

SEQ ID NO: 7368 - protein, 604 aa, Neisseria meningitidis
MSEHDMQNTNPPLPPLPPEITQLLSGLDAAQWAWLSGYAWAKAGNGASAGLPALQTALPAAEPFSVTVLSASQTGNAKSVADKAADSLEAAGIQVSRAELKDYKAKNIAGERRLLLVTSTQGEGEPPKEAVVLHKLLNGKKAPKLDKLQFAVLGLGDSSYPNFCQAGKDFDRRFEELGAKRLLERVDADLDFTASANAWTDNIAALLKEEAAKNRATPAPQTTPPAGLQTAPDGRYCKAAPFPAALLANQKITARQSDKDVRHIEIDLSGSDLHYLPGDALGVWFDNDPALVREILDLLGIDPATEIQAGGKMMPVARALSSHFELTQNTPAFVKGYAAFAHYEELDKIIADNAVLQDFVQNTPIVDVLHRFPASLTAEQFIRLLRPLAPRLYSISSAQAEVGDEVHLTVGVVRFEHEGRARTGGASGFLADRLEEDGTVRVFVERNDGFRLPEDSRKPIVMIGSGTGVAPFRAFVQQRAAENAEGKNWLIFGNPHFARDFLYQTEWQQFAKDGFLHRYDFAWSRDQEEKIYVQDKIREQAEGLWQWLQEGAHIYVCGDAAKMAKDVEAALLDVIIGAGHLDEEGAEEYLDMLREEKRYQRDVY

SEQ ID NO: 7369 - protein, 428 aa, Neisseria meningitidis
MTAQHQTPLRFITAGSVDDGKSTLIGRLLYDSKALLSDQIKTLESGKSKGLKEAIDFSILTDGLEAEREQGITIDVAYRYFSTAKRKFIIADTPGHEQYTRNMVTGASTASAAVVLVDASQLDFGAQPLQLLPQTKRHSAILRQLNCPHIVVAVNKMDLLDYSEDKFNAIVEAYRRLAEQLGLKDAHFVPMSALLGDNIVYPGGNMPWYKGEPLLSILETLPGADEVSRTADDFYFPVQLVVRQDADKADDFRGYQGRIERGSVAVGQTVRIEPNGLTAEVSEIITPKGEVAQAFAGEAATLRLDRDIDVSRGDLFVDKNSPLAPQKHLEATLCWFDERPLNTARKYLLKHGTQTVPAKVGEIESVLDVRTLEQEAGAESLKMNDIAKVRINLQKPVTATPYAENTAAGSFILIDEATYGTVAAGMIL

SEQ ID NO: 7370 - protein, 307 aa, Neisseria meningitidis
MTKTEPNNAQLDWLESESIHIIREVAAECENPALLFSGGKDSVVLLALACKAFRLGSRPVKLPFPLVHIDTGHNYPEVIAFRDAQAAKLNARLIVGRVEDSIAKGTVVLRKETDSRNAAQAVTLLETIEANGFDALMGGARRDEEKARAKERIFSFRDEFGQWDPKAQRPELWSLYNTRLHKGENMRVFPISNWTELDIWQYIARENLELPPIYYSHRREVVRRRGLLVPVTPLTPKMPSETSEILDVRFRTVGDISCTCPVESTASTPTEIIRETAVADISERSATRLDDQASEAAMEKRKKEGYF

SEQ ID NO: 7371 - protein, 246 aa, Neisseria meningitidis
METTLFKPALWQIPHIGSGGETALAEKTETLKQRLHRIVGSHRDARFASSLAAEDMVITDLIAGENLNIGIFTLDTGLLHTETLNLLDRLGRAYPHLRIKRFRPVREDADRYVESKGRFAFYDSVEARRECCRIRKTEPLNRAIAGADAWLTGQRREQSATRTELPFAEYDAGRGIGKYNPIFDWSEHDVWAYILANNVPYNDLYRQGFPSIGCDPCTRPVKAGEDIRAGRWWWEGRNSKECGLHK

SEQ ID NO: 7372 - protein, 483 aa, Neisseria meningitidis
MNYFPIFANLAGRPVLVVGGGAVAARKISLLLKAGAEVRVAAKHLNAELSALAAENKILWLAEEFRAEHIRTVFLIIAASSDQALNRRVFHLAESCQKPVNVVDDRDHCSFIFPSVIDRNPVQIAVSSSGSAPVLARLLRERLEALLPPSLGDMAEISGRWRDAVKGKLKSVTERRRFWEKQFNGRFAALVKNRQNTLAERELAGQLEQSRQNDQGGSVSLVGAGPGDAGLLTLKGLQEIQQADVVLYDALVSDGILSLVRRDAERIFVGKRARGERTPQEDTNALMVRLAREGRRVVRLKGGDPFVFGRGGEELETLARHQIPFSVVPGITAAVGATAYAGIPLTHRDYAQSAVFVTGHRKADAPDIEWQTLARSRQTLVIYMGALKAALIAERLQQHGRSPDTPAAVISQGTLPAQKTATGTLANLAELAETAPNPALIVIGEVVGLHEKLAWFGENGEGENRVGQTYPALGGLNAGQRAA

SEQ ID NO: 7373 - protein, 52 aa, Neisseria meningitidis
MPSEALFALRTASPHHANGLNARNGFRPFFFRNRYKTENRRIRSRPHIAFSF

SEQ ID NO: 7374 - protein, 218 aa, Neisseria meningitidis; identical to SEQ ID NO: 1604

SEQ ID NO: 7375 - protein, 296 aa, Neisseria meningitidis
MFPVFHLSGESRRQMLQTALRFPHVFKARAEDSHKGTFGTLAVVGGSAGMSGAPVLAASAAMYLGCGKVWAGFNQDTLPFAVIAGFPEIMLDTADSLAKRQDINAWVVGCGLGTGRAAVGTLAGILTEHTDKPVVLDADALNILSTDAETRNLARGCKNLILTPHPAEAARLLGTTVAQVQADRTAAVRKIGAIFGATVVLKGHKTLVASPDTEIYVNESGNAGLATAGSGDVLGGIIGSLLAQGVPVFEAACAGAWLHGAAADVIKESAGIAAGLLAGEIAPAARWLRNRITKSM

SEQ ID NO: 7376 - skipped

SEQ ID NO: 7377 - protein, 65 aa, Neisseria meningitidis; identical to SEQ ID NO: 7339

SEQ ID NO: 7378 - protein, 215 aa, Neisseria meningitidis; identical to SEQ ID NO: 1854

SEQ ID NO: 7379 - protein, 123 aa, Neisseria meningitidis; identical to SEQ ID NO: 3472

SEQ ID NO: 7380 - protein, 223 aa, Neisseria meningitidis; identical to SEQ ID NO: 7342

SEQ ID NO: 7381 - protein, 239 aa, Neisseria meningitidis; identical to SEQ ID NO: 7343

SEQ ID NO: 7382 - protein, 437 aa, Neisseria meningitidis; identical to SEQ ID NO: 3998

SEQ ID NO: 7383 - protein, 63 aa, Neisseria meningitidis
MIQTVTASHKAISLTAFIYFCSCLNSQQFHFKARTPTGLRGYDADFQTMVETPSGGAVGIGFA

SEQ ID NO: 7384 - protein, 290 aa, Neisseria meningitidis; identical to SEQ ID NO: 7346

SEQ ID NO: 7385 - protein, 620 aa, Neisseria meningitidis; identical to SEQ ID NO: 7347

SEQ ID NO: 7386 - protein, 218 aa, Neisseria meningitidis; identical to SEQ ID NO: 7348

SEQ ID NO: 7387 - protein, 253 aa, Neisseria meningitidis; identical to SEQ ID NO: 7349

SEQ ID NO: 7388 - protein, 113 aa, Neisseria meningitidis; identical to SEQ ID NO: 7350

SEQ ID NO: 7389 - protein, 47 aa, Neisseria meningitidis; identical to SEQ ID NO: 7351

SEQ ID NO: 7390 - protein, 227 aa, Neisseria meningitidis; identical to SEQ ID NO: 7352

SEQ ID NO: 7391 - protein, 65 aa, Neisseria meningitidis; identical to SEQ ID NO: 7353

SEQ ID NO: 7392 - protein, 133 aa, Neisseria meningitidis; identical to SEQ ID NO: 7354

SEQ ID NO: 7393 - protein, 319 aa, Neisseria meningitidis; identical to SEQ ID NO: 7355

SEQ ID NO: 7394 - protein, 426 aa, Neisseria meningitidis; identical to SEQ ID NO: 7356

SEQ ID NO: 7395 - protein, 203 aa, Neisseria meningitidis; identical to SEQ ID NO: 7357

SEQ ID NO: 7396 - protein, 78 aa, Neisseria meningitidis; identical to SEQ ID NO: 7358

SEQ ID NO: 7397 - protein, 121 aa, Neisseria meningitidis; identical to SEQ ID NO: 7359

SEQ ID NO: 7398 - protein, 101 aa, Neisseria meningitidis; identical to SEQ ID NO: 7360

SEQ ID NO: 7399 - protein, 458 aa, Neisseria meningitidis; identical to SEQ ID NO: 868

SEQ ID NO: 7400 - protein, 350 aa, Neisseria meningitidis; identical to SEQ ID NO: 7362

SEQ ID NO: 7401 - protein, 211 aa, Neisseria meningitidis; identical to SEQ ID NO: 7363

SEQ ID NO: 7402 - protein, 51 aa, Neisseria meningitidis; identical to SEQ ID NO: 7364

SEQ ID NO: 7403 - protein, 47 aa, Neisseria meningitidis; identical to SEQ ID NO: 7365

SEQ ID NO: 7404 - protein, 619 aa, Neisseria meningitidis; identical to SEQ ID NO: 7366

SEQ ID NO: 7405 - protein, 589 aa, Neisseria meningitidis; identical to SEQ ID NO: 7367

SEQ ID NO: 7406 - protein, 604 aa, Neisseria meningitidis; identical to SEQ ID NO: 7368

SEQ ID NO: 7407 - protein, 428 aa, Neisseria meningitidis; identical to SEQ ID NO: 7369

SEQ ID NO: 7408 - protein, 307 aa, Neisseria meningitidis; identical to SEQ ID NO: 7370

SEQ ID NO: 7409 - protein, 246 aa, Neisseria meningitidis; identical to SEQ ID NO: 7371

SEQ ID NO: 7410 - protein, 483 aa, Neisseria meningitidis; identical to SEQ ID NO: 7372

SEQ ID NO: 7411 - protein, 52 aa, Neisseria meningitidis; identical to SEQ ID NO: 7373

SEQ ID NO: 7412 - protein, 218 aa, Neisseria meningitidis; identical to SEQ ID NO: 1604

SEQ ID NO: 7413 - protein, 296 aa, Neisseria meningitidis; identical to SEQ ID NO: 7375

SEQ ID NO: 7414 - skipped

SEQ ID NO: 7415 - protein, 603 aa, Neisseria meningitidis; identical to SEQ ID NO: 1598

SEQ ID NO: 7416 - protein, 791 aa, Neisseria meningitidis
MNKNIKSLNLREKDPFLSREKQRYEHPLPSREWIIELLERKGVPSKIESLARELSITEDEYVFFERRLKAMARDGQVLINRRGAVCAADKLDLVKCRVEAHKDGFGFAVPLTPAKDGDFVLYERQMRGIMHGDIVTVRPAGMDRRGRREGTVLDIVERAQSKVVGRFYMDRGVAILEPEDKRLNQSIVLEPDGVARFKPESGQVIVGEIEVYPEQNRPAVAKIIEVLGDYADSGMEIEIAVRKHHLPHQFSEACAKAAKKIPVHVRKSDLKGRVDLRDLPLVTIDGETARDFDDAVFAEKVGRNYRLVVAIADVSHYVRPDDVIDADAQERSTSVYFPRRVIPMLPENLSNGICSLNPDVERLCMVCDMVVTYAGNIKEYRFYPAVMRSHARLTYNQVWKWISDGIDHPYKAQIDTLYKLFKILQKKRFERGAVEFESVETQMIFDDNGKIEKIVPVVRNDAHKLIEECMLAANVCAADFLLKNKHTALFRNHLGPTPEKLATLREQLGLLGLQLGGGDNPSPKDYAALVEQFKGRPDAELLQVMMLRSMQQAVYEPHCDGHFGLAYEAYAHFTSPIRRYPDLTVHRAIKAVLNQQTYTPKKSWQALGVHTSFCERRADDASRDVENWLKTYYMRDKVGEVFEGKISGMTSFGIFVTLDGIHIDGLVHISDLGEDYFNFRPEIMAIEGERSGIRFNMGDRVAVRVARADLDDGKIDFVLIAGGSGRGRKVKSSASAKPAGTAGKGKPKTAAEKKTARGGKVRGRGASAAAESRKKAKKPVPIKVKKRKGKS

SEQ ID NO: 7417 - protein, 487 aa, Neisseria meningitidis
MRIVEKAYTFDDVLLVPAHSTVLPRDVKLQTKLTREITLNLPLLSAAMDTVTEARLAISMAQEGGIGIIHKNMPPEMQARAVSKVKRHESGVVKDPVTVAPTTLIREVLEMRAQRKRKMSGLPVVENGKVVGIVTNRDLRFENRVDLPVSAIMTPRERLVTVPEGTSIDEARELMHTHKVERVLVLNEKDELKGLITVKDILKTTEFPNANKDSEGRLRVGAAVGTGGDTEERVKALVEAGVDVIVVDTAHGHSQGVIDRVRWVKETYPHIQVIGGNIATAKAALDLVAAGADAVKVGIGPGSICTTRIVAGVGVPQLTAIHNVAEALKGTGVPLIADGGIRFSGDIAKALAAGAYSVMLGGMFAGTEEAPGEIELYQGRSYKSYRGMGSLGAMSQGSADRYFQDKTDSTDKYVPEGIEGRVPYKGPIVNIIHQLTGGLRSSMGYLGCANIAEMHEKAEFVEITSAGMSESHVHDVQITKEAPNYHR

SEQ ID NO: 7418 - protein, 153 aa, Neisseria meningitidis
MNIIMDSTRKFGILWEENSECNGFIYGKIQIIIGENIYPKICPYGYFTLNAVFNSLKSSFEEKYYAGGNNGLDFGEQLFDIDKYNSLELCNIFSIDTTYMSGGGNCEIDCLVLEMGYSGEEERLFYSFDNGKNFKEIRYKKGTVESVIFQLNL

SEQ ID NO: 7419 - protein, 852 aa, Neisseria meningitidis
MPANLSSALETFKQQRDAAEAHYLKANRVSVFFREYTAAVETLLAALWAEYFQNSALCLMAVGGFGRGELYPCSDVDLAVVSPAPLSDGIQEQIARFVQTLWDCKLMPSVKSGSVDELCESVRNDITGDTAFLEARFLFGNRQTVDKLAEKMNAQRNVAAFVEAKLVEMEHRHAKSQGSGAVLEPNIKSCPGGLRDIHTLLWIAKAQGLATDLPDLLKQRILTRAEAGMLSHGYRRLAHIRIHLHLNAKRAEDRLLFDLQPQVAESMGYEGLNLRRQSEELMRVFYRAIKTVKQLGGILTPMLQSRVSSTPLRVTLRIDDDYIQVNNQIAARHTDIFFRRPEHIFKIVEIMQQRNDITALEPQTLRAWWGATRKINRSFYQNPENRRRFAGFFRNGNGLTQTLRFLNLYGVLGRYLPAWEKIIGLLQHDLFHIYPVDDHILTVVRNVRRLALDMHSHELPYASALMQSFEKQDILYLAAFFHDIAKGRGGDHAIQGIADARQFAADHFLTGEESDLLAWLVENHLLMSAVAQKEDIQDPSVLDAFCKRVQTHERLSALYLLTISDIRGTNPKLWNAWRASLLESLFHAAGRYLTGNGGNPHTLFGRRRQEAADLLTRAAVPEKQQKKLWNALGSAYFARHQSREILWHAANLVHDFETPIVRSRILPKSDSFQVMVFMPNGPRLFARLCRIFSRHGFDILAARAFITEHDYILDTFIVQIPSQHAPEDYPDIQSALEAELNSFIHGHTVAETQSRSRRISRRSRYMPIAPSITITPEEDYPDWYSVEITAVNRPFLLADMAEVFFAHNVSLRYAKISTLDERAEDSFTVFSPDLKNPKIQSSLKQTLLEQLS

SEQ ID NO: 7420 - protein, 106 aa, Neisseria meningitidis
MMGNKLTLPAELPDEQDLRAVLAYNMRLFRVNKGWSQEELARQCGLDRTYVSAVERKRWNIALSNIEKMAAALGVAAYQLLLPPQERLKLMTNSADTRQMPSESGI

SEQ ID NO: 7421 - protein, 48 aa, Neisseria meningitidis
MKFRVLVCCFPICLDFISFLLMCVCLGVAAATPFFWLLCEVKSVTANA

SEQ ID NO: 7422 - protein, 157 aa, Neisseria meningitidis
MKGDRLVIRELNKNLGLLLVTINQYFLHARILKNWGFEELGEHFFKQSIVEMKAADDLIERILFLEGLPNLQELGKLLIGESTEEIIACDLTKEQEKHEALLAAIATAEAQQDYVSRDLLEKQKDTNEEHIDWLETQQELIGKIGLPNYLQTAAQED

SEQ ID NO: 7423 - protein, 154 aa, Neisseria meningitidis
MQGNQAVVDYMNELLSGELAARDQYFIHSRLYSEWGYTKLFERLNHEMEEETTHAEDFIRRILMLGGTPKMARAELNIGTDVVSCLKADLQTEYEVRDALKKGIKLCEEAQDYVTRDLMVAQLKDTEEDHAHWLEQQLRLIELIGEGNYYQSQL

SEQ ID NO: 7424 - protein, 67 aa, Neisseria meningitidis
MRALYAKAVGMTNFLFKIQTIIKRNRAYSPMPSKSVCCFLSVFLLLKLRIHLIHKEHLHLLTIAKNK

SEQ ID NO: 7425 - protein, 67 aa, Neisseria meningitidis
MPSEGLSDGMPARTDAAWSGCRFEGVFNAKGNLSYDVFAAGALKKPGILGRSARLPGSISAIYSKPY

SEQ ID NO: 7426 - protein, 155 aa, Neisseria meningitidis
MKIENIDIISPELFPQETFNETEAFGALVWLWAVSPIYQHAGVQEAAVNILPVLKNGQFALFSSNGHPVAYCTWAYFDEETEWQYLQSNDVLRHSENWCSGNRMWLINWFAPFGDSRMMKRILVHLFPKREIRWLYHRGSEKGKRIMRFPALSKQ

SEQ ID NO: 7427 - protein, 80 aa, Neisseria meningitidis
MKYIVSISLAMGLAACSFGGFKPPPDDSVYWKYSRIEQEYPAMMSKNINLRIYSYEEYSKQIDDLFAKEKKTGKSAAMTQ

SEQ ID NO: 7428 - protein, 112 aa, Neisseria meningitidis; identical to SEQ ID NO: 3710

SEQ ID NO: 7429 - protein, 120 aa, Neisseria meningitidis
MKYIVSISLAMGLAACSFGGFKPPPDDSAFWRLTNYAKLYPGLTSATLDQYPPEERRRQLHDSFAREKKDWKECGYDPIGGGGGSEADACMRKRGWYRVGNDIYPENKKYEWPREEGKTK

SEQ ID NO: 7430 - protein, 2273 aa, Neisseria meningitidis
MNKRCYKVIFNKKRSCMMAVAENVHRDGKSMQDSEAASVRVTGAASVSSARAAFGFRMAAFSVMLALGVAAFSPAPASGIIADKSAPKNQQAVILQTANGLPQVNIQTPSSQGVSVNRFKQFDVDEKGVILNNSRSNTQTQLGGWIQGNPHLARGEARVIVNQIDSSNPSLLNGYIEVGGKRAEVVVANPSGIRVNGGGLINAASVTLTSGVPVLNNGNLTGFDVSSGKVVIGGKGLDTSDADYTRILSRAAEINAGVWGKDVKVVSGKNKLDFDGSLAKTASAPSSSDSVTPTVAIDTATLGGMYADKITLISTDNGAVIRNKGRIFAATGGVTLSADGKLSNSGSIDAAEITISAQTVDNRQGFIRSGKGSVLKVSDGINNQAGLIGSAGLLDIRDTGKSSLHINNTDGTIIAGKDVSLQAKSLDNDGILTAARDVSVSLHDDFAGKRDIEAGRTLTFSTQGRLKNTRIIQAGDTVSLTAAQIDNTVSGKIQSGNRTGLNGKNGITNRGLINSNGITLLQTEAKSDNAGTGRIYGSRVAVEADTLLNREETVNGETKAAVIAARERLDIGAREIENREAALLSSSGDLHIGSALNGSRQVQGANTSLHNRSAAIESSGNIRIATKDLQNTNEHLRFHTEETHREHRIEYQAEGRTERYPEGSQKELGWEIFEDESLHMRTPDGSPHSVWYKYDYERITAESKITESKPGQIISGGNLVLDAAKLKNHNSRIIAGGRLIVGTPESALDNDETLGTKTITDKGDLHRYHRHHKKGRDSTGYSRSPYEPAPEVSSIRMGISAYKGYAPQQASDIPGTVVPVVAENGIHPTFTLPNSSLFAIAPNNKGYLIETDPAFTDYRKWLGSGYMLAALQQDPNHIHKRLGDGYYEQKLVNEQIAKLTGYRRLDGYTNDEEQFKALMDNGITIAKELQLTPGIALSAEQVARLTSDIVWLENETVTLPDGTTQTVLKPKVYVRARPKDMNGQGALLSGSVVDIGSGAIENRGGLIAGREALILNAQNIKNLQGDLQGKNIFAAAGSDITNTGSIGAENALLLKASNNIESRSETRSNQNEQGSVRNIGRVAGIYLTGRQNGSVLLDAGNNIVLTASELTNQSEDGQTVLNAGGDIRSDTTGISRNQNTIFDSDNYVIRKEQNEVGSTIRTRGNLSLNAKGDIRIRAAEVGSEQGRLKLAAGRDIKVEAGKAHTETEDALKYTGRSGGGIKQKMTRHLKNQNGQAVSGTLDGKEIILVSGRDITVTGSNIIADNHTILSAKNNIVLKAAETRSRSAEMNKKEKSGLMGSGGIGFTAGSKKDTQTNRSETVSHTESVVGSLNGNTLISAGKHYTQTGSTISSPQGDVGISSGKISIDAAQNRYSQESKQVYEQKGVTVAISVPVVNTVMGAVDAVKAVQTVGKSKNSRVNAMAAANALNKGVDSGVALYNAARNPKKAAGQGISVSVTYGEQKNTSESRIKGTQVQEGKITGGGKVSLTASGAGKDSRITITGSDVYGGKGTRLKAENAVQIEAARQTHQERSENKSAGFNAGVAIAINKGISFGFTAGANYGKGYGNGDETAYRNSHIGSKDSQTAIESGGDTVIKGGQLKGKGVGVTAESLHIESLQDTAVFKGKQENVSAQVTVGYGFSVGGSYNRSKSSSDYASVNEQSGIFAGGDGYRIRVNGKTGLVGAAVVSDADKSKNLLKTSEIWHKDIQNHASAAASALGLSGGFSYSPKPTSGQYSTKKEAEIGKIGGKPVSLMRFDQVSAKDDELNEKYRSERIEKGETFKEANLNQNNAGGLKFGLKQNDIHSNDKYALAKMGLGNLLGNAKESESRQSITRSVISEGDWQIASAQGRKNIAGIEKGTSSAHKALAKADREGLLKEVELNRDVAKEFINETLIGGIADEAYRSQFIAEHRLMTFKMDENGEPIEDKQLEEDINKQFDNSVKLKKEFASFKDYWEAYKAIGGNIYELREVSDQERKNLKTARYTDPETGKTVEKIVVGVNGIFNNIQAAAKFAAQQYVGRFNPEKNRYERTYENVYFLHNPETNGRGFSKLPEIAVAAFHKMLEGAKIGNKTVIGLSNSGLALGNIMEDYGKDKNGLFVGSHSRGTLVVDNVLNTLNTQANRDKKILSNTELKMVGPAANVVRADKRLFQLQQGVTTPRTADFARQSIQIENHELDLIGMLIGRNPATVGTNTRQKSQWQAIRDIIGDYTSPHNCYGMANKQCVTDGYRDPENKQTQSPTGVFERGVSNEIEIMYRPVRIYDLQHPKGKTK

SEQ ID NO: 7431 - protein, 52 aa, Neisseria meningitidis
MDQQPLLKLPNSHIIIWRMDGLGKIFSQLKNNDNLFIEAYLRPVNFHSNSFE

SEQ ID NO: 7432 - protein, 327 aa, Neisseria meningitidis
MSEIKTDDPKRGIKLRGADKTARIPIKVVPLQEKLKKPEWIRAKLPSRKFFEIKDILREQKMHTVCEEASCPNIGECFSKGTATFMIMGDICTRRCPFCDVGHGRPNMLDPDEPRNLAESVKAMNLRYVVITSVDRDDLRDGGAQHFADCIKAIRETSPNTKIEILVPDFRGRLDIALKILAETPPDVMNHNLETHPSLYRKARPGANYQHSLDLLKRYKEMMPHIPTKSGIMVGLGETDEDVREIMRDMRAHNIEMITIGQYLQPSDGHLPVLRYVTPEQFKIFEKEAYELGFSNAAIGAMVRSSYHADEQAAEALRESHGGCGHH

SEQ ID NO: 7433 - protein, 207 aa, Neisseria meningitidis
MKIIHKGLVEYLPTFEAMKTFNAGRNADTEDELWVVEHPPVFTQGLAGKPEHLLIRDDIPVVQIDRGGQITYHGPGQLVVYTMIDFKRRKTSVRNIVSALENSIIATLAEYGIEAAADPKRPGVYVGERKIASLGLRIKNGSVYHGLALNVNMDLSPFTHINPCGYAGMEMTQIADFVQPCPTPDEVAAKLTAHLETQFTPKADNNE

SEQ ID NO: 7434 - protein, 91 aa, Neisseria meningitidis
MTEQKNKTSLIEFPCTFPLKVMGAVHPEFEQAVLDTVRLHAPDTQAHHITTRPSSKGNYTGATVQVKVENQEQLDNIYRALTSHELVKVVL

SEQ ID NO: 7435 - protein, 356 aa, Neisseria meningitidis; identical to SEQ ID NO: 784

SEQ ID NO: 7436 - protein, 315 aa, Neisseria meningitidis; identical to SEQ ID NO: 2438

SEQ ID NO: 7437 - protein, 135 aa, Neisseria meningitidis
MTVWFVAAVAVLIIELLTGTVYLLVVSAALAGSGIAYGLTGSTPAAVLTAALLSALGIWFVHAKTAVRKVETDSYQDLDAGQYVEILRHTGGNRYEVFYRGTHWQAQNTGQEELEPGTRALIVRKEGNLLIITHP

SEQ ID NO: 7438 - protein, 219 aa, Neisseria meningitidis
MDTWHDALGGEKQQPYFQEILNAVRQERLSGQIIYPPAADVFNAFRLTAFDRVKAVILGQDPYHGAGQAHGLAFSVRQGIRIPPSLLNIYKELETDIEGFSIPAHGCLTAWAEQGVLLLNTVLTVRAGQAHSHALLGWERFTDTVIRQLATHRKHLVFMLWGGYAQQKGRLIDSQNHLILTAPHPSPLSAYRGFFGCRHFSQANSYLSRHGIDPINWKL

SEQ ID NO: 7439 - skipped

SEQ ID NO: 7440 - protein, 133 aa, Neisseria meningitidis
MMKKQRHILCVGCLYIILKVNVFPNTGWMEASKGMQGMSFSTFGYADAPGYTFSRIGHTLIFLLGKTTGTRTTVSDSSHNVYYVKLYICANNSKALSCCLMLCQFGRKLSICAIKRALRWRSSKWVSSWTTTY

SEQ ID NO: 7441 - protein, 171 aa, Neisseria meningitidis
MKSKLLLILINFSLISSPLGANAAKIYTCTINGETVYTTKPSKSCHSTDLPPIGNYSSERYIPPQTPEPVSSPSNGGQVVKYKAPVKTVSKPAKSNTPPPQQAPSNNSRRSILETELSNERKALVEAQKMLSQARLAKGGNINHQEINALQSNVLDRQQNIQALQRELGRM

SEQ ID NO: 7442 - protein, 640 aa, Neisseria meningitidis
MIEIKNLTLQRGLKVLLDKANATVNPGQRVGLIGKNGTGKSSLFALIKGEITQDGGDVSIPKNWRLASVSQETPDLDISALDYVLQGDAELQAFQTALRQAEAQNDGMKQAEYHAKLEEIDAYTAPARAAKLLNGLGFSQEEHSRPVKSFSGGWRMRLNLAQALICRADLLLLDEPTNHLDLETVLWLENHLASLPCTQIIISHDRDFLNAETTQTIELSQQKLTQYGGNYDFYQNERAQRLAQQQAAYVKQQAQIKHLQSFIDRFKAKATKAVQAQSRMKALAKLERIAPAHLDSEFSFEFYHPDHLPNPLLKLEHADLGYEGKTVLHDITLSLESGARYGLLGVNGSGKSTFIKALAGTIDLLSGSIVRSEKLNIGYFAQHQLDTIRSDQNPVWHIQQLSPEVREQEIRNFLGGFNFVGDMALQKTEPFSGGEKARLALAMIIWQKPNLLLLDEPTNHLDLDMRHALTLALQSFQGALIVVSHDRSLLEATTDSFLLIDKGRLKNFDGDLNDYRQWRLAQENAAVAPAASAQSQSRKDTKRIEAQIRQEKARRGKPIQQKIDRAEKEMAQLSEIQTACEAFLAQEEAYFEENKEKLQDTLSELAKVKTQLAQIEEVWLACQEELEQIETEIEKQFAER

SEQ ID NO: 7443 - protein, 131 aa, Neisseria meningitidis
MMRQRGKKMLFEENPIDGQFAEYECGAGGIRLAGQSFHKPVLVHKDSVCLSQCRTLSDLTPENLLSDVKPVDYPEILIIGTGAAQEFIHPKIMADFSRIGISVECMNTDSAFRTLVFLHSEGRRAWAWLQP

SEQ ID NO: 7444 - protein, 435 aa, Neisseria meningitidis
MKPVNIGLLGLGTVGGGTAAVLRDNAEEISRRLGREIRISAVCDLSEEKARQTCPSAAFVKDPFELVAREDVDVVVELFGGTGIAKDAVLKAIENGKHIVTANKKLLAEYGNEIFPLAEKQNVIVQFEAAVAGGIPIIKALREGLAANRIKSIAGIINGTSNFILSEMREKGSAFADVLKEAQALGYAEADPTFDIEGNDAGHKITIMSALAFGTPMNFSACYLEGISKLDSRDIKYAEELGYRIKLLGITRKTGKGIELRVHPTLIPESRLLANVNGVMNAVRVNADMVGETLYYGAGAGALPTASAVVADIIDIARLVEADTAHRVPHLAFQPAQVQAQTILPMDEITSSYYLRVQAKDEPGTLGQIAALLAQENVSIEALIQKGVIDQTTAEIVILTHSTVEKHIKSAIAAIEALDCVEKPITMIRMESLHD

SEQ ID NO: 7445 - protein, 144 aa, Neisseria meningitidis; identical to SEQ ID NO: 2462

SEQ ID NO: 7446 - protein, 89 aa, Neisseria meningitidis
MNKSELIEAIAQEADISKAAAQKALDATTNAVTTALKQGDTVTLVGFGTFYVGERAERQGRNPKTGEPLTIAAAKTPKFRAGKALKDAL

SEQ ID NO: 7447 - protein, 820 aa, Neisseria meningitidis
MTQKEKHFEEYAALATLPLRDVVVYPHMVLPLFVGRPKSIAALENAITREEPVFLLAQTDAAVEEPIAADLYQTGTVAQVLQVLKLPDGTVKVLVEGLYRGRVLTIEDTGGLFVSHIETVVEEDTGGNTDLEAVRRTLLAQFEQYAKLNKKIPAEIIGSINGIAENSRLTDTVAAHLQLKLAQRQQILEIPEIGKRMEFLLAQLESELDIMQAEKRIRGRVKRQMEKSQREYYLNEQIKAIHKELGEEDENGELDALEADIKKAGMTKEAEEKCLSELKKLKMMPPMSAESTVVRNYIDTLLELPWKKKSRVSKDIAKAGLVLDADHYGLEKVKERILEYLAVQKRMDKLKGPILCLVGPPGVGKTSLGESIAKATGRKYVRMALGGVRDESEIRGHRRTYIGSMPGKILQNMAKAGVKNPLFLLDEIDKLGNDFRGDPASALLEVLDPEQNNKFADHYAEVDYDLSDVMFIATSNSLNIPTPLLDRMEIIRLSGYTEDEKINIAMQYLVPKQMKRNGVKEGELAIEESAVRDIIRYYTREAGVRSLDREIAKICRKVVMQITLDEDKKRLSETKKTSKAKPKAVKVNEKNLHDYLGVRRFDYGVAESENRIGQVTGLAWTEVGGELLTVEAAALPGKGVIQCTGQLGDVMKESVSAAWSVVRSRAESVGLAPDFYEKKDIHIHVPEGATPKDGPSAGIAMTLAAVSAFTKIPVRADVAMTGEITLRGEVLPIGGLKEKLLAALRGGIKHVLIPKDNVKDLEEIPENVKTGLTIHPVKWIDEVLALGLESQPEPWAEPSGAEAAAESASKPKPRSRATKH

SEQ ID NO: 7448 - protein, 306 aa, Neisseria meningitidis
MKKRVRKPAAVRSDADIAALFHAHRMKQAQQSRILNMLAVEIRPGFVLDNKRAPDIRSALLDVYGEADGKPFFLPLNLLLGFMGAHEWHKKGVAVPQLGGSIHVPFGVFSPLRGEYLDLLAHAPSTGFQTAFDIGTGSGVLAAILAKQGIPSVIGTDTNPKAVACARANIARLGFEKQVEIRETDLFPEGFADLIVCNPPWLPAKPTSAVESALYDPESAMLAAFLRDAPKHLNPDGEIRLIISDLAEHLHLRPSDFLDKAFAQAGLRVADMMKTKPKHKKAANPSDPLAFARTRETTFLYRLKKA

SEQ ID NO: 7449 - protein, 581 aa, Neisseria meningitidis
MERQTDEFAQAAARAAIRFLEHYAGSGDEVLANCTERLFQALQNGHSFIRLSGGEADALSALAPVVGTSAAPLILEGRRLFLGRMWQLEYDLAAEIKRLAAAGTSAPDAAGARQNLAKWFQGTGSEGQRDAAALALLQSFMVITGGPGTGKTTTVAKLLALICGEDENLPNIALAAPTGKAAAHMARALHRAINGFDAPEAVRRHLLKLEGQTVHRLLKLRPPKMQAAFNPVYPLPFDVLVIDEASMLDTALMLQLLKAVKTGARVILLGDENQLPSVGIGAVLSVLSQKTVLDGETHQRLAGFLPEHGFSVSANPPVLAQNTAHLSFSHRFGDNSGIGCLARAAVSGDEGAWALFDRFPDELEHSECSPNARVERLYRAHKAYWQAVKDGNIEAAYAGISDIVVLAAWRQDAEDFNEAYCRHVRRKMNIPEHLAYFAGEPIMIRQNDYALELFNGDIGLIMEDVGRQGSLAAYFADADGFKKVAVSCLPEFEPAFAMTVHKSQGSEYREVWLLPPSAAPSDEGDDALSGLSKELLYTAITRAREKFVFFGGEEAFRQAAATVKTRQTALGSMLERVFSQE

SEQ ID NO: 7450 - protein, 231 aa, Neisseria meningitidis
MSELILKCEGVGKRYRDGGLDVRVLHGLDLEIHAGESTGIIGSSGSGKSTLLHILGGLDMPSEGRVLLMGEDLRTLNQRRLGDLRNRHLGFVYQFHHLLPEFSALENVMMPLLIGKKSREEAAEAAMAMLEKVGLKHRSTHRAGELSGGERQRAAIARALVTQPKCLLADEPTGNLDRANARNVLDMMLELKTELGTGLVVVTHDDELAGRFERVMVMKDGSLHPKQGANA

SEQ ID NO: 7451 - protein, 415 aa, Neisseria meningitidis
MFSLEAWIGLRYLRAKKRNGFMSFITMVSIAGIALGVTALIVVLSVMNGFQKEIRGQLLNVAPHAEIGYIDNTDTDWRNLLRFTENRKGILAAAPYVSNQALLANAGEIRGVQMRGILPSEERKVVEYGDKMPAGKFEDLIPGEFDIILGVGLAEALGAEVGNKVTVITPEGNVTPAGVVPRLKQFTVVGLVKTGVYEVDNSLAMTHIQDARVLYRLDKEVAGLRLKLADPQNAPALTATLIPEAQRDAVWVRDWTYSNRSYFEAVELEKRMMFIILTLIIAVAAFNLVSSLVMAVTEKQADIAILRTLGLSPAGVMKIFMVQGAFSGFFGTLAGVVCGVLLGWNVGRVVAFFENLLGVHLINSQVYFIDYLPSDVDMGDVALIACISLGLSFVATLYPSRRASKTQPAEALRYE

SEQ ID NO: 7452 - protein, 92 aa, Neisseria meningitidis
MNIRTAFALCAIALSAAAAAYAKEIKIDANNTPYSEADAQKLAATAVGMGVKEPISLNGGSGSITVSGSSATQCVFKVGNGGALQIQGLNCK

SEQ ID NO: 7453 - protein, 206 aa, Neisseria meningitidis
MMSHKKQDAFQGLIDALKVLPNVGPKSAQRIAYHLLQHKRKEAEKLVDALQTALKQVYHCAMCNTFCEGGLCDICADETRDGRRLMVVHMPADVSNMEAANCHDGLYFVLMGQINTALGMDVSAIALDRLAQRLGGGEVEEIIIATAFTAEGNATAYVLSEFFKNLPYKVSRLSQGIPLGGELEYVDAGTLAQAVYERRLIKEGGA

SEQ ID NO: 7454 - protein, 512 aa, Neisseria meningitidis; identical to SEQ ID NO: 1818

SEQ ID NO: 7455 - protein, 124 aa, Neisseria meningitidis
MIVLHGIPNCDTVKKAKNRLAGYGLEFEFRDFKKQRPSEAEICSWLEQVPLATLLNKRGTSWRKLDAETQQKVLSSTAEAVKLMSEMPSLIKRPVLECGGKVYAGFSEETYDGIFNRQAPCRQG

SEQ ID NO: 7456 - protein, 542 aa, Neisseria meningitidis
MISTNGITMQFGAKPLFENVSVKFGEGNRYGLIGANGSGKSTFMKILGGDLEQTAGEVAIENGVRLGKLRQDQFAYEDMRVLDVVMMGHTEMWAAMTERDAIYANPEATEDDYMKAAELEAKFAEYDGYTAEARAAELLSGVGISEDLHNAKMAEVAPGFKLRVLLAQALFSKPDVLLLDEPTNNLDINTIRWLEGVLNQYDSTMIIISHDRHFLNEVCTHMADLDYNTITIYPGNYDDYMLASAQSRERALKDNAKAKEKLQELQEFVARFSANKSKARQATSRLKQADKIKSEMVEVKPSTRQNPYIRFEADEKAKLHRQAVEVEKLAKRFETQLFKNLNFILEAGQRLAIIGPNGAGKSTLLKLLAGAYNPEYSDGLLPDEGTIKWAEKASVGYYPQDHENDFDVDMDLSEWMRQWGQEGDDEQVIRGTLGRLLFGSNDVVKKVKVLSGGEKGRMLYGKLLLLKPNVLVMDEPTNHMDMESIESLNMALEKYNGTLIFVSHDRQFVSSLATQIIELDGKGGYEHYLGDYESYLEKKGVA

SEQ ID NO: 7457 - protein, 417 aa, Neisseria meningitidis
MQTYLVGGAVRDYLLGLPVKDRDWVVVGADAQTMLAQGFQPVGKDFPVFLHPETHEEYALARTERKTAKGYVGFSFHADKDVTLEQDLMRRDLTINAMAQDADGKIIDPFGGQRDLAAGILRHVSPAFAEDPVRILRTARFAARYKFEIAEETIKLMRQMVENGEADALVAERVWQEFAKGLMEKNPRKMIEVLRECGALKVLLPEVNALFGVPQRADYHPEIDSGIHTLMTLQRAADMGLSLPERYAALLHDLGKAKTPSDILPRHHGHDLAGVEPVREVNQRLRAPKHCAELAELVCRWHIIFHQVGQLKSQTILNVLKKTDAFRRPERFQTALNVCIADTQGRLNREHTPYPQRAHWLALLEAANQADSGKIAAECRAQGKAHLIAEQIDRARLAQIAPLQKAFRAAQDKTEKH

SEQ ID NO: 7458 - protein, 102 aa, Neisseria meningitidis
MTLKTDLLPKINNEDYQRLILKHSAEFSGGEIRLLNEILEKFNFDVVQAQALAQAVMQQIRFDPNAYHIDSDDEDTTGICPHCINPPMPPLRDYLVWRETRG

SEQ ID NO: 7459 - protein, 343 aa, Neisseria meningitidis
MLQTDNLTAAQPQRIVAAQTASAQEELLERALRPKTLDDYIGQDKAKEQLAIFIQAAKKRGEALDHVLLFGPPGLGKTTLAHIIAKELGVNLRQTSGPVLERAGDLAALLTNLDPHDVLFIDEIHRLSPVVEEILYPALEDYRLDIMIGEGPAARSVKIDLPPFTLIGATTRAGMLTNPLRDRFGIVSRLEFYENRDLTTIVSRSAQLLQLDMSEEGAEEIAKRSRGTPRIANRLLRRVRDFADVKNNGTIDGGIADAALSMLDVDAQGLDVMDRKFLEAVLHKFGGGPVGLDNVAAAIGESTDTIEDVIEPYLIQQGFLQRTPRGRMATERAYLHFGLPVEK

SEQ ID NO: 7460 - protein, 242 aa, Neisseria meningitidis
MTTYRIAPSILSADFARLGEEVESVIAAGADLIHFDVMDNHYVPNLTFGPMVCAALKPYASVPIDVHLMVEPVDDLIQSFAKAGASIITFHPEASRHIDRSLSLIRDMGCQAGLVLNPATPVYLLENVLDRLDMVLLMSVNPGFGGQSFIPHTLEKIRRVRAMLDRYEAQSGRHIAIEVDGGIKTDNIAAVARAGADTFVAGSAIFGKPDYKAVIDAMRAELEKSGRLNLAPMIEIEMPSEN

SEQ ID NO: 7461 - protein, 111 aa, Neisseria meningitidis
MEEPVLDFQFVHRKIHTGQIAAFDIIARLVPIKNIRGNDFDDRPAAAVFGMHNLQTRPVARHFEGGADFTQLIVLTLGQPESAYVAVRLKIVRGDISRGGVGKLTGKQSHT

SEQ ID NO: 7462 - protein, 287 aa, Neisseria meningitidis
MELNEFLDKAYAVLRRLDAVLPPEPGHTDWNALAFRWQSAGKKGFLEHLPDPHTFPLVRLAGVGRQTELLVRNTEQFIVGRPANNVLMSGARGTGKSSLVKALLHEYADKGLRLIEVDKSDLIGLPYLLTLLKECPEKFIVFCDDLSFESGDETYKALKTALDGGLSQRCANVLVYATSNRRHLMPEYFDENAGTTGMRGEIHQKEAVEEKISLSDRFGLWLSFYPFDQNDYLAAVQNWLEDFGVPYDETAQMAALQWAQTRGSRSGRSAWQFACDWAGRLPKQRAL

SEQ ID NO: 7463 - protein, 234 aa, Neisseria meningitidis
MLSEGISDGIFRGEMLQFAPFLPTQGNRIMFTGIVQGLGKLTAIHRPSEAFHTYVVELPQEAADNLQRGASVANNGCCLTITEIEGNRVSFDLMAETLAKTNLGLLKEGDCVNIERAARFGDEIGGHVMSGHIMATVPIVEIERDGFNRTVWFSLPHELKPYILTKGFVGLDGCSLTIGKVEDGRFNVHLIPETLERTLFGSRKVGDRINIEIDPNTQAIVDTVERLMAQRYAK

SEQ ID NO: 7464 - skipped

SEQ ID NO: 7465 - protein, 590 aa, Neisseria meningitidis; identical to SEQ ID NO: 2638

SEQ ID NO: 7466 - protein, 218 aa, Neisseria meningitidis
MTIKIILIDDHTLFRSGIKALLSRQHGFEVIGEAADGLSGIKMISRLQPDVVLLDLDMPGMNGREALSQIISINPQQAVIMLTVSEDSDDLTECMRIGARGYLLKNINADFLLESIRKAAEGDNVFSPEMTAKLVKSLISPQPAQGTQALSSLTPRELEILGYLAAGHSNKIIARHLDLAESTVKVHVQNLLRKLNLSSRVQAAVYAIRHNVPQPVPE

SEQ ID NO: 7467 - protein, 321 aa, Neisseria meningitidis
MSYTQLTQGERYHIQYLSRHCTVTEIAKQLNRHKSTISREIRRHRTQGQQYSAEKAQRQSRTIKQRKRQPYKLDSQLIQHIDPFIRRKLSPEQVCAYLCKHHQITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRALKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLIH

SEQ ID NO: 7468 - protein, 344 aa, Neisseria meningitidis
MSTSLSYRDAGVDIDAGDQLVENIKPFAKRTMRPEVLGDLGGFGALVEIGKKYQNPVLVSGTDGVGTKLKLAFDWDKHDTVGIDLVAMSVNDILVQGAEPLFFLDYFACGKLDVPRATDVIKGIAQGCEESGCALIGGETAEMPGMYPVGEYDLAGFAVGVVEKENVITGRSIGVGDVVLGLASNGAHSNGYSLIRKIIERDNPDLDAEFDNGKTLREAVIAPTRLYVKPILAALEKFTIKGMAHITGGGITENVPRVLPENTVAQIDAKSWELPKLFQWLQKAGNVETQEMYRTFNCGIGMVVIVAAEDADAVQGLLGEQGETVYRLGLIRERQGDEHQTQVA

SEQ ID NO: 7469 - protein, 225 aa, Neisseria meningitidis
MPAALIKDFLLTQGLKLPLDEVRAAYLTAQTVMDMGTASIDRSVLWRSDEGWKLADYLSCDNVREDALKRLFMALDSVFSRSTGVRSAAVYALMPSENQAFQLICLSRQGEVLENLWDLDEAAGKVSLACRSAQSGWMNVASDVRRWLDLGELSGERNHASAAQISIPVCTESGGVLGVVHVEFECAECAGTAAQVEWVALALALSEPLKLLLGMSAGKDGSEDV

SEQ ID NO: 7470 - protein, 197 aa, Neisseria meningitidis
MSEMLNHVASCRLPTEWGVFTMHGFEEANGQEHVALTVGNFSDGNPVLTRIHSECLTGDALFSRKCDCGPQLEAAMRAVQTEGRGIIVYLRQEGRGIGLINKIRAYHLQDQGMDTVEANLALGLPVDARDFRLAQSIYEYLGIRSVKLLTNNPEKIQTLKDAGINVVERIPLHVGENLENKRYLQTKADKLGHLMSE

SEQ ID NO: 7471 - skipped

SEQ ID NO: 7472 - protein, 363 aa, Neisseria meningitidis
MSHISPIPEILADIKAGKMVIITDAEDRENEGDLLMAAQFVTPEAINFMIKHARGLVCLPMDGEMVEKLGLPMMTQKNGAQYGTNFTVSIEAAHGITTGISAADRALTIQTAVSPTAKPEDIVQPGHIFPLRAQKGGVLVRAGHTEAGVDLAQMNGLIPASVICEIINDDGTMARMPELMKFAEEHKLKIGTIADLIEYRSRTESLLEDMGNAPVQTPWGEFQQHVYVDKLSGETHLALVKGTPAADTETLVRVHEPFSVMDFIQANPRHSWSLPKALEHIQQAESGVVILLHRTEDGASLLDRTLPKGANQAYKWDSKSYGIGAQILAGLNVKKLRVLGQPSSFTGLTGFGLEVVGFEEAEK

SEQ ID NO: 7473 - protein, 76 aa, Neisseria meningitidis
MEDFSVVIGYDEIKAKNHSLSAGQYFEVKIDYVDISADEFAQKMAGFSADLDKLFAESAELEKEIKDRLAMLKFNS

SEQ ID NO: 7474 - protein, 436 aa, Neisseria meningitidis
MTDLFAREPDAPLAERLRPHTLDDVVGQEHLIGEGKPLRVAVEGGKPHSMLLWGPPGVGKTTLARILAQSFNAQFLPVSAVFSGVKDIREAIDKAEIALQQGRATILFVDEVHRFNKAQQDAFLPHVESGLLTFIGATTENPSFEVNPALLSRAQVYVLQPLSSDDLKKLIAKVLALPEYQEFTIETDAQKLLVNTADGDARRLLNLLEQLLRAADTRRLKNLTAEFLADSLGAQIRRFDKGGESFYNQISALHKSVRGSHPNAALYWFCRMLDGGTDPRYLARRIVRIAWEDIGLADPRAFQIANDAAATFERLGSPEGELALAQAVLYLAAAAKSNAGYKAYNQMRHFVKENASDEVPVHLRNAPTKLMKELGYGREYRYAHDEPNAYSAGESYMPDGLDEPDFYQPVPRGLEIKIGEKLEWLKSLDEEVLKAK

SEQ ID NO: 7475 - protein, 321 aa, Neisseria meningitidis; identical to SEQ ID NO: 7467

SEQ ID NO: 7476 - protein, 979 aa, Neisseria meningitidis
MSGFNYEKNQPHQMRAVSAVLGVFDGATPKYRTADENPELLFAAKQYANNILKVQSQNGIDGRFPDRSDDQNILDISMETGTGKTYTYTQTMFELHRWLGVFKFIVVVPTLSIKAGTQQFLQSKALAEHFEQDFGGDYEGVRLKTYVVESAKKNKGKKSNAPITIEQFVKAENKKEIHVLLINAGMVNSSSMNDTGDKALKDLFDNPVDALAAVRPFMIVDEPHKFPTRDSAKTWGNIKRLKPQYILRYGATFNDEYYNLLYRLTAVDAFNDGLVKGVRVFQEEMQGGMDAAVKLVSSDGKEAKFELNEKDKKQTFKLAKGEDLAQIHPAISDLKIDKMNKTVVVLSNGLELKTGAVINPYSYSQTVQDAMMQRAVAEHFKLERALLAERAPQPKIKPLTLFFIDDIAGYRSGNELSGSLKDKFESWIRAEAARRLKTESDPFYRDYLQKTLDDVSACHGGYFSKDNTDSDDRIEQEINEILHDKEKLLSLDNPRRFIFSKWTLREGWDNPNVFQICKLRSSGSTTSKLQEVGRGLRLPVNELMARVRDVPYKLNYFVDSSEKDFVKQLVGEINDNSFQEEISKKFTEELKQKILQKYPDIKPLVLVNQLFLDGIIDDNENFAEDGYDKLKAAYPEAFPKGLDKGKVSNAKDEGKDTIIMREGKYEELKALWELIHHKAVLQYKIKDEAEFADLFTAYLHENAAKFPQAGIRTAVNEAYINNGLMLSRRIDSFEDEDFIRFNTMTYREFLEKLAQTAKIRMQTLHQAFYCIRNELNIGDFLNMQTIAQIKNGFNRFLLHHSFHKFELDYRLVGSKIHPTKFTNKDGKPRAVKKADLGRFEDTEHRPAAGYLFGEIFYDSDIEHENVANNQIEGVIVFTKIPRNSIKIPVAGGGTYSPDFAYIVKTKSGEILNFVIEAKGTDGAEDLRKSEERKIKHAEKLFAEISKEIKVVFKTQFDGERIAELIGQNMPAGGHSENGR

SEQ ID NO: 7477 - skipped

SEQ ID NO: 7478 - protein, 185 aa, Neisseria meningitidis
MKPKFKTVLTALLLAVSLPSMAATHVLMETDMGNIRLVLDESKAPKTVANFVRYARKGFYDDTVFHRVIDGFVIQGGGLTEDLAQKASDKAVANESGNGLKNTAGTIAMARTTAPDSATSQFFINLADNASLDYKNGQYGYTVFGRVESGMNTVSKIARVKTATRGFYQNVPVQPVKIRRVVVGQ

SEQ ID NO: 7479 - protein, 305 aa, Neisseria meningitidis
MKKTKVHLISGFLGTGKTTALKSLMAQKDPNEKWVIIVNEFGEIGIDGAVLSDNGIPVAEIAGGCLCCTAGPQMGVTVQKMLRDAKPDRLMIEASGLAHAASVIDELKTKPLDSLLEIGAVFTVVDPRQFINPDYAQQALYKDQIGICDVLVASKTDLCTPEQLAEFHDKAAKLFPPKAKVVEVQNAQLDIQWLDIPVIEKSRYRLKALPDNTMGFQSQGFTFPAGRDFDGEKLTNFFNDLPNMTEGLVRAKGVFQVLGTWVWLNWVDGQWGANQVSWRRDSRFELIAKSFDADLIEQKLKDALE

SEQ ID NO: 7480 - protein, 90 aa, Neisseria meningitidis
MKMQKELSVYLKQILQAAQYIRLYTDKMDYGQFSADTKTVQAVVFNLFLIGENATHILKSYPEFAEETKYLNWIGMRGYCAIGLPMATLK

SEQ ID NO: 7481 - protein, 97 aa, Neisseria meningitidis
MKPSLLLQSRKKEILAVFGKYPLICNPRVFGSVSRGDDTENSDIDLLVDAKTGTTLLDLGGLQEELQKLLGIKVDLLTPDDISAHFRDKVLTEAVAL

SEQ ID NO: 7482 - protein, 158 aa, Neisseria meningitidis
MKTNFKQKIIEQARSEGLQVTALREQVLDIVLQQSGVIKAYNVLSQMQQQSEGVLAPPTAYRALDFWAEQGVLHKVAAVNGYILCSHAQHECDDHCHDHEEAEAHHSAFILVCTECGTADEQTLSHEWAALRAGVAESGFALKEEHVVLTGICKKCQQ

SEQ ID NO: 7483 - protein, 151 aa, Neisseria meningitidis
MKKPKILFVCLGNICRSPMAEYILRRRAAEAGIPLEADSAGTSGWHDGEDMHRETAKILKKHGIDASGFTSRKIRQSDAAAFDCIIAMDGKNLSELERTFGRRPEKIFKLTDLIPESGYDHVPDPWYTGDFEETFRLADAGCRALLEKISK

SEQ ID NO: 7484 - protein, 371 aa, Neisseria meningitidis
MKIVIAPDSFKESLTAQQVAEAIKRGFQQSIADVECLLCPVGDGGEGTVDAIRHSLDLEEKCLQVTGPFGQKEVMRYFQKEQLALFEVADLVGLGKIPLEKRNPLQIQTRGIGELIRHLISQEIKEIYIGVGGTASNDGGIGIAAGLGYQFYDEDGNALPVCGQSLLNLASVSTENRYEIPEDVHIRILADVVSPLCGHQGATYTFGKQKGLDSTMFEAVDQAIQDFYEKVSPATLKLKGAGAGGGIAGGLCAFAQASIVSGIDTCLDLIDFDKKVSDVDLVIVGEGRLDRQSLAGKAPIGVAKRTPVGVPVVAICGSLVEDLPSLPFENIQAAFSILEKSEPLEDSLKNASLYLEHTASNIGHLLNMPKI

SEQ ID NO: 7485 - protein, 365 aa, Neisseria meningitidis
MNQTFTLPDTRPYPQNPIKNHLLLNAYQLAHNSSQASRKLSSGQLQTEIRGMLEQNHYINLSLALTMSPDAGTYAALLSSVNAVLDCEKEGEVQWFALPVVLVSGCKKERAIEMKLPTEALFACLQNYPHLRALTQETQWLPYLVHSSDLSAVAPDEWWRAKQNTEAAAQHLRRFAPRPLLLPEGQSVHVVYALGFGSGKVQTALGQNLLQAGLPLMQVWQENLASEGVTLFANPLSPDSPVRALSDGSHTRQRMAMDVFAANAIRAVRMQSPRVGVVAAAKAGGQILFGFNATDGAFEVVPQVFSWQLSFTDNIAVIQQNFLDLMAECRVEHVYLLHNPLGEQESIPSYAEALKREGHNPFFSA

SEQ ID NO: 7486 - protein, 543 aa, Neisseria meningitidis
MNWLNLRAIVPSDKQNMPNKKKKAAFARAATENGVPDVSNIKNSYDDLMYESGAFSQTAINNLEARARLMGLQPAPAANAKVLELGCSMGGNIITQALYYPDAEFVGIDLSGRQVAQGNAIIEKMGLKNVRLEEKDILTIDESFGKFDYIIVHGIWSWVPDAVKDKIFSICWNNLTKHGIAYISYNVYPGWKRQEQLREIMYFAGRDVLEEPLEARTRKGLDALKALAEILENDKGLDGGGKLPAIQKILNHNFYYIAHEYMEAFNDPIYVNGFIEWANRHRLAYIGDTNLHVSFVSWMAEHTRERILALAGDDYIAKEFYSDILSDRQFRRSLLCREEVGDTVRRDESVAVEVIESLNFRPARGETINFDENDILLSGIRDVMKTGEAFKTEDVAENLARRFPGLEFDRMKINSQLLLQTILGRFSVSSDNAGKPFFEDHKTYVPARFTNYAAAFVEHGAEAFVRPANRYNESTPSFGYGHLYIMRQLSRPTSKQALIETVAENLNIVSTTPDGLTFHPPAEVYVEEILADLADRHFLVSAD

SEQ ID NO: 7487 - protein, 70 aa, Neisseria meningitidis
METLILDIGGMSCGGCVKSVTRILEGVKGVASVEVSLENKSATVGYDPAQTDAGALIEAVEDGGYDAALK

SEQ ID NO: 7488 - protein, 47 aa, Neisseria meningitidis
MMLNQGFCEAFIVVVLMGIAAIMRKRPYFFKPPHRFRVCPSSRPDLQ

SEQ ID NO: 7489 - protein, 478 aa, Neisseria meningitidis
MPLLSVEFALFFLAFLPIYWGLAKYPSVQNLLLLAAGMGWLYHIGPVFAAIIVLYSSCVYLLGELLRSDRENTRRFWLGCGIAASLTVLGFFKYFDFFRPMIAQYAGKGGAIDILMPLGLSYYTFQSLAYLVYCFRAPHAARFSWHELLLHLSFFPTVTSGPIIRAAAFKSADGEQAGALAQIRTRRARSPVRPALAVSLILLGIAKKWWLAGMLAENWVSPVFENPAQFDGWGVLGGVYGYTFQLFLDFSGYSDLVIGMAMLLGFRLPKNFSAPLRALNIRAFWDKWHISLSTWIRDYIYIPLGGSKKGFLRTQLNLMAAMVLSGIWHGYGWNFLIWGALHGTALVLLNTGDRYFGRDALCRLKYFAPLSWLITFHFVCLSFVVFNTANPDDAGAVFSALFANANGWNAPQQANMLLLASFASVMLLYPYLQRAFDGAVKGLEKIPMWLWFIPVSAVLLLIIVLAPSGIPGFIYANF

SEQ ID NO: 7490 - protein, 327 aa, Neisseria meningitidis; identical to SEQ ID NO: 2226

SEQ ID NO: 7491 - skipped

SEQ ID NO: 7492 - protein, 517 aa, Neisseria meningitidis; identical to SEQ ID NO: 1664

SEQ ID NO: 7493 - protein, 675 aa, Neisseria meningitidis
MSLSEFIERRTSFNPMVILTTLFFVCVLVVLVLTVPDQVQMWLDRAKEVIFTEFSWFYVLTFSIFLGFLLILSVSSLGNIRLGRDEDVPEFGFLSWLAMLFAAGMGVGLMFFGVAEPLMHYFSDITAGTPEHRQQQALLHTVFHWGVHAWSVYGTIALALAYFGFRYKLPLALRSCFYPLLKEKISGRFGDAIDIMALLATFFGIITTLGFGASQLGAGLQEMGWIAENSFSVQVLIIAAVMSLAVVSAISGVGKGVKVLSELNLGLAFLLLFFVLAAGPTVYLLSAFGDNIGNYLGNLVRLSFKTYAYEREHKPWFESWTVLYWAWWCSWAPFVGLFIARISKGRTIREFVFGVLLIPGLFGVLWFTVFGNTAIWLNDGVAGGMLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVQIMSQTQEQDILKFLKQTASPAMHELQRELSEEYGLSVRVDKMFHRDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 7494 - protein, 668 aa, Neisseria meningitidis
MADMKKITPQNLRPLLSESLGHTDFVNVLNALIKFLRRGGKKCAGERFDLIIDTFKQDRELLSRFSRCFYIWLAQIHIYPALIKLGIFSRHSFAREMGIRIYERFSPSYKDFANLGEVFLYLFHSENDDKWLQTLNIRQWLVLYELIRSHAEPSKLQTAGIRLADARLRAIEMLSVWTASEAIEPDLIRIAPRLLEADSSFVALQRETAKLVEHYRNGTTPYDTAHLEVMFDQCFSQIDYLRRKGTGAGSGSSVKVAHLLERLRQTVDRLKLLTDIQTGAGNSNRLTIALMNSLIYAAVEQYSTRHLRRSSIRMLARSITENKSHHGEHYITRNRKEYFKMFYSAAGGGIIIALMALLKIRIGSLGLSPFLTSLSAGFNYGIGFMIIHMLHCTVATKQPAMTAASFAEQVDLNEGGKAVDNKLAKLLIDVCRSQSVAVFGNVSIAILLACAISFGYAHLYRLPILDAHTAAYQFKSIDIIAYPTLWYAAIAGLWLFCSGIIAGFFDNRADYLNLRQRLPFNPLLRKIMRPGPRRVLAAYIHKHYGSLVGNFIFGMLLGMTGYFGHLLGLPLDIRHVAFSSANLGYAAVSGNVGLGTFVLGIFSVLAIGLVNLCVSFSLALFVALRSRGTKIGSIRNLIKSFWNQIKSNPCILFLPPAKEQGHPPSDKP

SEQ ID NO: 7495 - protein, 369 aa, Neisseria meningitidis; identical to SEQ ID NO: 3798

SEQ ID NO: 7496 - protein, 475 aa, Neisseria meningitidis
MIHTEPSAQPSTMDTAAFLKHIESAFRRIFSDGIDLMRYLPEDKWLALKQAGLLLPFLDKKYGGRKGSQFEIQEVLRIAGHYGVPVTLRTGIEGALVLQPLQEFGDEAQVAQGLEMIFKGEGGGLGVTEPETSGAAIAREMQSYYEYIDGQTIYVNAAKYWQGNSQSDFLLVAAKERKNGKLAKVIDLLLVPKTYIRCETLASEGLRAVRYAVNRIDAEMPATAVMKLSQSDAAGLRAFQNIFIRSRLQLIGMTHGIMEYILENLERYVRNDIKFVDYERREIRRRHQVSEILYRYVCHSVSPVAPVAHQLMEANIVKTLATEYTYAAAQMLQKLLGAKGFERGHTAGNIAIDIRPFTIFEGPNDMLYAEIYDQFVRATAEEKEAGMKLDKNQTLLDRLQTDARFAAVARDYTLPEDIRSFLQEHTLTDACALQKVFIGKIIARLFVFVQAKHEDTAAFLLNDIRKDILDCRYCG

SEQ ID NO: 7497 - protein, 1379 aa, Neisseria meningitidis
MTYPIPKPREKSRWPNLSQGSLPLALARYLPHKRLKVVLTQDAEQALRLQTAWRFFRPHDTAVFLPDWETLPYERFSPHQDLVSERLSALWQIKSGAADVLFVPVATAMQKLPPVPFLAGRTFWLKTGQTLDIGRLKSDLVDAGYNHVSHVVAAGEFAVRGGIVDLFPMGSEMPYRIDLFDDEIDSIKTFDTETQRTISPVSEIRLLPAHEFPTDSEAQKIFRSRFREEVDGNPNDAAVYKAVSNGHFGAGVEYYLPLFFENELETLFDYIGEDALFVSLDDVHAEANRFWSDVKSRYAMAQGDETYPPLLPQYLYLSADVFAGRLKNYGQVLPDVSGKEYTLPDLAVNRQADEPLQALKDFQTAFDGRILLCAESLGRRETMLGFLQQNGLKAKPVSDWQGFLSAHEPLMITVAPLAYGFKLGGLQSPNQQQPTPSPVGEGWGEGKAVAAQTEFSAAAINPLPSPLPQEREQSAAAVSDSLKAAAVSTESSLPLGTSNLHGQIRQQPAPSPVGEGWGEGKAVAAQTEFPASATNPLPSPLPQEREQSAAAVSDDLKTKSSLHPVANNLHGQIRQQPTPSPVGEGWGEGKAVAAQTEFSAAATNPLPSPLPQEREQSAAVVSDSLKAAAVSTESSLPPGKSNLHGQIQQQPAPSPVGEGWGEGKAVAAQSAIAVITESDLYQYVARSRIHNRRKKHAAVSDGLLRDLAEINIGDPVVHEEHGIGRYMGLVTMDLGGETNEMMLLEYAGEAQLYVPVSQLHLISRYSGQAHENIALHKLGSGAWNKAKRKAAEKARDTAAELLNLYAQRAAQSGHKFEINELDYQAFADGFGYEETEDQAAAIAAVIKDLTQAKPMDRLVCGDVGFGKTEVALRAAFVAVMGGKQVAVLAPTTLLVEQHAQNFADRFADFPVKVASLSRFNNSKATKAALEGMADGTVDIVIGTHKLVQDDIKFKNLGLVIIDEEHRFGVRQKEQLKRLRANVDILTMTATPIPRTLSMALEGLRDFSLITTAPSRRLAVKTFVKPFSEGSVREAVLRELKRGGQVFFLHNEVDTIENMRERLETLLPEARIGVAHGQLRERELEQVMRDFLQQRFNVLLCSTIIETGIDIPNANTIIINRADKFGLAQLHQLRGRVGRSHHQAYAYLLTPEYITKDAEKRLDAIAAADELGAGFTLAMQDLEIRGAGEILGEGQSGEMIQVGFTLYTEMLKQAVRDLKKGRQPDLDAPLGITTEIKLHSPALLPEDYCPDIHERLVLYKRLAVCETVQQINTIHEELVDRFGLPEQPVKTLIESHHLRLMAKELGIDAIDAAGEAVTVTFGKNNNVDPTEIILLIQNDKKYRLAGADKLRFTAEMENIEVRINTVKNVLKTLQNRCLPK

SEQ ID NO: 7498 - protein, 127 aa, Neisseria meningitidis
MFRTMLGGKIHRATVTEADLNYVGSITVDQDLLDAAGIYPNEKVAIVNNNNGERFETYTIAGKRGSGVICLNGAAARLVQKGDIVIIMSYVQLSEPEIAAHEPKVVLVDGNNKIRDIISYEPPHTVL

SEQ ID NO: 7499 - protein, 280 aa, Neisseria meningitidis
MDIKINDITLGNNSPFVLFGGINVLESLDSTLQTCAHYVEVTRKLGIPYIFKASFDKANRSSIHSYRGVGLEEGLKIFEKVKAEFGIPVITDVHEPHQCQPVAEVCDVIQLPAFLARQTDLVVAMAKTGNVVNIKKPQFLSPSQMKNIVEKFHEAGNGKLILCERGSSFGYDNLVVDMLGFGVMKQTCGNLPVIFDVTHSLQTRDAGSAASGGRRAQALDLALAGMATRLAGLFLESHPDPKLAKCDGPSALPLHLLEDFLIRIKALDDLIKSQPILTIE

SEQ ID NO: 7500 - protein, 146 aa, Neisseria meningitidis
MMQTFRKISRYVATLWLGMQIMAGYIAAPVLFKMLPKMQAGEIAGVLFDILSWSGLAVWGAVLAAAFAALTRRQTALLLFLLSALAANRFLITPVIEALKYGHENWLLSFVGGSFGMWHGISSIVFMATALLSAVLSWRLSGKDAV

SEQ ID NO: 7501 - protein, 428 aa, Neisseria meningitidis; identical to SEQ ID NO: 3096

SEQ ID NO: 7502 - protein, 92 aa, Neisseria meningitidis
MKWVTVVLSFALVCCQYSLWFGKGSIGRNSSLREQIAVQEEKNQTLALRNHSLAAEVYDLENGQEAISEIARVELGYIQDGETFYRLIRHNR

SEQ ID NO: 7503 - protein, 96 aa, Neisseria meningitidis
MARIGTNKGFFELLEGETLLEGLERTGHMVEYQCRSGYCGSCRVKILEGSVTYREPPLAFLGRDEILPCCCCVEGDVRLDCGLSGEDEGLSDSLLK

SEQ ID NO: 7504 - protein, 384 aa, Neisseria meningitidis
MSCEHLTMSYSTFPKTKNDALNEPMFFGQPVNVARYDQQKYEVFEKLIEKQLSFFWRPEEIDVSRDRIDYANLPEHEKHIFISNLKYQTLLDSIQGRSPNVALLPLVSIPELETWIETWSFSETIHSRSYTHIIRNIVNDPSVVFDDIVENEYITARAEDIACYYDDLIEYTQYYNLLGEGVHNVGGKPVTVSLRGLKKKLYLCLMCVNVLEAIRFYVSFACSFAFAERELMEGNAKIIKLIARDEALHLTGTQHMLNLMRSGVDDSEMAEIAAELQDECFQLFKKAAEQEKEWAAYLFKDGSMIGLNKEILSQYVEYITNLRMQAVGLPAGFEGANQNPIPWINAWLSSDNVQVAPQEVEISSYLIGQIDSEVNTDDLGDFEL

SEQ ID NO: 7505 - protein, 395 aa, Neisseria meningitidis
MNDLAAQTIQVVNKSDDLVASAIQTANKSIAVYCRYIRPNDVGTTGSHQSGFYIQKHFSDDLFDVVCQKGTNKTISIKINWQDGSVTNSNFKYYGQGTRNEARITGFGKNFEFLSDKYSGSLLVLCRACYKDLLFHAFVLSSDEDIEIFIAETNILPGSLYLPKKQEVEDNLTKLFSLFPNFPKTEEMAVLARENIALNKTNVSNVLKQWVSKEYELFSIFEKREFEIIKSKITDLDSFINFAHSFTNRRKARAGKSLELHLSRIFDEFSLKFETQAKTEGKKKPDFLFPGSEEYHAMDESGNFIFQTEKLTMLGSKTTCKDRWRQVLNEADRIPHKHLFTLQEGISDTQIQEMSDENLTLVVPKESVKTFGTFGKTHVLTLENFIKYIKSQQVS

SEQ ID NO: 7506 - protein, 337 aa, Neisseria meningitidis
MKNKIQNQLDNIVTLNNEKFTFIDLFAGIGGFRIAMENVGGRCVFSSEWDDKARQTYQVNFNDIPYGDITLKETKAAIPSKFDVLTAGFPCQPFSIAGVSKKKSLGRETGFLDKAQGTLFFDVAEIIGKHRPKIFLLENVKNLVSHDKGNTFKVIKGTLEELDYQIFYQVMNAKYYVPQNRERIFIVGFDRQYFNKEINFNFPSPPESQPKLKQILEDDVDNSFTLSDNLWLYLQNYAKKHKAKGNGFGFGLVDLDGISRTLSARYYKDGSEILIPQKGKNPRKLTPRECSRLMGFPKDFVIDAVSKTAAYKQFGNSIAVPLVQAIAKQIINELKNE

SEQ ID NO: 7507 - protein, 759 aa, Neisseria meningitidis
MNTPTDLKVTKRDGRLEAIDLDKIHRVVTWAADGLENVSVSQVELKSHIQFYNGIRTDDIHETIIKAAADLISEDTPDYQYLAARLAIFHLRKIAYGEYEPPHLYDHVKKLTDAGKYDRHILEDYSREEFDELNAYIDHERDMSFSYAAVKQLEGKYLVQNRVTRQIYETPQFLYVLVAMCLFSKYPKEARLGYVKRFYDAVSTFKVSLPTPIMSGVRTPTRQFSSCVLIECDDSLDSINATTSAIVKYVSQRAGIGINAGRIRGLDSEIRGGEARHTGCIPFFKMFQAAVKSCSQGGVRGGAATLFYPLWHIEAESLLVLKNNRGVEDNRIRQLDYGVQINRLLYTRLIKGGNITLFSPNEVPGLYEAFFADQDEFERLYTKYEQDPDIRKRIIPAADLFSTLMQERAGTGRIYIQNVDHCNTHSPFDPRVAPVHQSNLCMEIALPTKPLDNINDPNGEIALCTLSAFNLGALNSLDELEGLADLTVRALDALLDYQGYPVEAARTSTMGRRSLGIGVINYAYYLAKNGVRYSDGSALGLTHRTFEAIQYYLLKASANLAKEYGACTLFNQTVYSQGKLPIDTYKKDLDAVCGEPLHYDWESLRAEIVKYGLRNSTLTALMPSETSSQIANATNGIEPPRGLVTVKASKDGILKQVVPEFETLKNAYETLWQLPGNEGYLKLVGVMQKFVDQSISANTAYDPGKFEGGKVSMKQMLKDLLTAYKYGVKTLYYHNTRDGADDTQTDIQDDGCAGGACKI

SEQ ID NO: 7508 - protein, 62 aa, Neisseria meningitidis
MSAAARQNHTLQNLTICRGRKQEAFLFRRKILISPPCSRSRSKGKKFTRFLSVKNYQIKQIL

SEQ ID NO: 7509 - protein, 108 aa, Neisseria meningitidis
MSVKKMLAILLSAILGLVSTTAAAGTSEPAHRDTKHIRKANKQMLHPECRKYLERRAAWYRSQGNVQELRENKKARKAFRSLPYAEQKIQCRAAYEAFDDFDGGSFRR

SEQ ID NO: 7510 - protein, 255 aa, Neisseria meningitidis
MSSNKASFFTRLRRLCRLAVWLFKTGKNLRGIDGGCPESRNRAVIELGRGVLAALDIGLEVGRPAPEHPNGVLVAANHVSWLDIFAMSAVYPSSFIAKQEIKSWPVLGKMGQNAGTVFINRNSRRDIEPINRAVCETLQRGQNVSFFPEARTSSGLGLLPFKAALFQSAIDAGAKVLAVALRYYDETGKRTARPSYADVGLPTCLWRIVSMKKLTIRVDFVCVADAAESEDRYALKDKIEESIRAVVADDADIAV

SEQ ID NO: 7511 - protein, 275 aa, Neisseria meningitidis
MPELPEVETTLRGIAPHIEGKTVEAVVLRQLKLRWQINPDLGEILSGRQVLSCGRRAKYLLIRFQTGVLLIHLGMSGSLRIFTPSDGRIGRPDRHDHVDIVFSDGTVMRYRDPRKFGAILWYEGIEEHHPLLEKLGPEPLSEAFCADYLYARLKAQKRAVKLALMDNAVVVGVGNIYANESLFRAGISPHRPANRLKKKECALLVETVKAVLQRAIETGGSTLRDFVDSDGKSGYFQQEYTVYGRHNQPCPRCGGLVVKETLGQRGTFYCPNCQK

SEQ ID NO: 7512 - protein, 221 aa, Neisseria meningitidis
MDAWFEDTAMGRYVAKLEQDFFGRYLDSYRFSGMCAVQVGGPWLSLSEDVVCVPRDMSMSAENMALADVSADMLLFPHTLEGGVPSQILSEAHRILKPCGRLMLTGFNPYSLWGFSRWFDGERLPEKRFCLPLPELKRRLADVGFDIEFGKFMVYLPPVSSLGQIRFWRFMEKAGDRWWPQCAAVYGLVLVKRAAGVTPLPAWDGYLGGKALAAGAARVAD

SEQ ID NO: 7513 - protein, 658 aa, Neisseria meningitidis
MSKLKTIALTASGLSVCPGFLYAQNTSSHQIGLAIMRLNSSILDLPPTKQYFQSGSLWGELRQGFRMGEVNPELVRRHESKFIASHSYFNRVINRSRPYMYHIANEVKKRNMPAEAALLPFIESAFVTKAKSHVGASGLWQFMPATGRHYGLEKTPVYDGRHDVYAATDAALNYLQYLYGLFGDWPLAFAAYNWGEGNVGRAINRARAQGLEPTYENLRMPNETRNYVPKLLAVRNIIATPQSFGMNISDIDNKPYFQAVEPDRPLDNEAIARLAGITQSELLALNPAFNVPAFIPKSKRKLLLPVASVQTFQSNYLNAAPDSLFSWEVYTPAAKTSLSDISTATGMSIADIKRLNNLNGNLVNAGRSILVAKNGKTLQTASESVVSIDIDNTPDTYRSNMPAGTVNVGIARIRPAAAQTADITVAPLPQKTVRTEPDPLVRIAEPALATAAAQPQTEKQTAMPSETQTATLAQIIPQNDMQAADELMQLVARNNLRRQAEETISAVIGTPDTVAEHKISASPQHTAAADGKRRVRLETRVAKAADGEAEISPLHASIHRVVEGDTLFNIAKRYNVSVADLIVANNIKGNTIQKGQVLRLAQAAPAQTRIEKVSYTARKGDTFKSIAARFNIHIDDIRRLNPNLNTINPGQRVKLIGS

SEQ ID NO: 7514 - protein, 230 aa, Neisseria meningitidis
MKLIKYLQYQGIGSRKQCQWLIAGGYVFINGTCMDDTDADIDSSSVETLDIDGEAVTVVPEPYFYIMLNKPEDYETSHKPKHYRSVFSLFPDNMRNIDMQAVGRLDADTTGVLLITNDGKLNHSLTSPSRKIPKLYEVTLKHPTGETLCETLKNGVLLHDENETVCAADAVLKNPTTLLLTITEGKYHQVKRMIAAAGNRVQHLHRRRFAHLETENLKPGEWKFIECPKF

SEQ ID NO: 7515 - skipped

SEQ ID NO: 7516 - protein, 218 aa, Neisseria meningitidis
MNRQKVIAIDGPGASGKGTVAARVAAALGYDYLDTGALYRLTALYAQKQGVGWHDEENVSELAKKLPAVFSGSRILLGGEDVSDGIRTEAIGMGASAVAQLPKVRAALLQRQRDFLTEKGLVADGRDTGSVVFPQAELKIFLTAESKIRAERRAKQIGIPCEGLAFERILSDIEARDEADRNRKVAPLKQQPDALLLDTSRLTIEETVKKVLDWYREV

SEQ ID NO: 7517 - protein, 561 aa, Neisseria meningitidis
MSMENFAQLLEESFTLQEMNPGEVITAEVVAIDQNFVTVNAGLKSESLIDVAEFKNAQGEIEVKVGDFVTVTIESVENGFGETKLSREKAKRAADWIALEEAMENGDILSGIINGKVKGGLTVMISSIRAFLPGSLVDVRPVKDTSHFEGKEIEFKVIKLDKKRNNVVVSRRAVLEATLGEERKALLENLQEGSVIKGIVKNITDYGAFVDLGGIDGLLHITDLAWRRVKHPSEVLEVGQEVEAKVLKFDQEKQRVSLGMKQLGEDPWSGLTRRYPQGTRLFGKVSNLTDYGAFVEIEQGIEGLVHVSEMDWTNKNVHPSKVVQLGDEVEVMILEIDEGRRRISLGMKQCQANPWEEFAANHNKGDKISGAVKSITDFGVFVGLPGGIDGLVHLSDLSWTESGEEAVRKYKKGEEVEAVVLAIDVEKERISLGIKQLEGDPFGNFISVNDKGSLVKGSVKSVDAKGAVIALSDEVEGYLPASEFAADRVEDLTTKLKEGDEVEAVIVTVDRKNRSIKLSVKAKDAKESREALNSVNAAANANAGTTSLGDLLKAKLSGEQE

SEQ ID NO: 7518 - protein, 104 aa, Neisseria meningitidis
MTKSELMVRLAEVFAAKNGTHLLAKDVEYSVKVLVDTMTRSLARGQRIEIRGFGSFDLNHRPARIGRNPKTGERVEVPEKHVPHFKPGKELRERVDLALKENAN

SEQ ID NO: 7519 - protein, 135 aa, Neisseria meningitidis
MTYTTAKAAEKIGISAHTLRFYDKEGLLPNIGRDEYGNRCFTDNDLQWLGLLQCLKNTGMSLKDIKRFAECTVIGDDTIEERLSLFENQIENVKCQIAELKRYLDLLEYKLAFYQKAKALGSVKAVNLPQIPETA

SEQ ID NO: 7520 - protein, 378 aa, Neisseria meningitidis
MEMKQADSTIKSRAAVAFAPNQPLQIVEIDVEMPRKGEVLIRNTHTGVCHTDAFTLSGSDPEGVFPVVLGHEGAGVVVAVGEGVSSVKPGDHVIPLYTAECGECEFCCSGKTNLCVSVRDTQGKGLMPDGTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPSKFELAKQFGATDCLNPNDYDKPIKDVLLDINKWGIDHTFECIGNVNVMRQALESAHRGWGQSIIIGVAGAGQEISTRPFQLVTGRVWKGSAFGGVKGRSELPKMVEDSMKGDIELEPFVTHTMTLDQINKAFDLMHEGKSIRAVIHY

SEQ ID NO: 7521 - protein, 275 aa, Neisseria meningitidis
MKLIEQHQIFGGSQQVWAHHAQTLQCEMKFAVYLPNNPENRPLGVIYWLSGLTCTEQNFITKSGFQRYAAEHQVIVVAPDTSPRGEQVPNDDAYDLGQSAGFYLNATEQPWAANYQMYDYILNELPRLIEKHFPTNGKRSIMGHSMGGHGALVLALRNQERYQSVSAFSPILSPSLVPWGEKAFTAYLGKDREKWQQYDANSLIQQGYKVQGMRIDQGLEDEFLPTQLRTEDFIETCRAANQPVDVRFHKGYDHSYYFIASFIGEHIAYHAAFLK

SEQ ID NO: 7522 - protein, 383 aa, Neisseria meningitidis
MSNRDQLFKAPPFENHSPLTWYQAASQLPNFIRDDAQAAAIEHLDRLWTELMMFKRKRNRFLGRSLRSPQVPKGLYFYGGVGRGKSFLMDAFFGCLPYRRKRRVHFHAFMAEIHQRLKTLKSESNPLKSVAAEIAKETRVLCFDEFHVSDIADAMILGRLLENLLNEGVVLVATSNYAPSELYPQGQNRSSFLPTIALIESSLTVLNVDGGEDYRLRTLRPAEIFFTPANEENEAKLAKLFKEMTGITDLNPGISTIHGREIPHKAESGRAIWFDFRALCFGPRSQSDYLYLAEHYEMVFISGLEQLSPQEKAEARRLTWLIDVLYDFRVKLCATGAVDVNHIYTEGDFAEEFTRTASRMVEMQSEVYLEQPHLTLSPKASGG

SEQ ID NO: 7523 - protein, 141 aa, Neisseria meningitidis
MAIERTISIIKPDAVGKNVIGKIYSRFEENGLKIVAAKMKQLTLKEAQEFYAVHKDRPFYAGLVEFMTGGPVMIQVLEGENAVLKNRELMGATNPSEAAEGTIRADFATSVSINAVHGSDSVENAALEIAYFFSQTEICPR

SEQ ID NO: 7524 - protein, 364 aa, Neisseria meningitidis
MKTNLLNYDLQGLTRHFADMGEKPFRAKQVMRWMHQSGAQNFDEMTDLAKSLRHKLNEQAGIEIPKLMMSQKSSDGTRKWLLDVGTGNGVETVFIPESDRGTLCISSQVGCALECTFCSTGRQGFNRNLTAAEIIGQLWWANKAMGVTPKNERVISNVVMMGMGEPMANFDNVVTALSIMLDDHGYGLSRRRVTVSTSGMVPQMDRLRDVMPVALAVSLHASNDEVRNQIVPLNKKYPLKELMAACQRYLVKAPRDFITFEYVMLDGINDKAQHARELIELVTDVPCKFNLIPFNPFPNSGYERSSNENIRVFRDILQQAGFVVTVRKTRGDDIDAACGQLAGQVQDKTRRQQKWQQILIGQQG

SEQ ID NO: 7525 - protein, 253 aa, Neisseria meningitidis; identical to SEQ ID NO: 3358

SEQ ID NO: 7526 - protein, 421 aa, Neisseria meningitidis
MNTLQRRKTHQVRIDHITVGSEAPVVIQSMTNTDTADAKATALQIKELSDAGSEMVRITVNSPEAASKVAEIRRRLDDMGYATPLIGDFHFNGERLLAEFPECGKALSKYRINPGNVGKGVKGDEKFAFMIRTAAENDKAVRIGVNWGSLDQSLAKRMMDANLASSAPKPPEEVTKEALIVSALESAEKAVLLGLPEDKIILSCKVSAVQDLIQVYRELGSRCAYPLHLGLTEAGMGSKGIVASTAALSVLLQEGIGDTIRISLTPEPGSPRTQEVVVGQEILQTMGLRSFTPMVTACPGCGRTTSTVFQELAQDVQNYLRQKMSIWRTLYPGVESLNVAVMGCVVNGPGESKLADIGISLPGTGETPVAPVYVDGERKVTLKGDNIATEFLAIVEEYVKTNYGENGLKRHQGKVIPIHSL

SEQ ID NO: 7527 - protein, 78 aa, Neisseria meningitidis
MPSESQMGQQFLQGRDTRILLNLPVRLLRKDKGRKRYPAFLIYTCNSSPYLPIVFSYCASIPYRFKKMPFPMGWVLYQ

SEQ ID NO: 7528 - protein, 176 aa, Neisseria meningitidis
MKERIVFLVGPVTDESANLVVAQLLFLESENPDKDIFFYINSPGGSVTAGMSIYDTMNFIKPDVSTLCLGQAASMGAFLLSAGEKGKRFALPNSRIMIHQPLISGGLGGQASDIEIHARELLKIKEKLNRLMAKHCDRDLADLERDTDRDNFMSAEEAKEYGLIDQILENRASLRL

SEQ ID NO: 7529 - protein, 437 aa, Neisseria meningitidis
MMSVTVETLENLERKVVLSLPWSEINAETDKKLKQTQRRAKIDGFRPGKAPLKMIAQMYGASAQNDVINELVQRRFYDVAVAQELKVAGFPRFEGVEEQDDKESFKVAAIFEVFPEVVIGDLSAQEVEKVTASVGDAEVDQTVEILRKQRTRFNHVEREARNGDRVIIDFEGKIDGEPFAGGASKNYAFVLGASQMLPEFEAGVVGMKAGESKDVTVNFPEDYHGKDVAGKTAVFTITLNNVSEATLPEVDADFAKALGIADGDVAKMREEVQKNVSREVERRVNEQTKESVMNALLKAVELKAPVALVNEEAARLANEMKQNFVNQGMADAANLDLPLDMFKEQAERRVSLGLILAKLVDENKLEPTEEQIKAVVANFAESYEDPQEVIDWYYADPSRLQAPTSLAVESNVVDFVLGKAKVNEKALSFDEVMGAQA

SEQ ID NO: 7530 - protein, 812 aa, Neisseria meningitidis
MTEKSHKKTAKGRAGSPSPTSARNKKADNGARGNKVSERLKAVKELQKTETKKARPEHVVNLIGDALWLMGLAATLYLAISLISFDMGDPSWSHSSPVVEDVANWGGLFGAYVADVGYYLFGWSFWWWIAAACVVLYKNFRLHAKQTENEAYNHKIAAAALFVLTVFSPVLEYFVLGGKYADSLPVGAGGMVGIRVGAVFAWLLGKSGSLLIILVVLLLSLSLLVQISWLEFLNGAGRAVQNRLSALSGKVMALGKRRPNTKTDGVDTQNTRRMVKEAKNITAKPVALPEGSSSNRKSVAVSVAPPPKIQVSLFEDDEPRQAGEYHKPTLNLLRIPDSEPVSINPAELERTAELIESKLAEFGIGVQVVSATSGPVITRYEIEPAQGVKGSQIVALSKDLARSMSLQSVRIVETIAGKNTMGIELPNDKRQDVMLSEILSSPVFAEAKSKLTVALGKDIAGTPVVGDLAKMPHLLVAGMTGSGKSVGVNGMIMSMLFKATPDEVRFIMIDPKMLELSIYDGIPHLLCPVVTDMREAGQALNWCVAEMEKRYRLLSHAGVRNLEGFNQKVEAAKAAGKPLLNPFSLNPDEPEPLEKLPLIVVVIDELADLMMTERKAVEQQIARLAQKARAAGIHMIVATQRPSVDVVTGLIKANIPTRMAFTVQSKIDSRTILDQMGADELLKYGDSLFLQPGSAEPTRLQGAFVSDDEVHQVVNYVKSQAPADYIEGLLSGEAALETANIVNPNADSDELFDQAVAYVLESKKTSISSLQRQLRIGYNRAANLMEALENAGVVSSTDLNGSRKILAHKDHL

SEQ ID NO: 7531 - protein, 403 aa, Neisseria meningitidis
MNQLKLAVSGAQILFVAFGAMVLVPLLTGLNPALALLGAGLGTLLFQITTKRKVPIFLGSSFAFIAPIIYSVGEWGLPSTMFGLFAAGFMYFVFAALIRWRGLAAVHKLLPPVVIGPVIMVIGLSVAVAASSMAMGQADGKQVIDYTDSLILSGFTFAVTAIVSVFGSRMMKLIPILIGVASGYVLALLMGLVDTASIAHAPWFAVPHFETPQINWQAALFMLPVAVAPAIEHIGGIMAIGNVTGKDYTKDPGLDKTLAGDGLGVCVAGLIGGPPVTTYGEVTGAVMITKNSNPVIMTWAAVFAVCMAFFGKFNAFLASIPMPVMGGIMLLLFGTIASLGVKTLIDAKVDLMLPKNLVIVSSVLTTGIGGMTLKLGSFSFAGVGLCAVLAIMLNSLLPDPKES

SEQ ID NO: 7532 - protein, 146 aa, Neisseria meningitidis
MNQRAHSSAVIRRRCAIHCFQAALSLYAVFFDALVECDLMNARKTRRSNHDGVVDTQRAQGFRVCQRDTGIVQRHDRPASGRLVFSNARKRVLTFAEGFQLGKRFAFRRIFFCGFNLQNIVRILRILPNGEIAVSIGSPCRRSHQA

SEQ ID NO: 7533 - protein, 134 aa, Neisseria meningitidis
MANRFQQRKSAYRRLSGKPLFSDGIAANLCGGRKTLSYNLSRFKISIRSEMQKISFNLLKPANSPKIGKRRPGLNGAPHIPMPSPRYLPASPEMPGNNIHPAKIRNNTPGGRQSQTAPQSIRHQKNKPPPRASS

SEQ ID NO: 7534 - protein, 248 aa, Neisseria meningitidis
METPTNTPQRSLRQNSIYLLPNSFTIAALFSAFYAITQSMHGRYETAAIAVFISMLLDGMDGRVARLTNSQSAFGEQLDSLADMVSFGVAPALIAYKWQLWQFGKIGYSVAFIYCACAALRLALFNTLIGKVDKRWFIGVPSPTAAALIVGLIWVNHSVEKFPAVHWWALGITLFAGLSMIVQIPFWSFKEINIRRQVPFVGMLLAVLLLLLVTWEPSLVLFLFFLGYSLSGYIMAARRFWKKYRKAD

SEQ ID NO: 7535 - protein, 257 aa, Neisseria meningitidis
MWHWDIILILLAVGSAAGFIAGLFGVGGGTLIVPVVLWVLDLQGLAQHPYAQHLAVGTSFAVMVFTAFSSMLGQHKKQAVDWKTVFTMMPGMIFGVFTGALSAKYIPAFGLQIFFILFLTAVAFKTLHTDPQTASRPLPGLPGLTAVSTLFGTMSSWVGIGGGSLSVPFLIHCGFPAHKAIGTSSGLAWPIALSGAISYLLNGLNIAGLPEGSLGFLYLPAVAVLSAATIAFAPLGVKTAHKLSSAKLKKSSALCCF

SEQ ID NO: 7536 - protein, 150 aa, Neisseria meningitidis
MQIILLEKIGGLGNLGDIVTVKNGYARNFLIPAGKAKRATEANMKEFEARRAELEAKQAEILADARVRQEKLDGQTVTVAQKAGVDGRLFGSVTNADIAAAIVAAGIEAVKANVRLPNGPLKAVGEYEVEVALHTDAVAKITVAVVAATE

SEQ ID NO: 7537 - protein, 76 aa, Neisseria meningitidis
MARQSFKRRKFCRFTAEKIQEVDYKQVDLLKDFISENGKIIPARITGTKAFYQRQLAVAVKRARFLALLPYTDQHK

SEQ ID NO: 7538 - protein, 100 aa, Neisseria meningitidis
MGFNNLVSLAALIEKVFPIRYTPAGIPVLDIILKHESWQEENGQQCLVQLEIPARILGRQAEEWQYRQGVYVHVEGFLAQKSRRSLMPMLRIQNIQEYKG

SEQ ID NO: 7539 - protein, 122 aa, Neisseria meningitidis
MRHYEIVFIVHPDQSEQVPAMVERYKTMIAEANGKIHRLEDWGRRQLAYPINKIHKAHYVLMNIETTPEVVEELETAFRFNDAILRHLTIKTKHAVTEASPMLGGEKAKNLLSGASEEAVAQ

SEQ ID NO: 7540 - protein, 316 aa, Neisseria meningitidis
MSQHRKLIILGSGPAGYTAAVYAARANLNPVIITGIAQGGQLMTTTEVDNWPADADGVQGPELMARFLAHAERFGTEIIFDQINAVDLQKRPFTLKGDMGEYTCDALIVATGASAKYLGLPSEEAFAGKGVSACATCDGFFYKNQDVAVVGGGNTAVEEALYLANIAKTVTLIHRRSEFRAEKIMIDKLMKRVEEGKIILKLESNLQEVLGDDRGVNGALLKNNDGSEQQIAVSGIFIAIGHKPNTDIFKGQLEMDEAGYLKTKGGTADNVGATNIEGVWAAGDVKDHTYRQAITSAASGCQAALDAERWLGSQNI

SEQ ID NO: 7541 - protein, 720 aa, Neisseria meningitidis; identical to SEQ ID NO: 2812

SEQ ID NO: 7542 - protein, 617 aa, Neisseria meningitidis
MNKETRFPEHFDIPLFLKNLPNLPGVYRFFNESGNVLYVGKAVNLKRRVSGYFQKNDHSPRIALMVKQVHHIETTITRSESEALILENNFIKALSPKYNILFRDDKSYPYLMLSGHQYPQMAYYRGTLKKPNQYFGPYPNSNAVRDSIQVLQKVFMLRTCEDSVFEHRDRPCLLYQIKRCTAPCVGHISEEDYRDSVREAATFLNGKTDELTRTLQHKMQTAAANLQFEEAARYRDQIQALGIMQSNQFIDSKNPNNPNDIDLLALAVSDGLVCVHWVSIRGGRHVGDKSFFPDTKNDPEPNGQDYAEAFVAQHYLGKSKPDIIISNFPVPDALKEALEGEHGKQMQFVTKTIGERKVRLKMAEQNAQMAIAQRRLQQSSQQHRIDELAKILGMDSDGLNRLECFDISHTQGEATIASCVVYDEQNIQPSQYRRYNITTAKPGDDYAAMREVLTRRYGKMQEAEANGETVKWPDAVLIDGGKGQIGVAVSVWEELGLHIPLVGIAKGPERKAGMEELILPFTGEVFRLPPNSPALHLLQTVRDESHRFAITGHRKKRDKARVTSSLSDIPGVGSKRRQALLTRFGGLRGVIAASREDLEKVEGISKALAETIYNHLH

SEQ ID NO: 7543 - protein, 467 aa, Neisseria meningitidis
MNNPDLPYRQALECLSQKQYNFTEVRRLLTEAFSAGHPAAAFELAKHLMDADSPYQDREQGMEMLRIAAEQGHPYARYNLAYIQELEGAPPETLIPLYRPLAEEGLPEAQVRLMYLLYASRHFEEALEWAKTSAKNNNPHGQYLLAQYCRYGTPPDFETAHLLYRKSAAQGLPEAHWQLGLQYRFGQGTKVDTAQAVNHLRAAAQQGYIPAYTPLAELILPTAPDEAVHWFQQAAQENDPDAHAALADIYLQGKHLERNHKLALHHAEAAAAERHPEGLRILGDICRYGLGIAPDTEKARHYYRQAAEAGSLSAYQKLISDSALNHPDQYGGIKDSAIRRQRAERLYQKAQALHYGLQCAPEYAAALKLYTEAAELGHSKAQTNLGSMYYFGQGMTADYNEARKWFEKAAAKKDSMAFYNLACIHYSGHGVEPDKEKACRYLQEAINNGYGQKSVLQELLQQWQNAV

SEQ ID NO: 7544 - protein, 238 aa, Neisseria meningitidis
MTDTAENQTQNNWQAGHPRSIRSFVLRQSHMTAAQQRAIDTLWDSFGIDYQATPADLDARFGSSRPKILEIGFGMGTATAEIARRLPETDFLAIDVHGPGVGNLLKLIDENHLENIRVMRHDAVEVVENMLQDGSLDGIHIFFPDPWHKKRHHKRRLIQAPFIAKLLPKLKTGGYIHLATDWEEYAQQMLEVLSSFDSLQNTAADYAPTPDYRPETKFEARGKRLGHGVWDLVFKRIG

SEQ ID NO: 7545 - protein, 64 aa, Neisseria meningitidis
MDCNDGNVEGFVGYKYPTYACCYISFDLMTKYDKVKVQITASMICFFRLLSFHDIDISSFSFSL

SEQ ID NO: 7546 - protein, 120 aa, Neisseria meningitidis
MSQLDFNLELFIKNSNFDDYKIFDIVKEAIETQDEIGSILRTHLFFERILEAWIYAKCNKEDFFNDTQIGFRTKLKIARNLGLFSEVYDIGERLNKIRNTIAHHVLREVNQENLTLYMKV

SEQ ID NO: 7547 - protein, 675 aa, Neisseria meningitidis
MEVIQYPNSPFKLHQPFPPAGDQPTAIAGLLEGLSDGLAYQTLLGVTGSGKTYTMANVIAQSGRPAIIMAHNKTLAAQLYAEMREFFPENAVEYFVSYYDYYQPEAYVPSRDLFIEKDSAINEHIEQMRLSATKNLMTRNDVIIVATVSAIYGIGDPTEYQQMVLSVKEGDTIEQRDIIATLVSMQYERGDLDFKRGSFRVRGDVIDVYPAESSENALRISLFDDEIDRLDMFDPLSGSLIQRVGRYTVFPSSHYVTPRDTVLRACESIKEELRERIEFFAREQRPVEQQRIEQRTRFDLEMLYEMGFCKGIENYSRHFSGKKEGEPPPTLMDYLPDNAIMFIDESHVTVTQIGGMYKGDASRKQNLVDYGFRLPSARDNRPLKFHEFEKVMPQTIFVSATPAKYEEEHAGQVVEQVVRPTGLVDPQIIIRPVATQVDDLMSEINDRIEKGERVLVTTLTKRMAEQLTDYYSELGIKVRYLHSDIDTVERVEIIRDLRLGLFDVLVGINLLREGLDIPEVSLVAILDADKEGFLRSHRSLIQTIGRAARNVNGVAILYADKITDSMKAAIDETERRREKQIKFNEEQGIVPQQIKKQVKDIIDGVYHEEDGSKGRLKGKNKVKVGEIHNEEDAIKEIAKLEKAMQQAARDLQFEEAAVLRDRIRDIKENLLFGAE

SEQ ID NO: 7548 - protein, 494 aa, Neisseria meningitidis; identical to SEQ ID NO: 3466

SEQ ID NO: 7549 - protein, 596 aa, Neisseria meningitidis
MRYKPLLLALMLVFSTPAVAAHDAAHNRSAEVKKQTKNKKEQPEAAEGKKEKGKNGAVKDKKTGGKEAAKEGKESKKTAKNRKEAEKEATSRQSARKGREGDKKSKAEHKKAHGKPVSGSKEKNAKTQPENKQGKKEAKGQGNPRKGGKAEKDTVSANKKVRSDKNGKAVKQDKKYREEKNAKTDSDELKAAVAAATNDVENKKALLKQSEGMLLHVSNSLKQLQEERIRQERIRQARGNLASVNRKQREAWDKFQKLNTELNRLKTEVAATKAQISRFVSGNYKNSQPNAVALFLKNAEPGQKNRFLRYTRYVNASNREVVKDLEKQQKALAVQEQKINNELARLKKIQANVQSLLKKQGVTDAAEQTESRRQNAKIAKDARKLLEQKGNEQQLNKLLSNLEKKKAEHRIQDAEAKRKLAEARLAAAEKARKEAAQQKAEARRAEMSNLTAEDRNIQAPSVMGIGSADGFSRMQGRLKKPVDGVPTGLFGQNRSGGDIWKGVFYSTAPATVESIAPGTVSYADELDGYGKVVVVDHGENYISIYAGLSEISVGKGYMVAAGSKIGSSGSLPDGEEGLYLQIRYQGQVLNPSSWIR

SEQ ID NO: 7550 - protein, 78 aa, Neisseria meningitidis
MPFAQSCAFFARILAIGSNSLILCVIFSMPQRILCSDTQGSTLSRIPYVARFWERAPLQTKQALPLSRKTGIQPIRKF

SEQ ID NO: 7551 - protein, 186 aa, Neisseria meningitidis; identical to SEQ ID NO: 3630

SEQ ID NO: 7552 - protein, 182 aa, Neisseria meningitidis
MNLSNHFLIAMPDMEDAFFSQSVVYICKHDEDGALGIAINKPSPITMDMIFSATGKNIPMRMQHDSVMMGGPVQVERGYVVHTPIGNWQSSIGVSDNIALTSSRDVIENISREGAVDKALISIGYSSWSKGQLERELADNAWLTVPADEHILFDIPYEHRYAAAFAKLGIDPLALFSGAGHA

SEQ ID NO: 7553 - protein, 151 aa, Neisseria meningitidis
MHKIPKGTALAFDFGEARIGVAQGDAELGLSHPLSTVTGGSNDEKFAAIAKLVQEWQPRYFVVGLPVHTDGTKHEMTHLSRKFGRRLNGRFNLPVYWVDERLSSVYAESLLSEAQVFGKKRKSVLDQVAAQAILHGFFEGGPAECFNGREG

SEQ ID NO: 7554 - protein, 218 aa, Neisseria meningitidis
MASVFLEGEAVEVGNIFCIGRNYAAHIEELKNEIPSEPVVFMKPSGSILNSGGTILLPEFSRDVQFECELVLLVGKDSDGTGEGKDILGCVAGYGVGLDLTARDIQCRLKEKGLPWLKAKGFRHSACVSDFAAAGRIGNPEKVLFSLKQNGVLKQRGDTGLMIYPIREILHKLAADYGLGKGDLVFTGTPSGVGAIGAGDNLALELDGLVRASFTVGC

SEQ ID NO: 7555 - protein, 570 aa, Neisseria meningitidis
MKASQFFISTLKEAPAEAALASHKLMIRAGLIKANASGLYTWMPMGLRVLRKVENVVREEMARAGSVELLMPVVQPAELWQESGRWEFYGKELLRLKDRHDRDFCMGPTCEEVIADIVRKEINSYKQLPKNFYHIQTKFRDEVRPRFGVMRAREFVMKDAYSFHADYASLQTTYQDMYDAYCRIFTRLGLAFRPVAADTGSIGGTGSHEFQVLAESGEDVIAYSDTSDYAANIELAPTLPLKGERAAAQAELVKVHTPNVKTIDSLVDFLSIPIEKTLKSIVVEGENEGELILLLLRGDHEFNDIKAEKLAGVKSPLTMASPAAIVEQFGANGGSLGPVGFAGKVYADFATEKGADWVIGANEDDYHYTGFNFGRDAAEPEFVDLRNVVEGDESPDGQGRLKLARGIEVGHVFQLRDKYTQAMNVSFLDNNGKSQIMEMGCYGIGITRVVAAAIEQNNDEKGIIWTKAMAPFEVVIVPMNYKKSDTVREAADKIYAELLAAGADVLLDDRDERAGVLLNDSELLGIPHRIVIGDRALKEGNVEYAERRDNEAQAVAIGEIVARVTASLNA

SEQ ID NO: 7556 - protein, 76 aa, Neisseria meningitidis
MVICQQTRLLIGFRVEQIEHFFQVFPCFQNFYNFLKTLNLNYFFRFDLEIFVFAYYFSQTKIKGLATPSLPIKHST

SEQ ID NO: 7557 - protein, 887 aa, Neisseria meningitidis
MSTQLHDVDPIETQEWLDALSSVLEYEGGERAQYLLENLVKYCRDKGVRMPHGTTTPYLNTVSVENEKGIPGDQNIEHRIRAFVRWNAAAIVLRAGKKDLELGGHIASFQSAATMYEVGFNHFWKAKGEGEEGDLVFFQGHVAPGIYARAFVEGRLTEDQLNNFRQEVDGHGLPSYPHPHLLPDFWQFPTVSMGLGPIMAIYQARFLKYLESRGLAKTKGRKVWCFCGDGEMDEPESQGAIALAAREGLDNLIFVINCNLQRLDGPVRGNGKIIQELEGNFAGAGWNVVKVIWGRRWDRLLAKDKDGILRQRMEECLDGDYQTYKSKDGAYVREHFFNTPELKALVADMTDEQLWALNRGGHDPQKVYNAYDRAANHADGKPTVILAKTIKGYGMGASGEGQNVAHQAKKMDKASLKQFRDRFDIPVTDEQIESGDLPYLTFAPDTEEYKYLHARRDALGGYLPQRKPTQEVLEVPELSAFDAQLKSSGEREFSTTMAFVRILSTLLKDKKIGKRVVPIVPDESRTFGMEGMFRQYGIWNPKGQQYTPQDKDQLMFYKESVDGQILQEGINEPGAMADWIAAATSYANSNFAMIPFYIYYSMFGFQRIGDLAWAAGDMHARGFLLGGTAGRTTLNGEGLQHEDGHSHIQADLIPNCVSYDPTFQYEVAVIVQDGLRRMYANNEDVFYYITLMNENYTHPDMPEGAEQDILKGMYLLKAGGKGDKKVQLMGSGTILQEVIAGAELLKADFGVEADIWSCPSFNLLHRDAVEVERFNRLHPLEAEKVPFVTSQLQGHDGPVIAATDYIRSYADRIRAYIPNDYHVLGTDGFGRSDSRANLRRFFEVDRYNVAVAALAALAEQGKVSKETVQQAIEKYGIKADSAPSWKR

SEQ ID NO: 7558 - protein, 535 aa, Neisseria meningitidis
MSIVEIKVPDIGGHENVDIIAVEVKAGDTIAVDDTLITLETDKATMDVPADAAGVVKEVKVKVGDKISEGGVILTVETGAAAAEAAPAAAEAQPAPAAAPAAAGGATVQVAVPDIGGHTDVDVIAVEIKVGDTVAEDDTLITLETDKATMDVPCTAAGVVKAVFLKVGDKVSEGSAIIEVETVGSAAAAPAQAAQAAAPAAAPPPTAAAAPAAAPAPSAPAAAKIDEAAFAKAHAGPSARKLARELGVDLGQVKGTGLKGRIMGDDIKAFVKSVMQGGAAKPAAASASLGGGLDLLPWPKVDFSKFGNVEVKELSRIKKISGQNLSRNWVVIPHVTVHEEADMTELEEFRKQLNKEWEREGVKLSPLAFIIKASVSALKAFPEFNASLDGDNLVLKNYFNIGFAADTPNGLVVPVIKDVDQKGLKQISQELTELSKKAREGKLKPQEMQGACFTISSLGGIGGTGFTPIVNAPEVAILGVCKSQIKPVWNGKEFAPRLMCPLSLSFDHRVIDGAAGMRFTVFLAKLLKDFRRITL

SEQ ID NO: 7559 - protein, 145 aa, Neisseria meningitidis
MGNFLYRGISCQQDEQNNGQLKPKGNKAEVAIRYDGKFKYDGKATHGPSVKNAVYAHQIETGLYDGCYISTTTDKEIAKKFATSSGIENGYIYVLNRDLFGQYSIFEYEVEHPENPNEKEVTIRAEDCGCIPEEVIIAKELIEIN

SEQ ID NO: 7560 - protein, 594 aa, Neisseria meningitidis
MALVELKVPDIGGHENVDIIAVEVNVGDTIAVDDTLITLETDKATMDVPAEVAGVVKEVKVKVGDKISEGGLIVVVEAEGTAAAPKAEAAAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 7561 - protein, 516 aa, Neisseria meningitidis; identical to SEQ ID NO: 2822

SEQ ID NO: 7562 - skipped

SEQ ID NO: 7563 - protein, 261 aa, Neisseria meningitidis
MNPFLNTAFKAARRAGQMMIRAAGNLDAVKTDSKAFNDFVSDVDRNSEIILVEALKEAYPHHKITCEESGSHGKAAAEYEWIIDPLDGTTNFLHGHPQYAISMALLHKGVLQEALVYAPERNDVYMASRGKGALLNDRRIRVSNRIELNRCLIGTGFPVVDQSMMDKYLAILKDFLAKTAGGRREGAASLDLCAVATGRFDGFFEFNLKPWDIAAGALIVQEAGGIVTDMSGEDGWLESGDIVAANPKVLAQMLKIISAHV

SEQ ID NO: 7564 - protein, 271 aa, Neisseria meningitidis
MTTLKPALPAYLDNIRIILTRTSHPANIGSAARAMKTMGLHKLTIVAPNLMATPMTENPPVFDPEHPQSFKLPEESFILASGAADVLENATIAASLDEALADTTIACALTSRRREITAPLQTPRDLVSELLQTANRGEKVALVFGNETFGLSIEEVQACNRLMTINGNPDYFSLNLAQAVQVVCYEIFSQTGSPMTHLQQEDHAATHEQIKGMVAHMESVMNDIGFFNRRNGERLMRRMQSLFGRANTQTEDIDILRGFFNTVSHRIHKKD

SEQ ID NO: 7565 - protein, 285 aa, Neisseria meningitidis
MNYALDALWWKLTSQPVRDLASLLTAPPLWQSGCELSVRELLGEHGFRYLLALDADPTRLTDYLAQRAPFGHRLGIYAEELLAFWFANAPHAELLAHNLTVSGSDGNTQGAADFVARLNGKPYHIELTCKYYGGDTDSPEGMRGFDPKDTLLGKAAKLTAQLGLPHTSDGIRTLRQHGLPLNVKPVSIVRGIGFFPHGFHAFEPPLNPYGWRGIYIQDWAEYGFKRQEVRYHLLDRMAYLAPARVAETETLNATEIRRIDQGLIAVLECRPDGFWHEIERIMKAV

SEQ ID NO: 7566 - protein, 113 aa, Neisseria meningitidis
MKNNVKNWTTKEVKQSLDKFNNILIKNTFLLQYLKKEFSASSAYCLSMLPEEEDIYEILVNGNIIIDLEFNKHTNETVVINVTDVDEYLKTLTNESGRVFFTLAKEIGKQKNI

SEQ ID NO: 7567 - protein, 418 aa, Neisseria meningitidis
MNAAQLDHTAKVLAEMLTFKQPADAVLSAYFREHKKLGSQDRHEIAETAFAALRHYQKISTALRRPHAQPRKAALAALVLGRSTNISQIKDLLDEEETAFLGNLKARKTEFSDSLNTAAELPQWLVEQLKQHWREEEILAFGRSINQPAPLDIRVNTLKGKRDKVLPLLQAESADAEATPYSPWGIRLKNKIALNKHELFLDGTLEVQDEGSQLLALLVGAKRGEIIVDFCAGAGGKTLAVGAQMANKGRIYAFDIAEKRLANLKPRMTRAGLTNIHPERIGSEHDARIARLAGKADRVLVDAPCSGLGTLRRNPDLKYRQSAETVANLLEQQHSILDAASKLVKPQGRLVYATCSILPEENELQVERFLSEHPEFEPVNCAELLAGLKIDLDTGKYLRLNSARHQTDGFFAAVLQRK

SEQ ID NO: 7568 - protein, 144 aa, Neisseria meningitidis; identical to SEQ ID NO: 2154

SEQ ID NO: 7569 - protein, 447 aa, Neisseria meningitidis
MFHSVNVFTGETLYRRPAQDYAEFERRLADLKMRGGAFAQLGVTERAARLQKFADRLEAEKERFAEMVCEEVGRCLHECRAEIGKSIELIRYYARLAPELLAHKTIATQASLSQVRFEPLGVVFAVMPWNYPVWQVLRFAVPAMCAGNACAVKPAPSVARVSQALFDLASDGIPLAGVWLDEAGTLKAVEDTDAMAFTGSTHTGRILAAHAGANLKKTVLELGGSNAFIVMPDADLERAAAEACYSRFRDAGQSCNAAKRIIVTEAAADRFITLFLAECAKLKMGDPKHPDTTLAPLHREDLRDRVHGQVEDAVSNGAVCLTGGKIPQGRGWFYPATVLDRVNPACRVWREEVFGPAALILRAENEEHAIALANDSPFGLGACIYTADTERAWRFAEKIQAGSVFINRHTSSDLRLPFGGVKDSGYGRELSEFGLYEFVNVKTYWQK

SEQ ID NO: 7570 - protein, 217 aa, Neisseria meningitidis; identical to SEQ ID NO: 2148

SEQ ID NO: 7571 - protein, 96 aa, Neisseria meningitidis
MALTLADVDKIARLSRLHLTAEEKEKSLQELNDIFTMVEQMQTINTDGIEPMAHPHEAALRLREDEVTETDRAAEYQAGAPEVRNRLYIVPQVIEE

SEQ ID NO: 7572 - protein, 481 aa, Neisseria meningitidis
MTQYTLKQASVLLQSKQISAVELASAYLAAIAEKNPALNGYITIDQDKTLAEARAADERIAQGNASALTGVPVAYKDIFCQTGWRSACASKMLDNFISPYTATVVQNLLDEGMVTLGRTNMDEFAMGSTNENSFYGAAKNPWNLEHVPGGSSGGSAAVVAARLAPAALGSDTGGSIRQPASHCGITGIKPTYGTVSRFGMVAYASSFDQTGPMAQTAEDCAILLNAMAGFDPKDSTSLEREKEDYTRDLNQPLKGLKIGLPKEYFGEGNSADVLTALQNTIDLLKAQGAELIEVSLPQTKLSIPAYYVLASAEASTNLSRYDGVRYGHRAAQFADLEEMYGKTRAEGFGSEVKRRIMIGTYVLSHGYYDAYYLKAQKLRRLVADDFQTAFARCDLILAPTAPTAAPKIGADASPVETYLSDIYTIAVNLAGLPALTLPAGFSGGGLPVGVQLVGNYFAEAKILGAAHQIQLNSDWHGKRPE

SEQ ID NO: 7573 - protein, 310 aa, Neisseria meningitidis
MKQNRTFTFPDFRTVYSYAPLYRLQHLKYTLRKFFGKKEIYAFEQFVNASPIRQGLFLHCPQNAYPLLREFVDRRFNCKRRLDAMTADFLMAEKLFGTDILHQMEDYRFHLVLAHLSDGISLWLNRNDNCVEEGAWSLSLRDEAGNRLYMATFAFVGTHLLTASVQGPAGEEAKDTVRRITKQLHGLRPQQLMVTALQYFAAVLGLDGAMGIAQKHQVKLRWKLKKRVKMNYDAFWQEYGASLERDGYWHLPQTPARKDLADIESKKRSMYRKRYEMLDNMVAEMKDSLKTEARGISDGIQTEKPPRRTA

SEQ ID NO: 7574 - protein, 476 aa, Neisseria meningitidis
MTWETVIGLEIHVQLNTKSKIFSGASTAFGAEPNAHASVVECALPGVLPVMNREVVEKAIKLGLALDAKINQKNVFDRKNYFYPDLPKGYQISQLDLPIVEHGKLEIVVGDDVKTINVTRAHMEEDAGKSVHEGLNGATGIDLNRAGTPLLEVVSEPEMRSAAEAVAYAKALHSLVTWLDICDGNMAEGSFRVDANVSVRPKGQEEFGTRREIKNLNSFRFLEQAINYEAEAQIEILEDGGKVQQATMLFDPEKGETRVMRLKEDAHDYRYFPDPDLLPVIISDAQMQKAKAEMPELPKEMAARFVADYGVSEYDARLLTASRAQAAYFEEAAKESGQGKLTANWMNGELAAALNKEGMELADSPITAPRLAALVGKIADGTLSSKLAKKAFEAMWAEPEATIAEIIEKHGLQQMTDTGEIEAMVDEVLANNAKAVEQFKSGNEKALNAIVGQVMKASKGKANPAQVQELIKAKLA

SEQ ID NO: 7575 - protein, 336 aa, Neisseria meningitidis
MNHTVTLPDQTTFAANDGETVLTAAARQNLNLPHSCKSGVCGQCKAELVSGDIQMGGHSEQALSEAEKAQGKILMCCTTAQSDININIPGYKADALPVRTLPARIESIIFKHDVALLKLALPKAPPFAFYAGQYIDLLLPGNVSRSYSIANLPDQEGILELHIRRHENGVCSEMIFGSEPKVKEKGIVRVKGPLGSFTLQEDSGKPVILLATGTGYAPIRSILLDLIRQGSNRAVHFYWGARHQDDLYALEEAQGLACRLKNACFTPVLSRPGEGWQGRNGHVQDIAAQDHPDLSEYEVFACGSPAMTEQTKNLFVQQHKLPENLFFSDAFTPSAS

SEQ ID NO: 7576 - protein, 210 aa, Neisseria meningitidis
MDLHNIREDYSKRELSEADCADNPIEQFERWLDEAVRAQVNEPTAVNVAAVDGRGRPNSRMVLLKEVNSEGFVFFTNYHSRKGRSLDAHPFAAMTFFWPELERQVRVEGRVERLAEKLSDEYFESRPYQSRLGAWASAQSEVIPNKAVLVAKAAAVGLKHPLHVPRPPHWGGYIVIPDLLEFWQGRPSRLHDRIQYRLLDGGWIRERLSP

SEQ ID NO: 7577 - protein, 350 aa, Neisseria meningitidis
MMSKQPTSKRQWRDGAAPSAKKTAKPFKSKARPKDETGKTASQPYGQKASDGIKPQNVPKQRAAKAKKLVVRNPNQKIMEHARDLKERRSDLSRMEPERLQKVLAASGVGSRREMEEWITNGWITVNGKTAQLGDKVTPDDHVTVKGSIIKLKWADRLPRIILYYKQEGEIVSRDDPQGRVSIFDRLPQAASSRWVAIGRLDINTSGLLILTTSGELVQRFAHPSFEVEREYAVRVLGGLTGEQMRVLTEEGVMLEDGLAKVERIREQGGEGANKWYNVVIKEGRNREVRRIFESQGLTVSRLVRIGFGPIGLPNRLKRGQFYELNPAEVANIIKWADMLLPGERRRKKA

SEQ ID NO: 7578 - protein, 513 aa, Neisseria meningitidis
MKFLDREASIAKPGFNRWLVPPAALAVHLAIGQIYAYSVFNAPLTKLIGITESAAGDWKLTTVGWIFSIALAMLGASAALFGTWMERVGPRKAIFAAACCFSLGFFVSAFGVRTHNLFLLYLGNGVIGGVGLGLGYIGPVSTLMKWFPDKPGMATGLAIMGFGGGAMLASPLSVSLMNTFSNAASVGVAETFAVLGLLYLALMMFGAFTIRVPADGWKPEGYTAPKTQNKLVSSNHVNVSQAMKTPQFWLLFWVLCLNVTAGIGVLGQASVMIQELFSETSIGRQAAVGAGAAAGFVSLLSLFNMGGRFLWSSVSDKIGRKNTYTIFFVLGSLLYFAVPSIGEGGSKALFIIGFCVIISMYGGGFAAIPAYLKDLFGTYQVGAIHGRILLAWSTAAVIGPVLVNYIRQSQIDSGIPAAQAYSVTMYIMACLLIIGLLCNLAVKSVHEKHHEKDIKTAAHSGNPDDETAISDAYLVGEKVSGGGISVWWRWALAVIPLAYGVVMVFVKALDLFS

SEQ ID NO: 7579 - protein, 451 aa, Neisseria meningitidis
MSDFFHSDVLSVSELNAFAKSLLENHLAGLWIAGEVSNLTRAASGHYYFSLKDSRAQVRCAMFKGAAVRLAKPLKEGDHIEVSGKISIYEARGEFQITVNEVRLKGLGQLYEAYERLKAQLQAEGAFAAERKKPLPVRPQCIGIVTSLAAAALRDVVTTLKRRAPEIPVIVYPTPVQGAGSELQIAQAIKTASQRAECDVLIVCRGGGSIEDLWAFNEEPVVRAIESCTVPVVSGVGHETDFTLADFVADMRAPTPTGAAELVSPNRQESLHRLAQAQCRLKTVLEQRYFDASQKLDWLARQIRHPRQKLDEQRASIGKLAQTLSYSMTQNVRTHTARFERQTQALKHCRPDVSVCKKNIDRFQTALSHAFHQLLTHRRQSLTAQAALLEAVSPQHILERGFSVVKNTRGQVIRNADVLKQGQKLHIIFADGETDVRVSKEQGQQDLFDCI

SEQ ID NO: 7580 - protein, 273 aa, Neisseria meningitidis
MMRIFSTGGKMDTQAVITHIARWLDEYAARANAKGFVVGVSGGIDSAVVSALAARTGRPTLLLDMPIRQHPGQLERARLHIRNLQRQYANVSAQTVDLTDTFQTFEQTVGAHQTAFDSQPLSLANARSRLRMLTLYYYGQIHGLLVTGTGNKIEDFGVGFFTKYGDGGVDISPIADLTKTQVYRLAEALGVDEAIQKAPPTDGLWDTERTDEEQMGASYPELEWAMGVYGTRKPEDFEGRQREVLEIYTRLHRAMQHKINPIPVCRIPPELLG

SEQ ID NO: 7581 - protein, 157 aa, Neisseria meningitidis
MTDFSVWETAPFGATVDHILQRYHNVHRAQFEELVPLAQKVAQVHADTFPAEIAELLAYMQNELLMHMMKEERMLFPMINQGVGRGAAMPIGVMMHEHEEHDRAIARLKELTDNFQPPEGACGSWTRLYALAKEMVEDLNDHIHLENDILFARVLDS

SEQ ID NO: 7582 - protein, 110 aa, Neisseria meningitidis
MSSELIVHTSDAAFEKDVLNADIPVLLDFWAPWCGPCKMIAPILDDIAAEFEGRLKVVKINIDDNEATPSRFGVRGIPTLMVFKNGEVVATKVGALAKGQLTAFVEASIA

SEQ ID NO: 7583 - protein, 354 aa, Neisseria meningitidis
MASYDKISDGWYRVCPKRSSNRALITVKLPFSTLFRLKPMTDITPFANRLGKNIKHLMKWAKRNGIEAWRIYDRDIPQFPFAADVYGDRIHLQEYDTGWLMRPEEYEAWLAEVLEAVAFVTGFAPEQIRLKRRERQKGLQQYEKTGKAGDDFVITENGRKFWVNLDKYLDTGLFLDHRNTRKKVGETAAGKRFLNLFSYTGSFTVYAATGGAASSETVDLSNTYLDWAKRNFELNGIDTERHKIVRADVFQYLQTAYGEGRRFDLIVMDPPSFSNSKKMSDILDIQRDHKKLIDGAVKLLASDGILYFSNNLRSFVLDDLVSEQYAVKDISKQSVPEDFRNKKIHRCWEIRHKS

SEQ ID NO: 7584 - protein, 462 aa, Neisseria meningitidis
MSIKFADLNLDKNILSAVSSEGYESPTPIQAQAIPFALEGRDIMASAQTGSGKTAAFLLPTLQKLTKRSEKPGKGPRALVLTPTRELAAQVEKNALAYAKNMRWFRTVSIVGGASFGYQTRALSKPVDLIVATPGRLMDLMQSGKVDFERLEVLILDEADRMLDMGFIDDIETIVEATPSDRQTLLFSATWDGAVGKLARKLTKDPEIIEVERVDDQGKIEEQLLYCDDMRHKNRLLDHILRDANIDQCVIFTSTKAMTEVIADELYEKGFAANCLHGDMPQGWRNRTLMDLRKGRCKILVATDVAARGIDVPTITHVINYDLPKQAEDYVHRIGRTGRAGRTGIAITFAEVNEYVKVHKIEKYINRKLPELTIEGMEPTRKRKSAGGKPKGKGGWGDRKSGGWRGDHKPSKEGFGGKTRGEGFKKEGFKRDGFKKTGEGFKGKRKAGDSFAGKGERRYKDR

SEQ ID NO: 7585 - protein, 184 aa, Neisseria meningitidis
MKKIIASALIATFALAACQDDTQARLEQQQKQIEALQQQLAQQADDTVYQLTPEAVKDTIPAEAQANGNNGQPVTGKDGQQYIYDQSTGSWLLQSLVGAAAGAFIGNALANKFTRAGNQDSPVARRARAAYHQSARPNARTSRDLNTRSLRAKQQAAQAQRYRPTTRPPANYRRPAMRGFGRRR

SEQ ID NO: 7586 - protein, 186 aa, Neisseria meningitidis
MLPSHRSPDSATHDRIRKMTMNAMPQTAAQNETLHTCSIIVDDAQDFSPMLLDAGRDDTLISESMIPQIRTVAALIAAERHDFSRSSPAEFTDAADFFAARILVLGVRRFHLDVSLLQILKTANSRARRFAEKHRLFFTPAQAELSLNKHKNRRLLTVETEHEVENKGNPVANSLAFVRKLHTLPL

SEQ ID NO: 7587 - protein, 398 aa, Neisseria meningitidis
MQNYLTPNFAFAPMIPERASGSRVWDTKGREYIDFSGGIAVNALGHCHPALVDALNAQMHKLWHISNIYTTRPAQELAQKLVANSFADKVFFCNSGSEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQTARRLCDRHNALLILDEVQTGMGHTGRLFAYEHYGIVPDILSSAKALGCGFPIGAMLATEKIAAAFQPGTHGSTFGGNPMACAVGSRAFDIINTPETLNHVREQGQKLQTALLDLCRKTGLFSQVRGMGLLLGCVLDEAYRGRASEITAAALKHGVMILVAGADVLRFAPSLLLNDEDMAEGLRRLEHALTEFAATSDNP

SEQ ID NO: 7588 - protein, 414 aa, Neisseria meningitidis
MSNENRTCSFCGKSKSHVKHLIEGENAFICDECVSNCIEILHEDGNDGTPSESAGGEPEESGKLPTPAEIVANLNDHVIGQEQAKKALAVSVYNHYKRLRHPKAGANVELSKSNILLIGPTGSGKTLLAQSLARKLDVPFVMADATTLTEAGYVGEDVEQIITKLLGKCDFDVEKAQRGIVYIDEIDKISRKSDNPSITRDVSGEGVQQALLKLIEGTVASVPPQGGRKHPNQEFINVDTTNILFICGGAFAGLEKVIRQRTEKGGIGFGASVHSKDENADITKLFGIVEPEDLIKFGLIPELIGRLPVIATLEELDEDALINILTEPKNALVKQYQALFGMENVELEFEEGALRSIARQAMERKTGARGLRSIVERCLLDTMYRLPDLKGLKKVVVGKAVIEEGREPELVFES

SEQ ID NO: 7589 - protein, 123 aa, Neisseria meningitidis
MRKPQRGYARQDRVKEQIMRELAELVRTGLKDPRAGFITVNEVEVTRDYSHATVFYTILNQDAREITEEVLEHARGHLRSELAKRIKLFKTPELHFKYDESLERGLNLSALIDQVAAEKPVED

SEQ ID NO: 7590 - protein, 307 aa, Neisseria meningitidis
MNTGKPQKRAVNGVLLLDKPEGLSSNTALQKARRLFHAEKAGHTGVLDPLATGLLPVCFGEATKFAQYLLDADKAYTATLKLGEASSTGDAEGEIIATARADISLAEFQTACQALTGNIRQVPPMFSALKHEGKPLYEYARKGIVIERKARYITVYAIDIAEFDAPKAVIDVRCSKGTYIRTLSEDIAKHIGTFAHLTALRRTETAGFTIAQSHTLEALANLNETERDSLLLPCDVLVSHFPQTVLNDYAVHMLHCGQRPRFEEDLPSDTPVRVYTENGRFVGLAEYQKEICRLKALRLMNTAASAA

SEQ ID NO: 7591-7592 - skipped (2 entries)

SEQ ID NO: 7593 - protein, 390 aa, Neisseria meningitidis
MKRDLSKMTCIEDLRRVAKRKMPRMFYDYIDSGSWTETTYRENTSDFKDIRFRQKVLVNMEGRSLETKMIGQDVKMPVAIAPTGFTGMAHADGEILAARAAEKFGIPFTLSTMSICSIEDVAENTSAPFWFQLYVMRDREFMENLIKRAKDAKCSALVLTADLQVLGQRHKDIKNGLSAPPKPTIANLINLATKPEWCMKMLNTERRTFRNIVGHAKNVGDLSSLSSWTSEQFDPRLSWDDVARIKDLWGGKLIIKGIMEPEDAEKAAKSGADALIVSNHGGRQLDDTVSAIKALPDIVSAVGSDIEVWMDSGIRSGQDILKAWALGAKGTMIGRAFLYGLGAYGEEGVTRALEILYKEMDISMAFTGHRDIQDVDASILRGKDWGRETV

SEQ ID NO: 7594 - protein, 148 aa, Neisseria meningitidis
MRLTTKGRFAVTAMLDLAMNAQTGAVKLSAISERQNISLSYLEQLFGKLRRAGLVESLRGPGGGYILAAPAARINIAQIIAAAEDRLDATQCGSKANCHHGAPCLTHDLWENLNKTINDYLGSVTLQSIIEQKNNGDGSRVVQFTHIH

SEQ ID NO: 7595 - protein, 404 aa, Neisseria meningitidis
MTVKTPVYLDYAATPPVDKRVAEKMIPYLTETFGNPASNSHSFGWEAEEAVEKARADIAALINADSKEIVFTSGATESNNLAIKGAAHFYKSKGNHLITVKTEHKAVLDTMRELERQGYEVTYLDVQENGLVDLDVLKAAIREDTILVSVMWVNNEIGVVQDIPAIGEICRERKIIFHVDAAQACGKVPVDVEAAKVDLLSMSGHKVYGPKGIGALYVRRKPRVRLEAQMHGGGHERGFRSGTLPTHQIVGMGEAFRIAKEELAQDTAHYLKLRDIFLKGIEGIEEVYINGDLEHRVPNNLNVSFNFVEGESLIMAVKELAVSSGSACTSASLEPSYVLRALGRNDELAHSSLRITFGRMTTEEEVQFAAELIKSKIGKLRELSPLWEMFKDGIDLNSIEWAAH

SEQ ID NO: 7596 - protein, 128 aa, Neisseria meningitidis
MAYSDKVIDHYENPRNVGTFDKGDDSVGTGMVGAPACGDVMRLQIKVNDEGIIEDAKFKTYGCGSAIASSSLITEWVKGKSLDDALAIKNSEIAEELELPPVKIHCSILAEDAVKAAVADYRKRQENR

SEQ ID NO: 7597 - protein, 126 aa, Neisseria meningitidis
MPSEPPAASGPSGAVQQGRNMITLTENAAKHINDYLAKRGKGLGVRLGVKTSGCSGMAYNLEFVDEADGDDLIFEGHGARIYIDPKSLVYLDGTQVDYTKEGLQEGFKFENPNVKDSCGCGESFHV

SEQ ID NO: 7598 - protein, 73 aa, Neisseria meningitidis
MGGKVQHNKGKIRDNALKALVKSDLFRHKVERKRKGKGSYNRQEAKKWRDGFDTVPPFLCLKRGSFRRSRRSL

SEQ ID NO: 7599 - protein, 166 aa, Neisseria meningitidis
MSQYFTLFRIEPAFDIDTENLEQTYRALAARFHPDKFASASAFEQKQAVMMSSTINDAYRTLKNPIDRAAYLLKTSGIDADAPEHTAFAPEFLMQQMEWRETLMEARAGNDLESLKNLDNEIRDEQEKLFCGLKQSFARQDYDTAAQQVRQGRFLDKLRNEISSAL

SEQ ID NO: 7600 - protein, 916 aa, Neisseria meningitidis
MTDATIRHDHKFALETLPVSLEDEMRKSYLDYAMSVIVGRALPDVRDGLKPVHRRVLYAMHELKNNWNAAYKKSARIVGDVIGKYHPHGDTAVYDTIVRMAQNFAMRYVLIDGQGNFGSVDGLAAAAMRYTEIRMAKISHEMLADIEEETVNFGPNYDGSEHEPLVLPTRFPTLLVNGSSGIAVGMATNIPPHNLSDTVNACLRLLDAPDTEIDELIDIIQAPDFPTGATIYGLSGVREGYKTGRGRVVMRGKTHIEPIGRNGEREAIVIDEIPYQVNKAKLVEKIGDLVREKTLEGISELRDESDKSGMRVVIELKRNENAEVVLNQLYKLTPLQDSFGINMVVLVDGQPRLLNLKQILSEFLRHRREVVTRRTLFRLKKARHEGHIAEGKAVALSNIDEIIKLIKESPNAAEAKDKLLARPWRSSLVEEMLTRSGLDLEMMRPEGLAANIGLKEQGYYLSEIQADAILRMSLRNLTGLDQEEIVESYKNLMGKIIDFVDILSKPERITQIIRDELEEIKTNYGDERRSEINPFGGDIADEDLIPQREMVVTLTHGGYIKTQPTTDYQAQRRGGRGKQAAATKDEDFIETLFVANTHDYLMCFTNLGKCHWIKVYKLPEGGRNSRGRPINNVIQLEEGEKVSAILAVREFPEDQYVFFATAQGMVKKVQLSAFKNVRAQGIKAIALKEGDYLVGAAQTGGADDIMLFSNLGKAIRFNEYWEKSGNDEAEDADIETEISDGIEDETADSENALPSGKHGVRPSGRGSGGLRGMRLPADGKIVSLITFAPETEESGLQVLTATANGYGKRTPIADYSRKNKGGQGNIAINTGERNGDLVAATLVGETDDLMLITSGGVLIRTKVEQIRETGRAAAGVKLINLDEGETLVSLERVAEDESELSDASVISNVTEPEVEN

SEQ ID NO: 7601-7602 - skipped (2 entries)

SEQ ID NO: 7603 - protein, 183 aa, Neisseria meningitidis
MPSERRPFQTAFLSNRKTVGKLAERVQSRYDGLHKFKHICSAAMALIKEPLDKVKQRNEELEAAEEAAAQEALGREQEAARVSEWEERYKLSRSEFEQFWKGLPQTVQNKLQASQKTWKSGMDKICANNAKAEGKTPNGIKFSELACKTAKTEARLEELHNRKKALIDEMAREADKKELSKRL

SEQ ID NO: 7604 - protein, 548 aa, Neisseria meningitidis
MKHLHDLPAWSKLWNHFDDSKTLHMREMFEQDPQRAERYWLQVGGLTLDYSKNRINDETMSLLFELAREAGVPERMRQMFHGEKINTTENRAVLHVALRNRTNSPIVVDGEDVMPKVNRVLQRMGEFAHEVRSGSWLGYTNQVITDVVNIGIGGSDLGPLMMCTALKPFGHPRLNMHFVSNVDGSQLRDVLSKVHPETTLFIIASKTFTTQETLTNALTAREWFLNHAGDEEAVAKHFAAVSTNQKAVAEFGIDTANMFEFWDWVGGRYSLWSAIGLPIMLYLGEENFIEMLNGAHLMDQHFINTPLERNLPVILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMRGKTPDEVRAELKAQGMDEVRIEELVPHKTFSGNRPTNLILMDKVNPRNMGSLIAMYEHKTFVQGIIWGINSFDQWGVELGKQLAKTILGELTGETGPQKHDSSTERLINLYLQTNRK

SEQ ID NO: 7605 - protein, 282 aa, Neisseria meningitidis
MLSKISESLANLSGAERKVAECALAEPKWFVHAAVAEIAERASVSQPTVIRFCRSLGYKGLPEFKLALSASIGHEGMPYVHEELNADDDMASVVEKVLGNAAASLLGERRFLKESELENAIATLMHARRVEFYGVGNSGIVAQDAQHKFFRFGMSTVAYVDTHTQLMAASVLSDQDVLVAISNTGSSIELLDAVSIAKENGASVIALTRNDSPLAQLADCVLSVATQENAELYTPMVSRLLQLAVIDILAIGLALRLGDAASLQLQKSKKSIHNKHIDYDKD

SEQ ID NO: 7606 - protein, 328 aa, Neisseria meningitidis
MSSTPNKQAGYPRLVADIGGTNARFALETAPRVIEKAAVLPCKDYDTVTDAVRAYLNQSGATAVRHAAFAIANPILGDWVQMTNHHWAFSIETTRQTLGLDTLILLNDFTAQALAVTQTSSKDLMQVGGQKPVEFAPKAVIGPGTGLGVSGLVHSHAGWVALAGEGGHTSFPPFDDMEVLIWQYAKNKYGHVSAERFLSGAGLSLVYEALAAKQKAKPAKLMPSEITEKALSGASPLCRQTLDIFCAMLGTVASNLALTLGARGGVYLCGGIIPRVLEYFKTSPFRSRFENKGRFEAYLAAIPVYVVLSEFPGISGAAAALDNHLRNV

SEQ ID NO: 7607 - protein, 231 aa, Neisseria meningitidis
MFVWHEYENAAEAAQSLADAVADALQGALDEKGGAVLAVSGGRSPIAFFNALSQKDLDWKNVGITLADERIVPTVHADSNTGLVREYLLKNKAEAAMWIPMVEDGKTETELHPDAVVDYALKHYKQPDVLVLGMGNDGHTASIFPKAPQFQTAIDGSAGVALVHTTPVTAPHERVSMTLDAIAHTGHVFLAIRGEEKKAVFDQAAQGENREYPINLVLNHQGVNCHVFYAE

SEQ ID NO: 7608 - protein, 481 aa, Neisseria meningitidis
MSTQTNFDLVLFGATGDLAMRKLLPCLYQAHVAGLLHPEGRILGVSRSELDTEGFLAKVETSSKIHVKENFSDEAWASFVERFAYLKVDVTQPDDFAALGDLVKARKETDNVVIYLSTAPKFFAQACENLAAIGLNADNVRVVLEKPLGTDLASSQQINTDVARYFKEGQIYRIDHYLGKESLQNLLALRFANVMFEPLWNNKYIESVQLTIAEQLGVEERGEFYDITGALRDMVQNHLMQMLCMTAMEAPASLDADAVRDEKVKVIKSLKPLTVESVNENVVRGQYTAARGMNGYLEEINVPQDSFTETYVAIKAEIENERWKGVPFYLRTGKRMAGKVAEIVLNFKDLNSHIFEGSRTAPNRLVIELQPYESVRLYTQMKTPGAGNKVETVPLATDLGKALEGRRAEAYERLLLDVINGKLALFNRRDELEAAWEYVMPILENWTNNTTPPHGYGAHSWGPEAARELLARDGHKWHEEQ

SEQ ID NO: 7609 - protein, 611 aa, Neisseria meningitidis
MNTTPIHSKLAEITGRIIERSRPTREKYLAKIRSAKQMGRLERNQLGCSNLAHGYAAMPKSIKIEMLQETVPNLGIITAYNDMVSAHQPFKDFPDQIKDEAQKNGATAQVAGGTPAMCDGITQGYAGMELSLFSRDVIAMSTAIGLSHQMFDGSLFMGVCDKIVPGLMIGALSFGHIPGIFVPAGPMSSGIGNKEKARTRQLFAEGKVGRNELLKSEMGSYHSPGTCTFYGTANSNQMMMEMMGVHLPAAAFVHPYTDLREALTRYAAGHLARGIKNGTIKPLGEMLTEKSFINALIGLMATGGSTNHTMHLVAMARAAGVILNWDDFDEISSIIPLLIRVYPNGKADVNHFTAAGGLPFVIRELLNAGLLHDDVDTVVGHGMRHYTKEPFLIDGKLEWREAPETSGNDDILRKADNPFSPDGGLRLMKGNIGRGVIKVSAVREGCRIIEAPAIVFNDQREVLAAFERGELERDFVCVVRYQGPRANGMPELHKLTPPLGILQDRGFKVALLTDGRMSGASGKVPASIHMTPEALMGGNIAKIRTGDLIRFDSVSGELNVLINETEWNAREVESIDLGANQQGCGRELFANFRSMTSSAETGAMSFGGEFA

SEQ ID NO: 7610 - protein, 212 aa, Neisseria meningitidis
MSKLTPREILTAGAVVPVMAIDDLSTAIDLSHALVEGGIPTLEITLRTPVGLDAIRLIAKEVPNAIVGAGTVTNPEQLKAVEDAGAVFAISPGLHESLAKAGHNSGIPLIPGVATPGEIQLALEHGIDTLKLFPAEVVGGKAMLKALYGPYADVRFCPTGGISLATAPEYLALPNVLCVGGSWLTPKEAVKNKDWDTITRLAKEAAALKPKA

SEQ ID NO: 7611 - protein, 346 aa, Neisseria meningitidis
MKAMVYHGANDIRFEEKPRPQIIDPTDAVVKIVKTTICGTDLGIWKGKNPEVADGRILGHEGIGIVEEVGEAVKNIKVGDKVIISCVSKCCTCDNCKTQLYSHCRNGGWILGYMIDGTQAEYVRTPYADNSLVPLPDNVNEEIALLLSDALPTAHEIGVQYGDVKPGDTVFIAGAGPVGMSALLTAQLYSPAAIIVCDMDENRLKLAKELGATHTINPASGEVSKQVFAIVGEDGVDCAIEAVGIPATWNMCQDIVKPGGHIAVVGVHGQSVDFKLEKLWIKKLAITTGLVNANTTEMLMKAISSSSVDYTKMLTHHFKFSELEKAYDVFKHAAENQVMKVVLEAD

SEQ ID NO: 7612 - protein, 349 aa, Neisseria meningitidis
MILMNTPIPFSERLIRWQKQHGRHHLPWQVKNPYCVWLSEIMLQQTQVATVLDYYPRFLEKFPTVQTLAAAPQDEVLSLWAGLGYYSRARNLHKAAQQVVRQFGGTFPSERKDLETLCGVGRSTAAAICAFSFNRRETILDGNVKRVLCRVFARDGNPQDKKFENSLWTLAESLLPSENADMPAYTQGLMDLGATVCKRTKPLCHQCPMADICEAKKQNRTAELPRKKTAAEVPTLPLYWLIVRNRDGAILLEKRPAKGIWGGLYCVPCFESLNGLSDFAAKFSLTMADMDEQTALTHRLTHRLLLITPFEAQMPSESPSDGIWIKPAHLKDYGLPKPLEIYLNGNRLE

SEQ ID NO: 7613 - protein, 60 aa, Neisseria meningitidis
MNTNLNDKDKAMDTAIRFQKRMRIPKFFFLILGITMVLAFIQDVITGSNFLQITINVKFS

SEQ ID NO: 7614 - protein, 186 aa, Neisseria meningitidis
MNMKTLLALAVSAVCSVGVAQAHEHNTIPKGASIEVKVQQLDPVNGNKDVGTVTITESNYGLVFTPDLQGLSEGLHGFHIHENPSCEPKEKEGKLTAGLGAGGHWDPKGAKQHGYPWQDDAHLGDLPALTVLHDGTATNPVLAPRLKHLDDVRGHSIMIHTGGDNHSDHPAPLGGGGPRMACGVIK

SEQ ID NO: 7615 - protein, 324 aa, Neisseria meningitidis
MIAKHIDRFPLLKLDRVIDWQLIEQYLNRQKTRYLRDHRGRPAYPLLSMFKAVLLGQWHSLSDPELEHSLITRIDFNLFCRFDELSIPDYSTLCRYRNRLAQDNTLSELLELINRQLTEKGLKIEKASAAVVDATIIQTAGSKQRQAIEVDEEGQISGQTTPSKDSDARWIKKNGLYKLGYKQHTRTDAEGYIEKLHITPANAHECKHLSPLLEGLPKGTTVYADKGYDSAENRQHLEEHQLLDGIMRKAHRNRPLTEVQTKRNRYLSKTRYVVEQSFGTLHRKFRYARAAYFGLVKVSAQSHLKAMCLNLLKAANRLSAPAAA

SEQ ID NO: 7616 - protein, 742 aa, Neisseria meningitidis
MRSAVLFIYFFLLNIFLFQPAVIHIQSNYILFMSIVSAPLPALSALIILAHYHGIAANPADIQHEFCTSAQSDLNETQWLLAAKSLGLKAKVVRQPIKRLAMATLPALVWCDDGNHFILAKTDGEGEHAQFLIQDLVTNKSAVLSFAEFSNRYSGKLILVASRASVLGSLAKFDFTWFIPAVIKYRRLFFEVLVVSVVLQLFALITPLFFQVVMDKVLVHRGFSTLDVVSVALLVVSLFEIVLGGLRTYLFAHTTSRIDVELGARLFRHLLSLPLSYFEHRRVGDTVARVRELEQIRNFLTGQALTSVLDLAFSFIFLAVMWYYSSTLTWVVLASLPAYAFWSAFISPILRTRLNDKFARNADNQSFLVESITAVGTVKAMAVEPQMTQRWDNQLAAYVASGFRVTKLAVVGQQGVQLIQKLVTVATLWIGARLVIESKLTVGQLIAFNMLSGQVAAPVIRLAQLWQDFQQVGISVARLGDILNAPTENASSHLALPDIRGEITFEHVDFRYKADGRLILQDLNLRIRAGEVLGIVGRSGSGKSTLTKLVQRLYVPEQGRVLVDGNDLALAAPAWLRRQVGVVLQENVLLNRSIRDNIALTDTGMPLERIIEAAKLAGAHEFIMELPEGYGTVVGEQGAGLSGGQRQRIAIARALITNPRILIFDEATSALDYESERAIMQNMQAICANRTVLIIAHRLSTVKTAHRIIAMDKGRIVEAGTQQELLAKPNGYYRYLYDLQNG

SEQ ID NO: 7617 - protein, 179 aa, Neisseria meningitidis
MKITHCKLKKKVQKELLRFFVLEVTARSAADILGIHPNSAVLFYRKIRMVISHYLALAANEVFEGSVELDESYFGGRRKGKRGRGAAGKVVVFGILKRNGRVYTVVVDNAKSDTLMPVIKQKIMPDSIVYTDSLSSYDKLDVSGFIHYRINHSKEFADRQNHINGIENFWNQAKRVLRK

SEQ ID NO: 7618 - protein, 144 aa, Neisseria meningitidis
MDNKKEFINNLTNRYMWIYPLVLNILFLPFYQSYQSFFIALGCLFALVRKMQSLDFKLQNHIVLLNIKSAWADKKVFLIRIVVSWLAVMEIWMCFISESSTWVCGAFCLNSEILEKIFRGFGYSGSLYFLFILMIDLNKLRESI

SEQ ID NO: 7619 - protein, 63 aa, Neisseria meningitidis
MIGSGDTKQCKKFSACDGKYHVYDPLALDLDGDGIETVTAKGFSGSLKTERVNTMSIHSMPLN

SEQ ID NO: 7620 - protein, 242 aa, Neisseria meningitidis; identical to SEQ ID NO: 974

SEQ ID NO: 7621 - protein, 400 aa, Neisseria meningitidis
MSARSSALAEFGNMVANLVSAKNEKDISKRNEYYKQAGYSALLAFGNLASNIAPGSTSSHIVNGTNASVIASRLSGNISSAIQEHKDGKVNINRFQNILADLYSLGGLGSTLIEKNGNMQSWGIPLAIAGDIIAATAIATGDTGTISTEEFYNFDNWKGFGYELFEDWSRWVYDWLPDGWNLWKELDRNRSGQYHIYDPLALDLDGDGIETVAAKGFSGSLFDHNGNGIRTATGWVSADDGLLVRDLNGNGIIDNGAELFGDNTKLADGSFAKHGYAALAELDSNGDNIINAADAAFQSLRVWQDLNQDGISQANELRTLEELGIQSLDLAYKDVNKNLGNGNTLAQQGSYTKTDGTTAKMGDLLLAADNLHSRFTNKMLSISHVRENTISPFVLGCLNK

SEQ ID NO: 7622 - protein, 120 aa, Neisseria meningitidis
MIAKSLFFRCQKIYFIYFILFICLYLNISYDGEIFIYFIINFTHLLICHGILLVFCRIFPYENIPFTIFLNFISLFLIFLPLIFTIRELIDSYYIESIINLFLILIPHVIFLIYLKGKQI

SEQ ID NO: 7623 - skipped

SEQ ID NO: 7624 - protein, 164 aa, Neisseria meningitidis
MNDHIVQIIRRFGLGRIFFYSYSKSSIIIFSSYVVYYIIYNYQFNYLSLLIYLLPILCSIYMFIFFLGKTKDTLTTERRKKFFNSIFPLRILMIIGSEKKRLGIGSFYLLNLLWIIWCLMIHREQVPLNNLTLLLSFIFSLFFLLCDFVLLLNVYVYFFKLREA

SEQ ID NO: 7625 - protein, 142 aa, Neisseria meningitidis
MSTDSTNYAAKHESLGKSVQRELQKTQSQLRQVVRKMQSKYNINNKARVAEISLLRQMQSQFSRKYVNKNLGNSNTLAQQGSYTKKDGTTAQAGDLLLAADNLHSRLTDKMLSISHVRENTISPFVLGCLKQITINAYHYLK

SEQ ID NO: 7626 - protein, 179 aa, Neisseria meningitidis
MDFLEIFIMSAFRKILLIISCLLIASCSFVETIFYMAISPEPVVVDFPLGKKTKRSIELKQKIGKPYAISLGTNFIHYDPKQGERWIDDKLNYPYNISVKIFKVEEDGKKLIIDELLTERSRKLGGGVFGAGGKYSMHIYDFYLPEGEYLFEISDNSEYIPLYDEINNSIRIVVNARIQ

SEQ ID NO: 7627 - protein, 217 aa, Neisseria meningitidis
MKITHCKLKKKVQKELLRFFVLEVTARSAADILGIHPNSAVLFYRKIRTVINHHLALAADEVFEGPVEPDESDFGGRRKGRRGRGAAGKVVVFGILKRNGRGYTVVVDNAKSETLLPVIKKKIMPDSIVYTDSLSSCDKLDVSGFIHYRINHSKEFADRQNHINGIENFWNQAKRVLRKYNGIDRKSFPLFLKECEFRFNFGTPSQQLKILRDWCGI

SEQ ID NO: 7628 - protein, 269 aa, Neisseria meningitidis
MRPYATTIYQLFILFIGSVFTMTSCEPVNEKTDQKAVSAQQAKEQTSFNNPEPMTGFEHTVTFDFQGTKMVIPYGYLARYTQDNATKWLSDTPGQDAYSINLIEISVYYKKTDQGWVLEPYNQQNKAHFIQFLRDGLDSVDDIVIRKDACSLSTTMGERLLTYGVKKMPSAYPEYEAYEDKRHIPENPYFHEFYYIKKGENPAIITHRNYHRYGENDYSTSVGSCINGFTVRYYPFIREKQQLTQQELVGYHQQVEQLVQSFVNNPSKK

SEQ ID NO: 7629 - skipped

SEQ ID NO: 7630 - protein, 257 aa, Neisseria meningitidis
MRPYATTIYQLFILFIGSVFTMTSCEPVNEQTSFNNPEPMTGFEHTVTFDFQGTKMVIPYGYLARYTQDNATKWLSDTPGQDAYSINLIEISVYYKKTDQGWVLEPYNQQNKAHFIQFLRDGLDSVDDIVIRKDACSLSTTMGERLLTYGVKKMPSAYPEYEAYEDKRHIPENPYFHEFYYIKKGENPAIITHWNNRVNQAEEDNYSTSVGSCINGFTVQYYPFIREKQQLTQQELVGYHQQVEQLVQSFVNNSSKK

SEQ ID NO: 7631 - protein, 1829 aa, Neisseria meningitidis
MNEGEVVLTPEQIQTLRGYASRGDTYGGWRYLANLGDRYADDAAAIVGKDANLNGLNLWMKKGVENLWDDTVGKKTRLEKFDRVALQHFRQYARLINQNNGRLPNTSEIERSYYKAVTDNGVSSSAAIDLVINRSLPDMADGYWALGLGIEAERIHNEQAVNNPNGSERDNRKQLISALDKGFDGSFKEKHFTFLQSVMMDVTKLGVEYTIDGWQKIGGWGNGIINDLYKSVVKREWTGIFEIVNNNIKQGNEAFKNEINSLVHDMKAAGKEFGDDLNTQWNNLTQAAEIIYNDIVDNTSQGIEKGVKAIKELSEKMKNAASDLADGSAEKAKQVVEDLAQAAKEAYENAKSTAEKAAQAAREFFKGLPSFKDLAEKFRDLFPNPEGWIDDGHQCLAPWVKETKKRNGKYHVYDPLALDLDGDGIETVATKGFAGSLFDHTNNGIRTATGWVSADDGLLVRDLNGNGIIDNGAELFGDNTKLADGSFAKHGYAALAELDSNGDNIINAADAAFQTLRVWQDLNQDGISQANELRTLEELGIQSLDLAYKDVNKNLGNGNTLAQQGSYTKTDGTTAKMGDLLLAADNLHSRFKDKVELTAEQAKAANLAGIGRLRDLREAAALSGDLANMLKAYSAAETKEAQLALLDNLIHKWAETDSNWGKKSPMRLSTDWTQTANEGIALTPSQVAQLKKNALVSLSDKAKAAIDAARDRIAVLDAYTGQDSNTLYYMSEEDALNIVKVTNDTYDHLAKNIYQNLLFQTRLQPYLNQISFKMENDTFTLDFSGLVQAFNHVKETNPQKAFVDLAEMLAYGELRSWYEGRRLMTDYVEEAKKAGKFEDYQKVLGQETVALLAKTSGTQADDILQNVGFGHNKNVSLYGNDGNDTLIGGAGNDYLEGGSGSDTYVFGEGFGQDTVYNYDYATGRKDIIRFTDGITADMLTFTREGNHLLIKAKDGSGQVTVQSYFQNDGSGAYRIDEIHFDNGKVLDVATVKELVQQSTDGSDRLYAYQSGNTLNGGLGDDYLYGADGDDLLNGDAGNDSIYSGNGNDTLDGGEGNDALYGYNGNDALNGGEGNDHLNGEDGNDTLIGGAGNDYLEGGSGSDTYVFGKGFGQDTVYNYDYATGRKDIIRFTDGITADMLTFTREGNHLLIKAKDGSGQVTVQYYFQNDGSGAYRIDEIHFDNGKVLDVATVKELVQQSTDGSDRLYAYQSGNTLNGGLGDDYLYGADGDDLLNGDAGNDSIYSGNGNDTLDGGEGNDALYGYNGNDALNGGEGNDHLNGEDGNDTLIGGAGNDYLEGGSGSDTYVFGKGFGQDAVYNYDYATGRKDIIRFTDGITADMLTFTREGNHLLIKAKDGSGQVTVQSYFQNDGSGAYRIDEIHFDNGKVLDVATVKELVQQSTDGSDRLYAYQSGNTLNGGLGDDYLYGADGDDLLNGDAGNDSIYSGNGNDTLNGGEGNDALYGYNGNDALNGGEGNDHLNGEDGNDTLIGGAGNDYLEGGSGSDTYVFGKGFGQDAVYNYDYATGRKDIIRFTDGITADMLTFTREGNHLLIKAKDGSGQVTVQSYFQNDGSGAYRIDEIHFDNGKVLDVATVKELVQQSTDGSDRLYAYQSGSTLNGGLGDDYLYGADGDDLLNGDAGNDSIYSGNGNDTLDGGEGNDALYGYNGNDALNGGEGNDHLNGEDGNDTLIGGAGNDYLEGGSGSDTYVFGEGFGQDTVYNYHVDKNSDTMHFKGFKAADVHFIRSGSDLVLSASEQDNVRISGFFYGENHRVDTFVFDDAAISNPDFAKYINAGNNLVQSMSVFGSNTAATGGNVDANIQSVQQPLLVTPSA

SEQ ID NO: 7632 - protein, 867 aa, Neisseria meningitidis; identical to SEQ ID NO: 3150

SEQ ID NO: 7633 - protein, 264 aa, Neisseria meningitidis
MTTILAFDIETVPDVQGIRTLYELPSSLPDDEVVLFAQQKRRAQTGGDFMQHHLHQVVAISCCMRWGQDKVHVGTIGEMDDGEEVVIAKFFELIEKHTPQLVSWNGGGFDLPVLHYRSLIYGINAARYWDMGDGDFGDSRDFKWNNYISRYHQRHCDLMDLLALYQPRANVPLDDMAKLCGFPGKLGMDGSKVWEAFHTGRLKEIRNYCETDAANTYLMYLRFCLVSGRLDADEYEMEIKRMRNYLSAQAGEKPHWEEFVRAWE

SEQ ID NO: 7634 - protein, 289 aa, Neisseria meningitidis
MKFIFFVLYVLQFLPFALLHKIADLTGLLAYLLVKPRRRIGEINLAKCFSEWSEEKRKTVLKQHFKHMAKLMLEYGLYWYAPAGRLKSLVRYRNKHYLDDALAAGEKVIILYPHFTAFEMAVYALNQDIPLISMYSHQKNKILDEQILKGRNRYHNVFLIGRTEGLRALVKQFRKSSAPFLYLPDQDFGRNDSVFVDFFGIQTATITGLSRIAALANAKVIPAIPVREADNTVTLHFYPAWKSFPGEDAKADAQRMNRFIEDRVREHPEQYFWLHKRFKTRPEGSPDFY

SEQ ID NO: 7635 - protein, 178 aa, Neisseria meningitidis
MAASVRILGIDPGSRVTGFGVIDVRGRDHFYVASGCIKTPADAPLADRIAVIVRHIGEVVTVYKPQQAAVEQVFVNVNPASTLMLGQARGAALAALVSHKLPVSEYTALQVKQAVVGKGKAAKEQVQHMVVQMLGLSGTPQPDAADGLAVALTHALRNHGLAAKLNPSGMQVKRGRFQ

SEQ ID NO: 7636 - protein, 79 aa, Neisseria meningitidis
MPHTLPDISQCIRQNLEQYFKDLNGTEPCGVYDMVLHQVEKPLLVCVMEQCGGNQSKASVMLGLNRNTLRKKLIQHGLL

SEQ ID NO: 7637 - protein, 336 aa, Neisseria meningitidis
MHIGGYFIDNPIALAPMAGITDKPFRRLCRDFGAGWAVCEMLTSDPTLRNTRKTLHRSDFADEGGIVAVQIAGSDPQQMADAARYNVSLGAQLIDINMGCPAKKVCNVQAGSALMQNEPLVAAILEAVVRAAGVPVTLKTRLGWHDDHQNLPVIAKIAEDCGIAALAVHGRTRTQMYKGEARYELIAETKCRLNIPVWVNGDITSPQKAQAVLKQTAADGIMIGRGAQGRPWFFRDLKHYAEHGVLPPALSLAECAAAILNHIRAIHAFYGDTAGVRIARKHIGWYIDEMPDGEQTRREINRLDSAAAQYDMLAGYLERLAEKTDSWACAYRPNAF

SEQ ID NO: 7638 - protein, 457 aa, Neisseria meningitidis
MSNPFSSLGLGTELVSALTAQGYENPTPIQAAAIPKALAGHDLLAAAQTGTGKTAAFMLPSLERLKRYATASTSPAMHPVRMLVLTPTRELADQIDQNVQGYIKNLPLRHTVLFGGMNMDKQTADLRAGCEIVVATVGRLLDHVKQKNIHLNKVEIVVLDEADRMLDMGFIDDIRKIMQMLPRQRQTLLFSATFSAPIRKLAQDFMNAPETVEVAAQNTTNANVEQHIIAVDTIQKRNLLERLIVDLHMNQVIVFCKTKQSVDRVTRELVRRNLSAQAIHGDRSQQSRLETLNAFKDGNLRVLVATDIAARGLDIAELPFVINYEMPAQPEDYVHRIGRTGRAGADGVAISLMDESEQKMFESIKELTGNKLLIERIEGFEPQWWEQGGAKPEKPEMREPRQRNRYESAKAQREKNTRPENAANDAGAACGKIAGRSRRSRREHRTCALLQPRYGVK

SEQ ID NO: 7639 - protein, 375 aa, Neisseria meningitidis
MSNWKPNIPYNDLPPLPPKQDIESKTILKRCIAARASLARLKQAAELIPNQAMLINTLPVMEARASSEIENIVTTTDKLFQSLQMDTERQDPATKEALQYRTALFAGYESLTSRPLCTQTAIMVCNAIKHPYEMAIRKTGGTALKGGNSGNVVYTPPEGEETIRGKLANWERFIHESGDLDPLIIMAAAHYQFEAIHPFTDGNGRTGRILNSLLLIEKGLLDLPILYLSRYIIENRADYYRLLLGVTERQDWESWIIYILDGVADTADWTVSKIDAIRRLFEQTRQHIRTHAQGIYTHELVNLLFEQPYTRIANLEAAGIAKRQTASKYLKELSDIGVLQEIVIGRDKLFIHPRLMELLRGEGNSFTSFQSLVKA

SEQ ID NO: 7640 - protein, 342 aa, Neisseria meningitidis; identical to SEQ ID NO: 3654

SEQ ID NO: 7641 - protein, 503 aa, Neisseria meningitidis
MSEQNHPQTEPQLDENQIIALRREKLHNIRQQRNAYPNDFKRDSFAADLHAQYGEIGKEELDPQGIPVKVAGRMMLKRQMGKASFATIQDVSGQIQLYLNNKGVSQEVLDDFNHWDLGDIVGAEGTLFKTNHGELTVRVSGIRLLSKSLRPLPDKHKGLSDQETKYRQRYVDLIANEESRNTFIKRSQIIQSVRNFMVGEHYLEVETPMMHPIPGGATAKPFVTHHNALDIPLYLRIAPELYLKRLVVGGLERVFEINRSFRNEGMSVRHNPEFTMIEFYEAFSDYERMMQMAEDIIRNASRTVNGTANITYNGKEVDLESPFERLTILEAIKKYNPHYTDEQLNDAEWLKKEIVKHGESLPPSPGIGSLQLALFEGCAEGKLWNPTFIVDYPVEVSPLARASDTKQGLTERFELFVVGRELANGYSELNDPEDQAERFKAQVVQKDAGDDEAMHYDADYIRAMEFGLPPTGGCGIGIDRLVMLLTDSQTIRDVILFPQMRPE

SEQ ID NO: 7642 - protein, 417 aa, Neisseria meningitidis; identical to SEQ ID NO: 480

SEQ ID NO: 7643 - protein, 59 aa, Neisseria meningitidis
MENIVKFEHEVLIVCVGRYLDYVTIRVFIKISLPGGILFLKTVGFGFVWGQSRPNWSNR

SEQ ID NO: 7644 - protein, 598 aa, Neisseria meningitidis
MNTVSNYLSALREAMKAQGLDALVIPSADPHLSEYLPEHWQARRELSGFTGSVGTFVLTTDEAGVWVDSRYWEQAAKQLAGSGIVLQKSGQVPPYNEWLAASLPENAAVGIPSDMVSLTGKRTLAQSLAAKNIRIEHPDNLLNQVWTNRPALPAETVFIHDPDYVSETAAEKLARVRAVMAEKGADYHLVSSLDDIAWLTNLRGSDVPFNPVFVSFLLIGKDNAVLFTDRCRLNAEAAAALQTAGIAVEPYAQVADKLAQIGGVLLIEPNKTAVSTLVRLPESVRLIEGINPSTLFKSCKSEADIARIREAMEHDGAALCGFFAEFEDIIGNGGSLTEIDVDTMLYRHRSVRPGFISLSFDTIAGFNANGALPHYSATPESHSTISGNGLLLIDSGAQYKGGTTDITRVVPVGTPSAEQKSDNTLVLKAHIALAEAVFPENIPSPLIDAICRKPLWQAQCDYGHGTGHGVGYFLNVHEGPQRIAFAAPATPETAMKKGMVTSIEPGLYRPGKWGIRIENLAANQAVAAPQETEFGSFLCFETLTLCPIDTRLMDTALMTDGEIDWVNRYHAEVRRRLEPLTEGAAKAWLIKRTEPLAR

SEQ ID NO: 7645 - protein, 392 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKNTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 7646 - protein, 158 aa, Neisseria meningitidis
MQKIPLTVRGAELLKQELQQLKSVARPEVIEAIAEARSHGDLSENAEYEAAKERQGFIEGRISELEHKLSVAHIINPTEIHAEGKIVFGTTVTLEDLETEEHVIYQIVGEDEADIKQGKIYVGSPIARALIGKEEGDTAEVQAPGGVREYDIIEVRYI

SEQ ID NO: 7647 - protein, 83 aa, Neisseria meningitidis
MKNLRLGIFGFKVRKCGFLCRKLIIFKFFVSKISLSAYFQLLLRTWRVCRRRGTIANFIEFGRIAAVQRQTSRRFSGRLVFLF

SEQ ID NO: 7648 - protein, 433 aa, Neisseria meningitidis
MTESVRLPVARLKPSTVALPGSKSISNRTLLLAALSDNACEIHSLLKSDDTDRMLEALDKLGVQIEYLAEDRLKVHGTGGRFPNRTADLFLGNAGTAFRPLTAALAVLGGDYHLHGVPRMHERPIGDLVDALRIAGADVEYLGKEHYPPLHIGERQDNGERVIPIKGNVSSQFLTALLMALPLTGQAFEIRMVGELISKPYIDITLKLMAQFGVQVINEGYRVFKIPADAHYHAPEHLHVEGDASSASYFLAAGLIAATPVRVTGIGANSIQGDVAFARELEKIGADVVWGENFVEVSRPKERAVQSFDLDANHIPDAAMTLAIVALATGQTCTLRNIGSWRVKETDRIAAMANELRKLGAKVVEEAEAIHITPPETLTPDAVIDTYDDHRMAMCFSLVSLLGVPVVINDPKCTHKTFPTYFDVFSSLTETAE

SEQ ID NO: 7649 - protein, 177 aa, Neisseria meningitidis; identical to SEQ ID NO: 1702

SEQ ID NO: 7650 - protein, 508 aa, Neisseria meningitidis; identical to SEQ ID NO: 3958

SEQ ID NO: 7651 - protein, 468 aa, Neisseria meningitidis
MEKNTLSARAPSPWLPLLLAIAIFMQMLDATILNTALPEIAADLNESPLDMQLAVISYTLTVALLIPLSGYLADRFGTKKVFFGSIAVFMLGSALCAASGSLFELTLSRVVQGIGGSMLVPIPRLTILRVYDKSKLLNAINYAVMPALIGPVLGPLAGGYLVEYASWHWIFLLNLPIGLLGFILGRNIMPDIKGSNISLDFKGYLIFSAAACLLLLSAESLSHALPPYFALLPLCGGLLFARRYFRHMKTASKPIYSADLFLIRTFRLGLAGNLFSRLGISSIPFLMPLMFQIAFGFGASLSGWLVAPVALSSLLVKPLIAPLMKRFGYRTVLLWNTKLLAAFIMLLALPDGNSPLWIWVFLSLAIGACNSLQFSAMNTLTLADLRPQQTGSGNSLMAVNQQLAISMGIVAGALILKNWTFLIPASSGLHSAFRMTLLSIGGITLASSLVFKRLHVSDGTNLTRNTPS

SEQ ID NO: 7652 - protein, 259 aa, Neisseria meningitidis
MSATIPPKIIRYDSNPTDVYFFGTCVLDLFMPEAGMDAITLIEQQGIRVHFPMAQSCCGQPAYSSGHPTEAFDVAKAQLDLFPENWPIVVPSGSCGGMMKHHWPTLFKGSEYEERAVDCAGRIIEFTHFLLAIGFKPEDKGEPLKVAVHTSCAARREMNVHLSGWQLIDGMENVERIVHDHESECCGFGGTFSVKQADISGAMVTDKVAALKETGATEIISADCGCMMNIGGKIAKDEPDMPRPKHIASFLLERTGGKA

SEQ ID NO: 7653 - protein, 233 aa, Neisseria meningitidis
MSARENILAKLKKADALPMEEPAVFDYYREMGVSWGSEVERLKHWAAAMRAVKTEIYWVTKSNWMQVFREAAEGKGLKNILLPLATEHGQIARAALADSNIEPIAFEREIDTWKTEFFTNIDAGFSGAQCGIARTGTLMLFSSPEEPRTLSLVPPVHFCLFDTSKMYNEFHNAVEGEKLVENGMPTNVFLISGPSKTADIQLTLAYGAHGPRDLVILAILPDHISPADLEENA

SEQ ID NO: 7654 - protein, 484 aa, Neisseria meningitidis
MTTQTIKFHMKPETFKQNAAISLQDKPLRKSLRTAMDMLMTKRKAVLTDEEELQSLRDLCEHVRQRSLSKLPALLEQLEENLTKLGVKVHWAETPTEACQIIHDIITAKNGKLMVKGKSMVSEEIELNHYLEAKGIKAVESDLGEFIVQMAGEKPTHIVMPAIHKTKEQVSELFHQNLGTPLTDDVDQLTGFARKALRDIYSTADVGLSGVNFAVAETGTLCLVENEGNGRLSTTVPPVHIAITGIEKVVAKLSDIPPLYSLLPRSAIGQNITTYFNMITGPRRSEELDGPQEMHLVLLDNGRSQAYAEDQMRRTLQCIRCGACMNHCPVYTRIGGAAYGTTYPGPIGEIISPHLLGLDATRDLPTACTMCGACVEVCPVRIPITEQMQRLRVEAQRSPTETVPHPIRGQGASHTFGEQMAWRTFNGIFSGSKTYRAFGWAATKFRNLTPRKQLGWTQNRVPMKPAKKTLHELMAEKMRQKEQA

SEQ ID NO: 7655 - protein, 161 aa, Neisseria meningitidis
MIQIGIIMGSNSDWPVMRQAAQFLEEFGVEYEARVVSAHRTPDLMFQYAETARARGIKAIIAGAGGAAHLPGMVAAKTTVPVLGVPVPSKYLRGEDSLLSIVQMPKGVPVATFAIGEAGAANAALFAVSMLANETPELAQKLADFRAKQEQAVLNMELEQI

SEQ ID NO: 7656 - protein, 237 aa, Neisseria meningitidis; identical to SEQ ID NO: 3650

SEQ ID NO: 7657 - protein, 222 aa, Neisseria meningitidis
MTTHLSNVAPDLQNYLNAIGEPEHPVLTRLREKTGHHRMGKMAIAREQAAVLVWLAKLIRAEKYLEIGVFTGYSSTALALALPEHGRITACDINVTFTDTARQVWNEAGVAHKISLHLQPALLTLDDLIAQGEAGSYDLALIDADKPPTPQYFERCLKLVRQGGIIAIDNILLNGRVMREAASDAPPSVGILKDFNQNLPNDPRIVPITLPVGDGLTLLLKK

SEQ ID NO: 7658 - protein, 658 aa, Neisseria meningitidis
MSRIAALPDHLVNQIAAGEVVERPANALKEIVENSIDAGATAIEVELAGGGIRLIRVSDNGGGIHPDDIELALHRHATSKIKTLNDLEHVASMGFRGEGLASIASVSRLTLTSRQNDSSHATQVKAEDGKLSSPTAAAHPVGTTIEAAELFFNTPARRKFLKSENTEYAHCATMLERLALAHPHIAFSLKRDGKQVFKLPAQSLHERIAAIVGEDFQTASLGIDSGNGALRLYGAIAKPTFAKGKTDKQYCFVNHRFVRDKVMLHAVKQAYRDVLHNALTPAFVLFLDLPPEAVDVNVHPTKTEIRFRDSQQVHQLVFHTLNKALADTRANLTESVGNAGEVLHDITGVVSTPMPSENDSENLFDSVSNYPTGNKSDTHNAFGSSGKTAPMPYQSAYAPQQRSLSLRESRAAMNTYAELYKKTDDIDLELSRFEQARFGNMPSETPAPQTDTPLSDGIPSQSELPPLGFAIAQLLGIYILAQAEDSLLLIDMHAAAERVNYEKMKRQRQENGNLQSQRLLIPVTFAASHEECAALADYAETLAGFGLELSDMGGNTLAVRAVPAMLGKADVVSLAKDVLNELAQVGSSQTIEEHENRILATMSCHGSIRAGRRLTLPEMNALLRDMENTPRSNQCNHGRPTWVKLTLKELDALFLRGQ

SEQ ID NO: 7659 - protein, 704 aa, Neisseria meningitidis
MAYQVLARKWRPKTFADLVGQEHVVKALQNALDEGRLHHAYLLTGTRGVGKTTIARILAKSLNCENAQHGEPCGVCESCTQIDAGRYVDLLEIDAASNTGIDNIREVLENAQYAPTAGKYKVYIIDEVHMLSKSAFNAMLKTLEEPPEHVKFILATTDPHKVPVTVLSRCLQFVLRNMTAQQVADHLAHVLDSEKIAYEPAALQLLGRAAAGSMRDALSLLDQAIALGSGKVAENDVRQMIGAVDKQYLYELLTGIINQDGAALTAKAQEMAACAVGFDNALGELAILLQHLALIQAVPNALAHDDPDSDILHRLAQTISGEQIQLYYQIAVHGKRDLSLAPDEYAGFMMTLLRMLAFAPLAAASCDANAVIENTELKSPSAQTAEKETAAKKPQPRPEAETAQTPVQTASAAAMPSEGKTAEPVTNQENNDIPPWEDAPDETAAGTAQASAKSIQTASEAGTPPKNQVSKNEAADNETDAPLSEVPSENPIQATPNNEALETEAFAHEAPAKPFNGYSFPNDDYLVEDGAEIPPPDWEHAAPADAEEENNADESSNNEDHTPYAPPPEFSTENWAAIVRHFARKLGAAQMPAQHSAWTEYHPDTGLMVLAMTAEARATADKKRLDKIRDTLAQAYGLQLTLQTQDWRDEAGRETPAMQDKRVQAEDRQKAQALLEADPAAQKILQAFGAQWQPESLELAANRP

SEQ ID NO: 7660 - protein, 111 aa, Neisseria meningitidis
MFGKAGLGGLMKQAQQMQENMKKAQAKLAETEIEGEAGNGLVKITMTCAHEVRKIDISPDLIQEAADDKEMLEDLILAALKSARGKAEETANKTMGAFTQGLPPGVGDFFR

SEQ ID NO: 7661 - protein, 348 aa, Neisseria meningitidis
MSDDKSKALAAALAQIEKSFGKGAIMKMDGSQQEENLEVISTGSLGLDLALGVGGLPRGRIVEIFGPESSGKTTLCLEAVAQCQKNGGVCAFVDAEHAFDPVYARKLGVKVEELYLSQPDTGEQALEICDTLVRSGGIDMVVVDSVAALVPKAEIEGDMGDSHVGLQARLMSQALRKLTGHIKKTNTLVVFINQIRMKIGVMFGSPETTTGGNALKFYSSVRLDIRRTGSIKKGEEVLGNETRVKVIKNKVAPPFRQAEFDILYGEGISWEGELIDIGVKNDIINKSGAWYSYNGAKIGQGKDNVRVWLKENPEVANEIDAKIRALNGVEMHITEGTQDETDGERPEE

SEQ ID NO: 7662 - protein, 254 aa, Neisseria meningitidis
MCSCLVVKNTVIGSGRTKIAVPLVARDAAELSAVLEQIKNMPFDIAEFRADFLECAGSIGEILHHTQTVRDALPDKPLLFTFRRHGEGGSFPCSDDYYFELLDALIESRLPDIIDIELFSGETAVRCAVANAQKNGIAALLCNHEFHRTPPQEEIVCRLKQMEDCGADICKIAVMPQSAEDVLTLLSATLKAKELAAKPIVTMSMGQTGAVSRLAGQVFGSSITFGSGTQNSAPGQIGVSALRATLDCLENGAD

SEQ ID NO: 7663 - protein, 671 aa, Neisseria meningitidis
MMKLNPQQLEAVRYLGGPLLVLAGAGSGKTGVITQKIKHLIVNVGYLPHTVAAITFTNKAAAEMQERVAKMLPKPQTRGLTICTFHSLGMKILREEANHIGYKKNFSILDSTDSAKIIGELLGGTGKEAVFKAQHQISLWKNDLKTPEDVVQTASNIWEQQTARVYASYQETLQSYQAVDFDDLIRLPAVLLQQNSEVRNKWQRRLRYLLVDECQDTNTCQFTLMKLLTGAEGMFTAVGDDDQSIYAWRGANMENLRKMQENYPQMKVIKLEQNYRSTARILKIANKVIENNPKLFTKKLWSQLGEGEPVKVVACQNEQHEADWVVSQIVKQKLIGGDKTQYADFAVLYRGKHQARIFEEALRGARIPYQLSGGQSFFDKAEIKDVLSYVRLLANPNDDPAFLRAVTTPKRGIGDVTLGKLNTYAHEHECSLYEAAQNEEALATLNNTNRQHLQTFMDMFVSYLAKAETSEAGEFINSLLEEIDYENHLMQNEEGKAGEIKWRNVGDLVSWFARKGGEDGKNIIELAQTVALMTLLEGKDEEETDAVSLSTLHAAKGLEYPYVFLVGCEEGVLPHNDSIEEGNVEEERRLMYVGITRAKRQLTLTHCVKRKKQGTWQFPEPSRFIDEMPQEDLKILGRKGGEPIVSKEEGRRNLADIIGRLDNLKKSGAAD

SEQ ID NO: 7664 - protein, 318 aa, Neisseria meningitidis
MSSRKIIHIDMDAFYASVELREQPHLKGRPVVVAWEGARSVICAASYEARQFGLHSAMSVATAKRLCPQAVYVPPHFDLYRQVSAQIHAVFRRYTDLIEPLSLDEAYLDVTRNFKNIPYAGDVAKEIRAAIFAETGLTASAGIAPNKFLAKIASDWRKPNGQFVLPPHKVMAFLETLPLGKIPGVGKVTLKKMQSLGMRTAGDLRRFERGELLNHFGRYGYRLYDLVRGTDERPVKAERERLQISTEITLPEDLPLEQAAGHLPHLAEDLWRQITRKNVEAQSVTLKLKTYDFRIITRTLTYSSVLPDCALCCRLRKC

SEQ ID NO: 7665 - skipped

SEQ ID NO: 7666 - protein, 259 aa, Neisseria meningitidis
MAASPEAKFTEEKILWVKHHTPKLITFAISRPESYRFKAGQFSRLGFYEGEGFIWRAYSIVSAEYADTLEYFAVLIQDGPMSARFAKMQQGNTILLDKNATGFLLPERFPDGKDLVMLCTGSGIAPFLSILEQPEIRQRFDTVNLIHSVSFPEELIFNDRLAALTEHPLVGEYGHSFRFVPVTTRAANPSGLSGKRIPELLKNNSIEQALHTKFTPESTRFMICGNPEMVKDTFQTLLDMGYAMHRNRIPGQIMMENGF

SEQ ID NO: 7667 - protein, 470 aa, Neisseria meningitidis
MLFEFKENKMIVASRWPLLEKVFLRFGMPVAVVDLESTGGNLYEDRVTEVALVKFEQGRVVRHEWLVNPQKPIPQFVAGLTGISDGMVADAPVFAEIAGELFSVLKGCVLVAHNSRFDYTFLKHEFHRAGIGFSSPALCSVQLSRCLYPQFYKHSLDSIIERLGIVVEDRHRAMADVSALCDYLEYSLSEHGVEAWIRQCFRLMNPKPLPAALPERLREQLYGLPDGMGVLACFDGGGKVNYIGTFERVYSEISALLDSGKAPFDWCNTEEVRFFPALGSLHAYKIKAELVGRYHSDCYVSAKNLLKTFTTVRFEKGSDGMLNAKTAALKNGVTDNPPTGLFANKKAARRALSSWAETYGLCPAAAGILPDGYAEDEPCPVYVSGRCDKACGRSDEQVLAFAHKLPVLDWGKMHEVEITETDPLTGEKVVLHGMGGALEMDDGLWYFDKDLPDAFKAKFKTDRKNIKEIG

SEQ ID NO: 7668 - protein, 379 aa, Neisseria meningitidis
MQNIFDPLVIRGKSLTPIVQGGMGVGVSASGLSSAVARENGIGTIASVDLRHLHEDLLAESQINPSEEKYTSLNCTALDREIQKAKSASEGKGLIAVNVMKAVKDHAAYVRQACESGADAVVMGAGLPLDLPEMTEGYHKDVALLPILSESRGINIVLKRWMKKGILPDAIVVEHPAHAAGHLGASTVEGVNDAKFDFKRVIEETFEVFKSLGLESEKIPLILAGGMANFEKVKTALKNWGASAVQIGTAFAVTEEGDAHLNFKKTLAGAETEKVVEFMSVAGLPARGVRTKFLDSYIKRESKLQTNAKADPRRCTQGLNCLTSCGLRDGLSKAGQFCIDIQLAAAFRGEVDKGLFFRGKDRCPSAMPSAPSARRYNIC

SEQ ID NO: 7669 - protein, 163 aa, Neisseria meningitidis; identical to SEQ ID NO: 2106

SEQ ID NO: 7670 - protein, 498 aa, Neisseria meningitidis
MTTENQAGSPASGIGTSEQTKAAPKAKKTFDPRASVIQIHPEGERIHPKKAEGRFAKLRIAAVLATQFVFYVIPWFNWSGRQAVVFNIPERHFFIFGLSLGVGDLIYLALLLMICAFGLFWWTTIAGRLWCGYSCPQTVYTEIMLWIDNLVEGDRNKRLKLEKSPWNFTKIRIKATKYLLIFLVCAWTGITFAGWFVPIRQFVPDLFTGAAGGGAMFAAAFYGFMTFFFAHIMREKVCLHMCPYARFQSAMFDKDTLIVSYDAERGEPRGARKKTVNKEEAGLGDCINCAMCVQVCPVGIDIRNGLQYQCIGCAACIDACDEIMDKMGYPRGLIRYTTESALEHEYSEKDIKKRLLRPRVAGYGAVLALVIIAFLAGLSTRKMVEVDILKDRGVLVRENAKGWLENAYSLRIINKSEKEQLITASVKGFDEIALTGLPEGGIKVAPRETVTLPVQVSTIPEYADKGSHPIEFTFQYRESGAPDGKPVVLEEDATFIGE

SEQ ID NO: 7671 - protein, 39 aa, Neisseria meningitidis
MYPPHTSGRRIKLYNSGNIFWEKRIFSKLETQRLKKQEK

SEQ ID NO: 7672 - protein, 65 aa, Neisseria meningitidis
MLSRKGRTRGKAAAGDRRGRIFDLRAKPAIIPFEIKSYRLCAGLSIAFVYELAPSVLPIWGCRFF

SEQ ID NO: 7673 - protein, 659 aa, Neisseria meningitidis
MSQLANAIRFLSADAVQKANSGHPGAPMGMAEMAETLWTKFLNHNPANPKFYNRDRFVLSNGHASMLLYSLLHLTGYNLSIEDLKNFRQLHSKTPGHPEYGYTDGVETTTGPLGQGIANAVGMALAEKILAAEFNKDGLNIVDHYTYVFMGDGCLMEGVSHEACSLAGTLGLGKLIVLYDDNNISIDGKVDGWFTENIPQRFESYGWHVVPNVNGHDTAAIQAAIEAARAETGKPSIICCKTLIGKGSANKEGSHKTHGAPLGADEIEATRKHLGWTYPAFEIPQEIYDAWNAKEQGAKLEADWNELFAQYQAKYPAEAAEFVRRMDKKLPDNFDEYVQAALKEVCAKAETIATRKASQNSIEILAKELPELVGGSADLTPSNLTDWSNSVSVTRDKGGNYIHYGVREFGMGAIMNGLVLHGGVKPFGATFLMFSEYERNALRMAALMKINPVFVFTHDSIGLGEDGPTHQPIEQTATLRLIPNMDVWRPCDTAESLVAWAEAVKAADHPSCLIFSRQNLKFQARSEQQLNDIKRGGYVISEAQGNAQAVIIATGSEVELALEAQKALAAQNIAVRVVSMPSTNVFDRQDAAYQAAVLPEGLPRIAVEAGHADGWYKYVGLNGAVVGINRFGESAPADLLFKAFGFTVDNVVDTVKSVL

SEQ ID NO: 7674 - protein, 462 aa, Neisseria meningitidis
MSTRTEHDTMGNVEVPSEAYWGAQTQRSRNNFKIGGETLPQPLIYALALVKKAAAATNVSLGRIKPEQADLITQAADDVLSGKLDGQFPLVVWQTGSGTQSNMNMNEVLANRANEIAGTGLAAYQPVHPNDHVNHAQSTNDAFPTAIHVAAAIEINRHLIPAVKALRDTLDKKAQAFAPIVKIGRTHLQDATPLTLGQEFSGYVSQLDHGLGRLNDALKDLYELALGGTAVGTGLNSHPEYAEKAAAKLAELSGLPFVSAPNKFEALGGRDAAVAASGALKTLAASLNKIANDIRWLASGPRCGLGEIKIPENEPGSSIMPGKVNPTQCEAMTMVCCQVFGNDVTIGMAGASGNFELNVYMPVIAYNLLQSIHLLGDACNSFNEHCAIGIEPVPEKIDYFLHHSLMLVTALNRKIGYENAAKVAKTAYKNNKSLRETAVELGLLTGEEFDELVVPADMVHPR

SEQ ID NO: 7675 - protein, 307 aa, Neisseria meningitidis
MENQRPLLGFALALLAAMTWGTLPIAVRQVLKFVDAPTLVWVRFTVAAAVLFVLLALGGRLPKRRDFSWCSFRLLLLGVAGISANFVLIAQGLHYISPTTTQVLWQISPFTMIVVGVLVFKDRMTAAQKIGLVLLLAGLLMFFNDKFGELSGLGAYAKGVLLCAAGSMAWVCYAVAQKLLSAQFGPQQILLLIYAASAAVFLPFAEPAHIGSLDGTLAWVCFAYCCLNTLIGYGSFGEALKHWEASKVSAVTTLLPVFTVIFSLLGHYVMPDTFAAPDMNGLGYAGALIVVGGAVTAAVGDRLFKRR

SEQ ID NO: 7676 - protein, 174 aa, Neisseria meningitidis
MSLNKVILIGRLGRDPEVRYMPNGEAVCNFSVATSETWNDRNGQRVERTEWHNITMYRKLAEIAGQYLKKGGLVYLEGRIQSRKYQGKDGIERTAYDIVANEMKMLGGRNENSGGAPYEEGYGQSQEAYQRPAQQSRQPASDAPSHPQEAPAAPRRQPVPAAAPVEDIDDDIPF

SEQ ID NO: 7677 - protein, 461 aa, Neisseria meningitidis
MMARDNRIQMFPHEWRASTTLSGVYALRMLGMFLVLPVLAVYAASLPGAEGNKTLVGLAMGIYGLTQALLQLPLGIASDKFGRKKTIYAGLVVFAAGSFLAAAADTLPMLVAARAIQGAGAVSAAVTALLADLTRDGVRTRAMAMIGLSIGLTFSVSLVVAPVIADAVGVRGLFMLTGILTVISIGVVAWMTPDPEVSKLHEDTQAQPSRIGEVLKNRRLLTLDFGIFALHAAQMALFTALPFAMTQLGLEKIQHWKVYLPSTITGLVVMVPLIIVGETRNKLKQVFVLGIVCIAAAQLGLLSGMRSVGLITAYLVVYFIGFNVLEASLPSMVSKIAPSDLKGTAMGVYNTMQSLGLFAGGAAGGLLFQKYGFSGVFAFCSILMLLWLVIAVLSPAPKPVKNLSYPVGGVWQGNQEGLYRALSELEGVEDIGFSFDGQTVYLKVLQKGFDQAAAEKIITGV

SEQ ID NO: 7678 - protein, 207 aa, Neisseria meningitidis
MRKPTDTLPVNLQRRRLLCAAGALLLSPLAHAGAQREETLADDVASVMRSSVGSVNPPRLVFDNPKEGERWLSAMSARLARFVPEEEERRRLLVNIQYESSRAGLDTQIVLGLIEVESAFRQYAISGVGARGLMQVMPFWKNYIGKPAHNLFDIRTNLRYGCTILRHYRNLEKGNIVRALARFNGSLGSNKYPNAVLGAWRNRWQWR

SEQ ID NO: 7679 - skipped

SEQ ID NO: 7680 - protein, 163 aa, Neisseria meningitidis
MKYRRFYRNGGTYFFTVVTNKRQKILTDDAVRLALRQAVMAVRERYPFEILAWVLMPDHLHTIWRLPDNDSAYSERWRQIKRHSQYLIGGNLRLWQKRFWEYTIRDEADFAWHFDYLHFNPVKHGYVGQISDWGFSTFHRYVKQGIYPHNWGGGNADFSIGYD

SEQ ID NO: 7681 - skipped

SEQ ID NO: 7682 - protein, 243 aa, Neisseria meningitidis
MSREINAGRHHFLYGGISGGGVHYWDNKDFSEQSLRLSFGYKNRSVTRSFGIVPFVEQNLLGGSRYNFVGGFNADFSQRLSERWRLTLNAGNMWKHYQEDRTAARYDSHMPLAGATLMYSAPKDWLLYGGADWSHNITKEAEQASIRKGLRVGAVKTFDGGLGLRANLRYTRRMFDAPGTIVYRFPRKDHEYQANLSLWHDKISWKGFTPQLNFRYLKIDSNMKSFYTRKNMQIFMSVEKDFK

SEQ ID NO: 7683 - protein, 502 aa, Neisseria meningitidis
MTTTPANVLASVDLGSNSFRLQICENNNGQLKVIDSFKQMVRFAAGLDEQKNLSAASQEQALDCLAKFGERLRGFRPEQVRAVATNTFRVAKNIADFLPKAEAALGFPIEIIAGREEARLIYTGVIHTLPPGGGKMLVIDIGGGSTEFVIGSTLNPDITESLPLGCVTYSLRFFQNKITAKDFQSAISAARNEIQRISKNMRREGWDFAVGTSGSAKSIRDVLAAEMPQEADITYKGMRALAERIIEAGSVKKAKFENLKPERIEVFAGGLAVMMAAFEEMKLDRMTVTEAALRDGVFYDLIGRGLNEDMRGQTVAEFQHRYHVSLNQAKRTAETAQTFMDSLCHAKNVTVQELALWQQYLGRAAALHEIGLDIAHTGYHKHSAYILENADMPGFSRKEQTILAQLVIGHRGDMKKMSGIIGTNEMLWYAVLSLRLAALFCRSRQDLSFPKNMQLRTDTESCGFILRIDREWLERHPLIADALEYESVQWQKINMPFKVEAV

SEQ ID NO: 7684 - protein, 107 aa, Neisseria meningitidis; identical to SEQ ID NO: 1800

SEQ ID NO: 7685 - protein, 27 aa, Neisseria meningitidis
MGKISRLMEHGPIFKQNLNQQLKKDKT

SEQ ID NO: 7686 - protein, 181 aa, Neisseria meningitidis; identical to SEQ ID NO: 428

SEQ ID NO: 7687 - protein, 336 aa, Neisseria meningitidis
MSKKRVLTGVTTTGIPHLGNYVGAIRPAVRAAQNLDTESFLFLADYHGIIKCHEPEMIHQSTQAVAATWLACGLDPERTTFYRQSDTPEVMELNWILTCITAKGLMNRAHAYKAAVQANAENGQEDPDFGVEMGLFSYPILMTADILMFNANEVPVGRDQIQHVEMARDIAGRFNHRFRELFTLPEVKIDENVELLVGLDGRKMSKSYGNTIPLWENDKKTQKSVNKIITNMKEPGEPKQPDESPLFEIYKAFSTPSETVEFTKMLADGLAWGEAKKLLAAKINAELAEPRERYNELTADPSQIEEILQAGAAKARKEARELLDKVRDAVGIRPLK

SEQ ID NO: 7688 - protein, 859 aa, Neisseria meningitidis
MRYDKLTAKFQQALAEAQSLALAADGSYLEAGFVLKALLDDQNSGAAALLAHAGVNVPQVKQRLQQHLNSLPKVSGQGGDILPSRELQAVLNLMDKAATKRSDAYIASELFLLALVQQNDATGKILKEAGATEQNINAAIDAVRGGQNVNDANAEDQRDALKKYTLDLTQRARDGKLDPVIGRDDEIRRAIQVLQRRTKNNPVLIGEPGVGKTAIVEGLAQRIVNGEVPESLRNKRLLVLDLAALIAGAKYRGEFEERLKGVLNDLAKDDGNTLIFIDEIHTLVGAGKTDGAMDAGNMLKPALARGELHCIGATTLDEYRQYIEKDAALERRFQKVLVGEPSVEDTIAILRGLQERYEIHHGIDITDPAIVAAAELSDRYITDRFLPDKAIDLIDEAASRVKMEKETKPEAMDKIDRRLIQLRMEKAHVEKEKDDASKKRLELIDEEINGLQKEYADLDEIWKAEKAISDGAANIKKQIDEVKIKIEQAKRQGDLALASKLMYEDLEHLEKQRAAAERADTDSTKPANKLLRNNVGAEEIAEVVSRMTGIPVSKMMEGERDKLLKMEEVLHRRVVGQDEAVRAVSDAIRRSRSGLADPNKPYGSFLFLGPTGVGKTELCKALAGFLFDSEDHLIRIDMSEYMEKHAVARLIGAPPGYVGYEEGGYLTEQVRRKPYSVILLDEVEKAHPDVFNILLQVLDDGRLTDGQGRTVDFKNTVIVMTSNIGSQHIQQMGIQDYEAVKEVVMEDVKEHFRPEMINRIDEVVVFHGLDQDNIRNIAKIQLKGLEKRLEKQNLRLAVSDAALDIIAKAGFDPIYGARPLKRAIQSEIENPLAKALLAGNYAPESEIRVEADGDRLKFA

SEQ ID NO: 7689 - protein, 404 aa, Neisseria meningitidis
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLNDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 7690 - protein, 69 aa, Neisseria meningitidis
MPYVNIKVTGGKEAPTAAQKAELIGGVTELLARVLGKNPETTVVVIDEVDTDNWGIGGKSVSERRKEGR

SEQ ID NO: 7691 - protein, 268 aa, Neisseria meningitidis; identical to SEQ ID NO: 3786

SEQ ID NO: 7692 - protein, 421 aa, Neisseria meningitidis
MSEALAKETLNPFEIARKQVKTACDRLKTDPAVYEILKSPTRVLEVNFPVKLDDDTVKTFTGYRSQHNNAVGPYKGGVRFHPSVNLDEVKALSIWMTIKCCVAGIPYGGGKGGITLDPRDYSEAELERIARAYAEAIAPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEALFKEFQEKGFITNEAGYGKEITNAELLALDVDVLAPCALENQLTSENAGKVRAKIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 7693 - protein, 61 aa, Neisseria meningitidis
MCSAFFRRIPCGLGNKIIYRLIKSGRFQLHAITFCLKIGYSCEPDGLFHSEPLFVKRKQNV

SEQ ID NO: 7694 - skipped

SEQ ID NO: 7695 - protein, 153 aa, Neisseria meningitidis
MKPQKSLRARAMDILSRQELSRIGLKRKLAPHAESEEELENVLNEFAERNWQSDLRYAEAYIRSKSRKHGSLRLKQALAQQGIDEETSRNLLPDRSSEKLAAIAVLRKKFKHPAADLKEKQKQARFLAYRGFDADTVQTALKHAWDDGWEEDC

SEQ ID NO: 7696 - protein, 53 aa, Neisseria meningitidis
MSEQSEKNHNPLLEDERKNPVYRMGQAVAGFMLVVWAGVLALVFFLVFRFWLS

SEQ ID NO: 7697 - protein, 44 aa, Neisseria meningitidis
MPSETFRRHRQPISAGYPIIAFFSLNSTFPFPKIFPHPFQNTLS

SEQ ID NO: 7698 - protein, 160 aa, Neisseria meningitidis
MTQQRQLPSHELIMSELMMPDTANFSGNVHGGELLLLLDQVAYSCASRYSGNYCVTLSVDKVLFKEPIHVGDLVTFYASVNYTGRTSMEIGIRVEAQNIRTGEIRHTNSCYFTMVAVKDGKPVPVPPLEILTDRQRCRYEKAKKRRDISLQASGDVSCGC

SEQ ID NO: 7699 - protein, 415 aa, Neisseria meningitidis
MLKQTTLLAACTAVAALLGGCATQQPAPVIAGNSGMQDAPSSAVYNNPYGATPYSPAPAGDAPYVPPVQSAPVYTPPAYVPPSAPAVSGTYVPSYAPVDINAATHTIVRGDTVYNISKRYHISQDDFRAWNGMTDNTLSIGQIVKVKPAGYAAPKAAAVKSRPAVPAAAQPPVQSAPVDINAATHTIVRGDTVYNISKRYHISQDDFRAWNGMTDNMLSIGQIVKVKPAGYAAPKTAAVESRPAVPAAVQTPVKPAAQPPVQSAPQPAAPAAENKAVPAPAPQSPAASPSGTRSVGGIVWQRPTQGKVVADFGGNNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 7700 - protein, 248 aa, Neisseria meningitidis
MNVLISNDDGYLSEGIAVLARVTAEFANVRVVAPERDRSGVSNSLTLERPLQLKQAQNGFYYVNGTPTDCIHIGQSVFSDFQADFVFSGINRGANMGDDTLYSGTVAAATEAYLMGIPAVAFSLNDASGRYWATAEQALWTLLAHFFKNPPQSPILWNINIPAVAPEDVRGIKIARLGRRHHGQNVIPARNPRGEQIYWIGPVGEVSDREEGTDFGECGAGFITVTPLQIDLTAYPDMAETAAFWHAD

SEQ ID NO: 7701 - protein, 518 aa, Neisseria meningitidis
MDFSWLAEPHTWIGFATLLVLEVVLGIDNLVFVAILANKVQPARRDRARIIGLGLAVVIRIIMLAFMAHIITLTEPLFQIGGLAVSGKDMIMLAGGIFLLYKATTELHERLEGHNRFTVADSQKKHAPFWGVVAQILILDAVFSIDSVITAVAMVDHIVVAMGAVVVAMAVMISASKLLTEFVDRHPTVVMLCLGFLLMIGFSLIAEAFHFHIPKGYLYAAIGFSILIELFNQISQRNSRKNDYIGSSWRKRTAENVLGMMGIRESVLADAGGESGDDAHFEENEKSMIRSVLTLAERPIMGVMIPRRDIERLDISQSREEQCAQLQNTPYSRLLVVGKAGVDEPLGYINKKDLLSQLLETGGLDIQTALRQPLVLPDSTTALGAIELFRQSSADYALVVDEFGAVLGMVTMKDLLETIAGEFPEEFEREEEPAVQGNPDESLTVEGALEYVELAPQLNLPQQEEDADFHTVAGLIMEELQTIPDVGDFADFHGWRFEVVEKEGQRIERVKITKLPEE

SEQ ID NO: 7702 - protein, 46 aa, Neisseria meningitidis
MAFCHCPDKLLNYLNYFDRRYTHMQDPEQSSKPARRFLCVPSVQAA

SEQ ID NO: 7703 - protein, 262 aa, Neisseria meningitidis
MMENGKTVPRWRFALKSAGWHLLISLSVAGLAALLVFKVWYPYPYAELTGGLSLYQLVVAVDIVCGPLLTLILASPKKKTKARMVDFSMVGIIQLAALVYGLHSVSLARPVVEAFEQDRMTIVTAAEVVVEDLHKAPEGLQSLSWFGIRRIALKEPEDADEKNKTLDLSLKGIEPSMRPDQWLPYSDKEAEEIRKHLKPLKVLADARKTTVADILKQAGLAEGEELYYLPFTSSRQKEWIVITDKEGNTKGYAPIDGFIITP

SEQ ID NO: 7704 - protein, 477 aa, Neisseria meningitidis
MNEYSQLIKHPDISLPPVSDGIKVDNPATGETLAFVRKTDSDKLKNLIQKAAAAQKLWAAKTALERADVLWRWYFQIKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALASLAYEAGIPQDLLPVVSGSASEIGHEFATNPIIRKISFTGSTEVGAKIFADSAADIKKLSLELGGNAPFIVFDDADLDKAVEGALASKFRNSGQTCVCTNRVYAQSAIYDEFCRKLSEKAAALKLGNGLEDGVNQGPLIEEKAVEKVEQHIADALAKGASCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 7705 - protein, 164 aa, Neisseria meningitidis
MIFKQNQNYWAVFDANKETLIVQTCSGLGLTAIDHLYPPHILPLDTDNETLGTTVLQALANSRTFVYDSPEDQDFFDTEKIRQRYEDWVAKLCGNLGYKTRRALFKNMMSVDIWLHNGCLKISPSRHVKLEAWNAIDADDVILSLDNSPEEIGAGLKLALSHCR

SEQ ID NO: 7706 - protein, 143 aa, Neisseria meningitidis
MMTADAGICRPFKTKPARTIFGRFPARTVCLCASAIWTAAKSRCGWTAGVPSSLPTLPHPANAIPPNTVCSETQPSGTRKAAKPFSALPMPTAIRSKLPAAPVKRGSLFEPPSRFFGRFFVSDGRFFVSDLFCSSASGRVRAA

SEQ ID NO: 7707 - protein, 29 aa, Neisseria meningitidis
MKQCACRDLCLMPASNSAGMRAHKTLNAE

SEQ ID NO: 7708 - protein, 22 aa, Neisseria meningitidis
MPERRETAEPSAGTGTNRSLND

SEQ ID NO: 7709 - protein, 693 aa, Neisseria meningitidis
MKSLKTFLIWGIVVLVGLASFTTLALSRGEQVSAVWMVTAAISVYCIAYRFYSLYIANRVMRLDPDRLTPAERHNDGLDYVPTHKGVLFGHHFAAIAGAGPLVGPVLAAQMGYLPGTLWIIFGVVFAGAVQDMMVLFVSMRRDGKSLGDIVKQELGTVPGVIASIGILMIMVIIMAVLALIVVKALVHSPWGTFTIAATMPIALFMGIYTRYIRPGKIGEISIVGFILLMLAVIYGEDVAKSSIGHWFDLDGIQLTWAIMIYGFVASVLPVWLLLTPRDYLSTFLKIGTIAALALGIVIVNPALQMPAVTHFIDGSGPVFSGALFPFLFITIACGAVSGFHALISSGTTPKMLENETHVRMIGYGGMLMESFVAIMALAAAASLDPGVYFAMNSPAALIGTDANTAAEVITTKLQFPVDAATLLHTAKEVGENTILSRAGGAPTLAVGMAHIMSRLIPGEAMMAFWYHFALLFEALFILTAVDAGTRVARFMIQDLGSIFYKPFGNTDSIPANLIATFFAVALWGYFLYTGVTDPLGGINSLWPLFGIANQMLAGVALIMCAVVLIKMKRDRYVWVVLVPAVGVLFVTCYAGLQKLFHSDPRISFLAHAGKYSDALAKNEILAPAKDIGEMAQIIFNDKINAGLTILFLSVVVIVAAYGLRTALKARKVGWPTAKEIPAVYRDGKQPEAQSEA

SEQ ID NO: 7710 - protein, 64 aa, Neisseria meningitidis
MKHKLASWWKTIKLTANLMAGVPDYENYVAQQRKHNPNAPVMTKLQFQDYCRKRRCGANGGRCC

SEQ ID NO: 7711 - protein, 64 aa, Neisseria meningitidis
MNPSQYLFIDLNFDKIPDTRLCCFSIFQPTVNLKQPVHAMLQFLFLSADCFDKELKIHFMHLKI

SEQ ID NO: 7712 - protein, 186 aa, Neisseria meningitidis
MKNLIAFNKPYGVICQFSPHEKHKSLKDFINLPGFYPAGRLDTDSEGLLLLTDDGRLQAQITDPKFKHPKTYWAQLEGVPDESRLESLRKGIDLGGFVTRPASIRILKHGEADSLWERIPPIRVRKTVPDFWIEITISEGKNRQVRRMTAKAGYPCLRLIRVASGRLKLFDLDLKPGEWAYAPFKP

SEQ ID NO: 7713 - protein, 921 aa, Neisseria meningitidis
MRSSFRLKPICFYLMGVTLYHYSYAEDAGRAGSEAQIQVLEDVHVKAKRVPKDKKVFTDARAVSTRQDIFKSSENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRSVAQNYRVGGGGQHIGNFGAEYLERRKQRYFVQEGALKFNSDSGKWERDLQRQQWKYKPYKNYNNQELQKYIEEHDKSWRENLAPQYDITPIDPSSLKQQSAGNLFKLEYDGVFNKYTAQFRDLNTKIGSRKIINRNYQFNYGLSLNPYTNLNLTAAYNSGRQKYPKGSKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNTVGYRFGGEYTGYYGSDDEFKRAFGENSPTYKKHCNRSCGIYEPVLKKYGKKRANNHSVSISADFGDYFMPFASYSRTHRMPNIQEMYFSQIGDSGVHTALKPERANTWQFGFNTYKKGLLKQDDTLGLKLVGYRSRIDNYIHNVYGKWWDLNGDIPSWVSSTGLAYTIQHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 7714 - protein, 405 aa, Neisseria meningitidis
MALIVHKYGGTSVGSPERIKNVAKRVAKARAEGHDIVVVVSAMSGETNRLVALAHEMQEHPDPRELDVVLATGEQVTIGLLAMALKDIGVDAKSYTGWQVALKTDTAHTKARIESIDDEKMRADLTAGKVVIVAGFQGISSEGDISTLGRGGSDTSAVALAAALKADECQIYTDVDGVYTTDPRVVPEARRMDTVTFEEMIELASLGSKVLQIRSVEFAGKYKVRLRVLSSLQDGGNGTLITFEEDDNMERAAVTGIAFDKNQARINVRGVPDKPGVAYQILGAVADANIEVDMIIQNVGSEGTTDFSFTVPRGDYKQTLEILSERQDSIGAASIDGDDTVCKVSAVGLGMRSHVGVAAKIFRTLAEEGINIQMISTSEIKVSVLIDEKYMELATRVLHKAFNLG

SEQ ID NO: 7715 - protein, 242 aa, Neisseria meningitidis
MPDYIRISRAADSLRDIKITPHFLPHTDGSCLIECGNTKVICTASIDENVPPFLRGKNQGWVTAEYGMLPASTASRMLREASAGKQSGRTQEIQRLIGRSLRAVVDMEKLGERQILIDCDVIQADGGTRTASITGAFVALQIAVGKLVSDGILSENPIREAVAAVSVGVVNGVPLLDLDYPEDSGCDSDVNIVMTASGKIIEIQGTAEDAPFSLDELGKLVALAQKGIGELLQHQQNALSAA

SEQ ID NO: 7716 - protein, 154 aa, Neisseria meningitidis
MYKHLVVAVDGSETSINALKHAAELAGVNGARLTLVHVANPAEYMALAPEFLQHESYEAAAVAQGNEVLDAAERTAQELGVENTVKHLLVANKGAREMAQDLVDYADENGADLLVLGTHGRTGLMHLLMGSFAETVMRQSHLPLLIIRSKAEEA

SEQ ID NO: 7717 - protein, 258 aa, Neisseria meningitidis
MSDNALTSSRRFGGIARLYGDSALAHFSQAHVCVVGVGGVGSWAVEALARTGIGRLTLIDLDNVAESNVNRQLHALTGDFGKAKVTALRERITQINPQCEVFEIEDFVTEDNLPEYFGKGFDFVIDAIDQVRVKAAMAAYFVERKQPFVLSGGAGGQKNPALIQTADLSRVTHDPLLANLRYTLRKRYGFSRDTKANMRVPCVYSTENIVPPQSREACSADAAPQGLSCAGYGASMLVTASFGLYCAQAAVEHIADKK

SEQ ID NO: 7718 - protein, 175 aa, Neisseria meningitidis
MEFVNNLVIFSFLLLMLIPIFFVVYGIYHKIRYRKICILRTSFILLVVILCSMYYIYCRYLDQQKVAYYCIDEQCISIVHLYKDYGINSPTYARIYAGKILFRFQVRAKNYAELLMEDDISISKKILGNKFIIYGSLPVIYGNVDNIEVKEATGYIDRSSTDYIVSRNLKFRHLY

SEQ ID NO: 7719 - protein, 69 aa, Neisseria meningitidis
MPSEHLPDHIIRECRQIVFFCKLILKSTYRFTPCRPSLPHLHHPSTLSHGYSANPLPICPRICLFRPMH

SEQ ID NO: 7720 - protein, 284 aa, Neisseria meningitidis
MPPIPAPSAPSEHTVAWVFGQPVTDLPQDLFIPPDALKVVLGSFQGPLDLLLYLIRKQNIDVLDIPMVKITEQYLHYIAQIETYQFDLAAEYLLMAAMLIEIKSRLLLPRTETVEDEEADPRAELVRRLLAYEQMKLAAQGLDALPRAGRDFAWAYLPLEIAVEAKLPEVYITDLTQAWLGILSRAKHTRSHEVIKETISVRAQMTAILRRLNGHGICRFHDLFNPKQGAAYVVVNFIALLELAKEGLVRIVQEDGFGEIRISLNHEGAHSDGISGTRGGRDVF

SEQ ID NO: 7721 - protein, 402 aa, Neisseria meningitidis
MTGIIHSLLDTDLYKFTMLQVVLHQFPQTHSLYEFRCRNASTVYPLADIREDLEAELDALCQLRFTHDELGYLRSLRFIKSDFVDYLELFQLQRRFVEIGTDDKDRLNIRIEGPMIQAMFFEIFILAIVNELYFRRLETPAVIEEGERRLQAKAARLKEIAAAQNPDEPPFLISDFGTRRRYKLAWQEHVIRTLLEAAPGIVRGTSNVFLAKKLGITPIGTMAHEFLQAFQALDVRLRNFQKAALESWVHEYRGDLGVALTDVVGMDAFLRDFDLYFAKLFDGLRHDSGDPYVWGDKAYAHYQKLKIDSRTKMLTFSDGLDIERSWALHQYFKDRFKTGFGIGTNLTNDMGHTPLNIVLKLVECNGQSVAKLSDSPGKTMTNNSTFLAYLRQVFDVPEPETP

SEQ ID NO: 7722 - protein, 572 aa, Neisseria meningitidis
MNLHQTVEHEAAAAFAAAGIADSPIVLQPTKNAEHGDFQINGVMGAAKKAKQNPRELAQKVAEALADNAVIESAEVAGPGFINLRLRPEFLAQNIQTALNDARFGVAKTDKPQTVVIDYSSPNLAKEMHVGHLRSSIIGDSISRVLAFMGNTVIRQNHVGDWGTQFGMLVAYLVEQQKDNAAFELADLEQFYRAAKVRFDEDPAFADTAREYVVKLQGGDETVLALWKQFVDISLSHAQAVYDTLGLKLRPEDVAGESKYNDDLQPVVDDLVQKGLAVEDDGAKVVFLDEFKNKEGEPAAFIVQKQGGGFLYASTDLACLRYRIGRLKADRLLYVVDHRQALHFEQLFTTSRKAGYLPENVGAAFIGFGTMMGKDGKPFKTRSGDTVKLVDLLTEAVERATALVKEKNPELGADEAAKIGKTVGIGAVKYADLSKNRTSDYVFDWDAMLSFEGNTAPYLQYAYTRVQSVFRKAGEWDANAPTVLTEPLEKQLAAELLKFEDVLQSVADTAYPHYLAAYLYQIATLFSRFYEACPILKAEGASRNSRLQLAKLTGDTLKQGLDLLGIDVLDVM

SEQ ID NO: 7723 - protein, 119 aa, Neisseria meningitidis
MRNKQTPSKQASKQASKQASKQKIITPFLPTHALSARRIPLFPPLKSAFSSGRVSARLFSLFSFPRHACAPPAALCCTFAPGRHRSAIRFSVLHTPVSERNADVSTHRTTHKAPPYVLP

SEQ ID NO: 7724 - protein, 485 aa, Neisseria meningitidis
MSEWRSFNRKGNTMNIHTLLSKQWTLPPFLPKRLLLSLLILLAPNAVFWVLALLTATARPIVNLDYLPAALLIALPWRFVKIAGVLAFWLAVLFDGLMMVIQLFPFMDLIGAINLVPFILTAPAPYQIMTGLLLLYMLAMPFVLQKAAAKTDFRHIAVCAAVVAAAGYFTGHLSYYDRGRMANIFGANNFYYAKSQAMLYTVSQNADFITAGLVDPVFLPLGNQQRAATHLNEPKSQKILFIVAESWGLPANPELQNATFAKLLAQKDRFSVWESGSFPFIGATVEGEMRELCAYGGLRGFALRRAPDEKFARCLPNRLKQEGYATFAMHGAGSSLYDRFSWYPRAGFQEIKTAENLIGKKTCAIFGGVCDSELFGEVSAFFKKHDKGLFYWMTLTSHADYPESDIFNHRLKCTEYGLPAETDLCRNFSLHTQFFDQLADLIQRPEMKGTEVIIVGDHPPPVGNLNETFRYLKQGHVAWLNFKIK

SEQ ID NO: 7725 - protein, 248 aa, Neisseria meningitidis; identical to SEQ ID NO: 838

SEQ ID NO: 7726 - protein, 233 aa, Neisseria meningitidis; identical to SEQ ID NO: 3980

SEQ ID NO: 7727 - protein, 223 aa, Neisseria meningitidis
MTTQDELKRIAAEKAVEFVPENEYIGIGTGSTINFFIEALGKSGKKIKGAVSTSKKSGELLAQYDIPVVSLNEVSGLAVYIDGADEVNHALQMIKGGGGAHLNEKIVASASEKFICIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 7728 - protein, 160 aa, Neisseria meningitidis
MTNIRIGQGYDVHQLTEGRKLILGGVEIPFEKGLLGHSDADALLHAVTDALLGAAGLGDIGSHFPDTAAEFKDADSRVLLRAAYQSVQAQGWQAVNVDTTVIAQKPKLAPHIPQMRANIAADLGIDISCVNIKGKTNEKLGYLGRMEGIEAQAAVLLVRI

SEQ ID NO: 7729 - protein, 229 aa, Neisseria meningitidis
MKRKNIALIPAAGIGARFGADKPKQYVEIGSKTVLEHTIGIFERHEAVDLTVVVVSPEDTFADKVQTAFPQVRVWKNGGQTRAETVRNGVAKLLETGLAAETDNILVHDAARCCLPSEALTRLIEQAGNAAEGGILAIPIADTLKCADGGNISATVERTSLWQAQTPQLFRAGLLHRALAAENLDGITDEASAVEKLGVRPLLIQGDVRNLKLTQPQDAYIVRLLLDAV

SEQ ID NO: 7730 - protein, 244 aa, Neisseria meningitidis
MTTRQIILDTETTGLYADGGDRLVEFAGLEMVNRQMTDKNLHLYVHPERDMPEEAARVHGLTIQVLEGKNAPPFAEVGRQIADFLRGAELIIHNAKFDVGFLNMEFRRMGLPTVEELGCTVTDTLAMAREMFPGQKASLDALCNRFSVDRSKRVLHGALIDCELLGEVYLAMTRRQFDLMGAAAEEKMETKPVVHTETKRSGKLKVIRADENELAAHGQYLDGLGEACIWRKEAVPSENGGTDA

SEQ ID NO: 7731 - protein, 436 aa, Neisseria meningitidis
MYAKKGGLGLVKSRRFAPLFATQFLGAFNDNVFKTALFVMIGFYGLGQNGFLPAGQMLNLGALLFILPYFLFSSLSGQLGNKFDKAVLARWVKVLEMIIMAVAAYGFYIRSAPLLLACLFCMGAQSTLFGPLKYAILPDYLDDKELMMGNSLIESGTFVAILFGQILGTAVAGVPPYIVGILVLLVAVGGTVGSLFMPSVPAKAADTQIEWNIVRGTKSLLRETVRHKPVFTAIIGISWFWFVGAVYTTQLPTFTQIHLGGNDNVFNLMLALFSIGIAAGSVLCAKFSRERLMLAWVTVGALGLTVCGLVLVWLTHGHRFEGLNGIFWFLSQGWAYPVMAVMTLIGFFGGFFSVPLYTWLQTASSETFRARAVAANNIVNGIFMVSAAVLSAVLLFLFDSISLLYLIVALGNIPLSVFLIKRERRFLGAAAIRKKP

SEQ ID NO: 7732 - protein, 62 aa, Neisseria meningitidis
MMESMFILVPISIILAFVIGWFFWWSGKNGQFDDLEGPAHRILMDDDSTSKLIEKERENDVR

SEQ ID NO: 7733 - protein, 99 aa, Neisseria meningitidis
MHYFSIHDQSGRHIGFFILLADDESEARPQSGRFAVKLEGGMENHVLSPFGQTEIPQYWRVVKDRIELFFDEAPVGTLRNEYLTVSGQTFVLNDLTGNM

SEQ ID NO: 7734 - protein, 398 aa, Neisseria meningitidis
MSQKLILVLNCGSSSLKGAVLDNGSGEVLLSCLAEKLNLPDAYITFKVNGEKHKVDLSAHPDHTGAVEALMEELKAHGLDSRIGAIGHRVVSGGELYSESILVDDEVIAGIEKCIPLAPLHNPAHLLGLRAAQSIFKGLPNVVVFDTSFHQTMPEVAYKYAVPQELYEKYGLRRYGAHGTSYRFVADETARFLGKDKKDLRMVIAHLGNGASITAVANGESRDTSMGLTPLEGLVMGTRSGDIDPSVFGFLAENANMTIAQITEMLNKKSGLLGISGLSNDCRTIEEEAAKGHKGAKLALDMFIYRLAKYIGSMAVAAGGLDALVFTGGIGENSDIIRERVIGYLGFLGLNIDQEANLKARFGNAGVITTADSKAVAVVIPTNEELMIAHDTARLSGL

SEQ ID NO: 7735 - protein, 601 aa, Neisseria meningitidis
MKKLICLFAVFLMLCGRAFALDANDLLPPEKAFVPELAVADDGVNVRFRIADGYYMYQAKIVGKTDPADLLGQPSFSKGEEKEDEFFGRQTVYHHEAQVAFPYAKAVGEPYKLVLTYQGCAEAGVCYPPVDTEFDIFGNGTYHPQTDEPASAKDRFLQPSSQNGSGALPPPKGDEGGDSRFKLSWDTLNANLLAFFLAGLGLSFTACMYPLLPIVSSIVVGDKKAGKARAFVLSVVYVQGLALTYTLVGIVAGLTGALLTVWLQQAWVVLAASALMVVLALSMFGLFNIQLPNAVQSYFQNQSSRLSGGKIVSVFIMGILSALIVGPCVAPPLAFALGYIGQTGDAVLGGLALYTLALGTGVPLIAIGTFGGHILPKAGDWMNAVKYAFGFILLAVAVYLATPHLPYYLVVALYTLLMLVPAFMLLVNGRRQKRRPKAVAFALGGILLIGGAWFGWQGANGKTTALHHFLTLNPPAEAGKSSEHGKMFADTAALKAAMDTALKEHPDKPVVLDFYADWCISCKEMAAYTLNQPEVHQAVDMERFFQIDVTANTPEHQALLKEYGLFGPPGVFVVRSDGSRSEPLLGFVKADKFIEWYEQNR

SEQ ID NO: 7736 - protein, 173 aa, Neisseria meningitidis
MRVQSGLIFCTQADEFAQSGHVEIDIQTGAVALRRPQCFRQCLHHFVFGFQPAAFGAQGVVDCAYAVRLVYARLFLDGQMQRHMQEGVAFAVFGQPVGVQMVFDAFEITVVFGMGFDNAEGFLFQCAQLQRIEPLLPHAGEKAADIVGIDIVHGGFDKMFMEIGSDNGGFYIN

SEQ ID NO: 7737 - protein, 275 aa, Neisseria meningitidis
MDGEGMSVGHYENFPVGSLILPRRLRKPVHAVYAFARTADDMADEGSMPSEARLAGLEGLQRELDVLASGGRSAHPLIARLDAEAVVPFGLDLQPFYDLLSAFSQDVVKTRYGNFGELADYCRRSANPVGRIMLALYGKTDAVCVAQSDGICTALQLVNFWQDVAVDWQKGRVYIPQDDLLKFGVSEEQIAAGRADAAFQRLMAYECRRAFRMLKAGSPLARELNGRIGLELRMIVLGAQLILQKLDACRYDVFAQRPVLDKKDWLIMLKKALWK

SEQ ID NO: 7738 - protein, 160 aa, Neisseria meningitidis
MAIVKNSVVSLHYEMYDANNQLLDKTEEPIAYLHGGYDGIFPLVEEALHGKDAGDTVDVALSPDDAFGEQDPELVRIEDAGVFPVEVEVGMMFEADDPETGDVVVYRVTDVADGKAVVDGNHPLAGMKIRFKATVESVRDASDEEIAHGHVHGPHGHHHH

SEQ ID NO: 7739 - protein, 98 aa, Neisseria meningitidis
MKKSLFAAALLSLVLAACGGEKAAEAPAAEAPAAEAPATEAPAAEAPAAEAPAAEAPAAEAAATEAPAAEAAATEAPAAEAAATEAPAAEAPAAEAAK

SEQ ID NO: 7740 - protein, 455 aa, Neisseria meningitidis
MLDLHTEFSRLLPADEIAEPSPTLLKDQRNRFTSAPDIILQPLSVKSVQTIMRFCHQHRIPVTPQGGNTGLCGAAVSENGVLLNLSKLNRIRSINLSDNCITVEAGSVLQTVQQAAEASNRLFPLSLASEGSCQIGGNIACNAGGLNVLRYGTMRDLVIGLEVVLPNGELVSHLHPLHKNTTGYDLRHLFIGSEGTLGIITAATLKLFANPLDKATAWVGIPDIESAVRLLTETQAHFAERLCSFELIGRFAAELSSEFSKLPLPTHSEWHILLELTDSLPDSNLDDRLVEFLYKKGFTDSVLAQSEQERIHMWALRENISASQRKLGTSIKHDIAVPIGRVADFVRRCAKDLEQNFKGIQIVCFGHLGDGSLHYNTFLPEILSNEVYRYENDINSTVYRNVLACNGTIAAEHGIGIIKKQWLDKVRTPAEIALMKSIKQHLDPYNIMNPGKLLP

SEQ ID NO: 7741 - skipped

SEQ ID NO: 7742 - protein, 148 aa, Neisseria meningitidis
MAIANNKKAFHDFFIEDRIEAGLVLEGWEVKAIRAARVQLKESYIYWKKDAFYLVGCHITALPTASTHIKPDAVRPRKLLLNQSEINKLIGKTERAGYTIVPLDLHFSRGKIKMEIGLAKGKKQHDKRQSMKEADWKREKQRLIKHTR

SEQ ID NO: 7743 - protein, 336 aa, Neisseria meningitidis
MSIKILIISPSWIGDCVMTQPLFRRLKELHPGCTIDVFAPKWSMAVFERMPEVNEILENSFGHGALELKRRWRVGRDLGRRGYDQVIVLPGSLKSAIIALATGIGKRTGYVGESRYFLLNDIRRLDKERLPLMVDRYTALAHPSQEDFDGHSGFPEFSIDERRREISVETFGLDIGKPVLAFCPGAEFGPAKRWPTRHFAELGKHYLAAGWQVWLFGSQKDDEIAEEINRLSDGMCVNLCGKTDLSQAMDLLSLADTVVCNDSGLMHLAAALGRKVVAVYGSSSPTHTPPLSDRAKIVSLHLECSPCFKRECPLGHTDCLNRLYPEKIVQAVEEAV

SEQ ID NO: 7744 - protein, 269 aa, Neisseria meningitidis
MAKIGDFAVKSMIGIRSKQMITLPSLNNLPSKWDEIRHWLESRVFECGVMPHPNLTECEAKQFERDFWDNIGCAPEEYVRIRRAIRLLEARYPDSLNELVCAAIATPLGEMLAVFGSRGLCLLEFVGQKHLEQEIAAVQKALRGRFVFREDERTQLLRQELDLYFKGRLKTFATPLEQIGTEFQKQAWDALLAIPYGETRSYKEQAQRLGNPKAVRAVAAANGQNKVSILIPCHRVIGSDGKLTGYAGGLNRKQFLLALEHGEVQTALF

SEQ ID NO: 7745 - protein, 271 aa, Neisseria meningitidis
MTAYNESTYSSSKGIIYANPHPLRRTAGFFNRCLCRGRIHAAIRQPVRRRRLHAKPAFERALRLLLFRRQCFARAVVEKSARRDKSFVLTVYDKDAPTGLGWMHRVVADIPADVHRRNATSLQLSRCANIADRTGLDALGGRRHSRRCPPPQRGLAAIKPLRQHRRRPVRSHIGGNQFADLPHQVDAFVHGKTDAVMLQPRQHAAKRGLRSIVRHFFIRQYRSLIIKRRAHTPGIRQLYRIAHCLRRPVLCGEPFYGFLFESNPLRLIEAV

SEQ ID NO: 7746 - protein, 381 aa, Neisseria meningitidis
MTETQSLELAKELISRPSVTPDDRDCQKLLAERLHKIGFAAEELHFGDTKNIWLRRGTKAPVVCFAGHTDVVPTGPVEKWDSPPFEPAERDGRLYGRGAADMKTSIACFVTACERFVAKHPNHQGSIALLITSDEEGDALDGTTKVVDVLKARDELIDYCIVGEPTAVDKLGDMIKNGRRGSLSGNLTVKGKQGHIAYPHLAINPVHTFAPALLELTQEVWDEGNEYFPPTSFQISNINGGTGATNVIPGELNVKFNFRFSTESTEAGLKQRVHAILDKHGVQYDLQWSCSGQPFLTQAGKLTDVARAAIAETCGIEAELSTTGGTSDGRFIKAIAQELIELGPSNATIHQINENVRLNDIPKLSAVYEGILARLLAGNAV

SEQ ID NO: 7747 - protein, 206 aa, Neisseria meningitidis
MLTPKSCDLFNIPFFQFSQLKKYQPESIPQIKADYKENWQIWQQLIQQVAAELGAPFAPPHIERWCNGWQVRAHFFAYFKYEQYKNSAAILSILLNRRRLSVSLDWHCYKADVSPIALPDYNRWLDNFDTEKYASFDMWHGAESEYDDYRTVAQQNESDRKLQNDEDFFCIGKHIERDDLGRQDVAKWIAETVEDLLPLYEACHGK

SEQ ID NO: 7748 - protein, 169 aa, Neisseria meningitidis
MNPFETKSVTFAEPIEMLYACHGKVRRFCGQVAMLSDYIAENGCNQIVLQTIRQIAQYFNVAAPLHHEDEEENFFPLLLQYAPQAQESVDELLRQHIGLHDNWAAVSAEFAKLEADNAYVPDEEAFKRFVAGYDVHLAIEEPLFDMGNTFIPKEKLTEIGEIMAARRRK

SEQ ID NO: 7749 - protein, 183 aa, Neisseria meningitidis
MKAYLALISAAVIGLAACSQEPAAPAAEATPAAEAPASEAPAAEAAPADAAEAPAAGNCAATVESNDNMQFNTKDIQVSKACKEFTITLKHTGTQPKASMGHNLVIAKAEDMDGVFKDGVGAADTDYVKPDDARVVAHTKLIGGGEEASLTLDPAKLADGEYKFACTFPGHGALMNGKVTLVD

SEQ ID NO: 7750 - protein, 46 aa, Neisseria meningitidis
MKFVAKCRSETSVCATRRNLFQGFVNGGCTLISVKPNIILSIGDLL

SEQ ID NO: 7751 - protein, 157 aa, Neisseria meningitidis
MFTQIPVYILCAMPSNQVCQCLRQFGMPFFQLCRRRTETLQRSLTQMQGIGFRRFFRFRDQPDRNRAYRSIKPCQLRQYRRCNHFQARCRHIVCRQKDKPAVFDTCRLKMRVQVGRQQFFHGGIQPPPLSRLFQKSGKQRVPPAQLFQIHKTYTQKD

SEQ ID NO: 7752 - protein, 916 aa, Neisseria meningitidis
MLTNIAKKIFGSRNDRLLKQYRKSVARINALEEQMQALSDADLQAKTAEFKQRLADGQTLDGILPEAFAVCREASRRTLGMRHFDVQLIGGMVLHDGKIAEMRTGEGKTLVATLAVYLNALAGKGVHVVTVNDYLASRDAGIMEPLYNFLGLTVGVIISDMQPFDRQNAYAADITYGTNNEFGFDYLRDNMVTDQYDKVQRELNFAVVDEVDSILIDEARTPLIISGQADDNIQLYQIMNTVPPHLVRQETEEGEGDYWVDEKAHQVILSEAGHEHAEQILTQMGLLAENDSLYSAANIALMHHLMAALRAHSLFHKDQHYVIQDGEIVIVDEFTGRLMSGRRWSEGLHQAVEAKEGVEIKRENQTLASITFQNYFRLYTKLSGMTGTADTEAFEFQSIYNLETVIIPTNRPVQRKDFNDQIFRSAEEKFEAVVKDIEECHKRGQPVLVGTTSIENSELVSKLLTQAGLPHNVLNAKEHEREALIVAQAGKVGAITVATNMAGRGTDIVLGGNLKHQTDAIRADETLSDEEKQAQIAALEDGWQAEHDKVMEAGGLHIIGTERHESRRIDNQLRGRSGRQGDPGSSRFYLSFEDPLLRLFALDRAAAILNRLAPERGVAIEHNLLTRQIEGAQRKVEGRNFDMRKQVLEYDDVANEQRKVIYSQRNEILTSKDISDLMQEIRSDVVSDLVDTYMPPDSMEEQWDIPTLENRLAAEFRLHEDIQSWLKADNAIDGQDIKERLIERIENEYAAKTELVGKQAMADFERNVMLQVIDNQWREHLAAMDYLRQGIHLRSYAQKNPKQEYKREAFTMFQDLWNGIKFHIASLLTSVQIEQNPVAVVEEQPIGNIQSIHSESPDMEELLGQSQTDLVTEAFNPDGTDFSPEALEARGQIVHRNDPCPCGSGLKYKQCHGKLA

SEQ ID NO: 7753 - protein, 590 aa, Neisseria meningitidis
MIPSDFIDELLAKTDIVDIIDEQVPLKKGGANYMACCPFHKEKTPSFSVSPTKQFYHCFSCGAHGSAIGFVMEHQGLSFPEAVQFLADRVGMVVPKVHGQNDNPEVRAERKKKQQTLEETTAAAADFYAQQLKFNPAAKAYLDKRGLSAEVIAHYGLGYAPDGWQPLTQVFQPYPNTALVDTGMVIDNEGRHYDRFRHRIMFPIRNPRGQVIGFGGRVLDDSKPKYLNSPDTPLFDKGKNLYGLYEGRAAVKEAGRILVVEGYMDVVALAQFGVGYGVAALGTATTAEHVKILMRQADSIYFCFDGDSAGRKAAWRALENALPQLKDDKSLHFLFLPEEHDPDSYIRAYGKAQFEDALLNQSKPLSEYFWEHLSDGIHLNTQEGKAELVKTSSPLLAQITAPALAYLLKQRLSELVGIDPDNLAQLLGQEAPKRHVKQKNYKLPPISVKQPVMLTLVQRQIRSLLINPDWAAYIDLPDYLALDGDFACLANLAESIKNHAAVPETAQVLEYMRGSPYEETITRIFHSTHQSEEMNSSSEEDCENFQIGMKKLLNELKYSQIETLKQKSLQSGLNESEKKLLLSLLTAKQN

SEQ ID NO: 7754 - protein, 642 aa, Neisseria meningitidis
MSRNQNHEEYQDDTRPLSIEEQRARLRQLIIMGKERGYITYSEINDALPDDMSDADQIDNIVSMISGLGIQVTEHAPDAEDILLSDNAAVTDDDAVEEAEAALSSADSEFGRTTDPVRMYMREMGQVDLLTREDEIIIAKKIENALKNMVQAISACPGSIAEILELIEKIRKDEIRVDEVVEAIIDPNEVLLNELGLGHLETTAPEKPSNDNSDENEDDEESEEDADEISAANLAELKQKVIGHFAQIEKDYKKMIGRLEKHHSRHKDYLAYRDAIANKLLEVRFATRQIDSLSSSLRGKVENIRKLEREIRDICLDRVHMERDYFIQNFLPEITNLEWIEEEIAKGRVWSDALDRFRHAILEKQTELADMEKETRISIEELKEINKNMVSSEKETAAAKQEMIQANLRLVISIAKKYTNRGLQFLDLIQEGNIGLMKAVDKFEYRRGYKFSTYATWWIRQAITRSIADQARTIRIPVHMIETINKMNRISRQHLQETGEEPDSAKLAELMQMPEDKIRKIMKIAKEPISMETPIGDDDDSHLGDFIEDANNVAPADAAMYTSLHEVTKEILESLTPREAKVLRMRFGIDMNTDHTLEEVGRQFDVTRERIRQIEAKALRKLRHPTRSDRLRSFLDSEDSKL

SEQ ID NO: 7755 - protein, 335 aa, Neisseria meningitidis
MSTFFQQTAQAMIAKHIDRFPLLKLDQVIDWQPIEQYLNRQRTRYLRDHRGRPAYPLLSMFKAVLLGQWHSLSDPELEHSLITRIDFNLFCRFDELSIPDYSTLCRYRNWLAQDDTLSELLELINCQLTEKGLKVEKASAAVVDATIIQTAGSKQRQAIEVDEEGQVSGQTTPSKDSDARWIKKNGLYKLGYKQHTRTDAEGYIEKLHITPANAHECKHLSPLLEGLPEGTTVYADKGYDSAENRQHLEEHQLQDGIMRKACRNRPLSEVQTKRNRYLSKTRYVVEQSFGTLHRKFRYARAAYFGLIKVSVQSHLKAMCLNLLKAANRLSAPVAA

SEQ ID NO: 7756 - protein, 943 aa, Neisseria meningitidis
MNKKHGFPLTLTALAIATAFPAYAAQAGGATPDAAQTQSLKEITVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSWGIQAKTAYGSKNRQFMKSLGAGFSKDGWEGLLIRTERQGRETRPHGDIADGVEYGIDRLDAFRQTYDIKRKTREPFFSVEGERESKPVAKLAGYGKYLNNQLNRWVKERIEQNQPLSAEEEAQVREAQARHENLSAQAYTGGGRILPDPMDYRSGSWLAKLGYRFGGRHYVGGVFEDTKQRYDIRDMTEKQYYGTDEAEKFRDKSGVYDGDDFRDGLYFVPNIEEWKGDKNLVRGIGLKYSRTKFIDEHHRRRRMGLLYRYENEAYSDNWADKAVLSFDKQGVATDNNTLKLNCAVYPAVDKSCRASADKPYSYDSSDRFHYREQHNVLNASFEKSLKNKWTKHHLTLGFGYDASKAISRPEQLSHNAARISESTGFDENNQDKYLLGKPEVVEGSVCGYIETLRSRKCVPRKINGSNIHISLNDRFSIGKYFDFSLGGRYDRKNFTTSEELVRSGRYVDRSWNSGILFKPNRHFSVSYRASSGFRTPSFQELFGIDIYHDYPKGWQRPALKSEKAANREIGLQWKGDFGFLEISSFRNRYTDMIAVADHKTKLPNQAGQLTEIDIRDYYNAQNMSLQGVNILGKIDWNGVYGKLPEGLYTTLAYNRIKPKSVSNRPGLSLRSYALDAVQPSRYVLGFGYDQPEGKWGANIMLTYSKGKNPDELAYLAGDQKRYSTKRASSSWSTADVSAYLNLKKRLTLRAAIYNIGNYRYVTWESLRQTAESTANRHGGDSNYGRYAAPGRNFSLALEMKF

SEQ ID NO: 7757 - protein, 737 aa, Neisseria meningitidis
MCKPNYGGIVLLPLLLASCIGGNFGVQPVVESTPTAYPVTFKSKDVPTPPPAGSSVETTPVNRPAVGAAMRLPRRNIASYKQDGTEIPDKHQAEEHLPLKEKDILFLDGTLKEQADKLKKKINERYSDVRVITSKKEEEKYQYQFVRAGYVFTRAEGKDNEKEKTSDGKEFVNRFSYDGFVYYSGERPSQSLPSAGTVQYSGNWQYMTDAKRHRTGKAVSSTDLGYTTYYGNEIGATSYEARDADDREKHPAEYTVDFDNKTLNGKLIKNQYVQNKSNPNEPKKPLTIYDITATLDGNRFTGSAKVSTEVKTQHADKEYLFFHTDADQRLEGGFFGDNGEELAGRFISNDNSVFGVFAGKQKTETENAADTKPALSSGKHTKILDSLKISVDEASDKNPREFAISSMPDFGHPDKLLVEGREIPLVNKEQTIELADGRKTTIRTCCDFLTYVKIGRMQTERPAAKPKAQDEERDEEDTGVDSVEEGEDEIDDEEGTEDAAVKDEGSEEDEAVEGEDEAEEPEEESPTEEGGSGSDGILPAPEAPKGRNIDLFLKGIRTAETDIPKTGEAHYTGTWEARIGKPIQWDNQADKEAAKAVFTVDFGKKSISGTLTEENGVEPAFHIENGKIEGNGFYATARTRENGINLSGNGSTDPKTFQASNLRVEGGFYGPQAEELGGIIFNNDGKSLGITEGTENKVDVEAEVDAEVDVGKQLESEVKHQFGVVFGAKKDMQEVEK

SEQ ID NO: 7758 - protein, 73 aa, Neisseria meningitidis
MSAVNVIFSCSYWRIFKKSDSCVLCFYQFRHGEPHKLINQENFSKLYQAFDYIDSVGSNFPVIITTDGCGLFC

SEQ ID NO: 7759 - protein, 404 aa, Neisseria meningitidis
MSEVEYFSHFISDGKGKLLEIPQRRGKQDGVFVDWISFTFHEDTLLKVSGCPLFSDAEYMYVLSRKLEEILGFGITRKCKSRGNKFYESMYRLGSDDVDYGEVHFGGQRNTVLVELKGTGCSVASPGWELRLKQFLDDSIRTRITRIDLALDFFDGEYTPDQALLDHDNGFFDNSNQRPKSETIGTAWRNEDGSGKTFYVGRKKNSRFVRVYEKGRQLGDKESKWVRFEIQFNYGDIEIPLDILINQGSYFCGAFPICRKFKNMPVPERFDQRKKKLNLTFEHKLHYAKNAVGKLVNFMIEMGFDNSEIVESLKADSGFPKGLEPEKYALEMLRDGLKHGFIHEQPDIDLEIELDELGVIAFKNSDKFDREKRLFSPDYDVEKERKYQEYLSKVYHQNVDYDYF

SEQ ID NO: 7760 - protein, 103 aa, Neisseria meningitidis
MFNQTQTVTYPATFLGAKKFKGEIDGSNIDTCSVLVATPLPAQSGNAVGFTAAQMKFGDSKNFSKLENLKYPCEVMVTVEMTSTGKGMVPSLIDFQVAEKPKG

SEQ ID NO: 7761 - protein, 66 aa, Neisseria meningitidis
MKFEERFIVQDLETHDFIYPDPFGDVGFTQNIKSAGQFESYEDALNSGINEIGGGFQIFQFFVKSE

SEQ ID NO: 7762 - protein, 94 aa, Neisseria meningitidis
MKQVKKSSYFKYQKRKKTMNIVKKYAVKAALAAGIFTPAIVMADTFDPSAIGTQVANVIMGFVSMVSAVGMAAITVILAIQGFKMAWSMIKSVK

SEQ ID NO: 7763 - protein, 100 aa, Neisseria meningitidis
MGYRVGINCFDTRLQADDYLLSSLPPTVTQDGKIIRPERVGDKWILNGKPVTLSYPECSNFEQIKQGSYVGSTVLILFVVIYGFRLLINFLKDIGKVGTD

SEQ ID NO: 7764 - protein, 548 aa, Neisseria meningitidis
MKQNVMFIILGRNFLKIILCFSFFVSKFALASVNAPGKFDRVEVYDDGRYLGIRGSDDKRRRIWKGVFDRESGRYLTSEAQDLKVRHVSTGASSTGKVSSVVSSSVSRAGVLAGVGKLARLGAKLSTRAVPYVGTALLAHDVYETFKEDIQAQGYQYDPETDKFVKGYEYSNCLWYEDKRRINRTYGCYGVDSSIMRLMSDDSRFPEVKELMESQMYRLARPFWNWHKEELNKLSSLDWNNFVLNSCTFDWNGGDCVVNKGDDFRNGADFSLIRNSKYKEEMDAKKLEEILSLKVDANPDKYIKATGYPGYSEKVEVAPGTKVNMGPVTDRNGNPVQVVATFGRDSQGNTTVDVQVIPRPDLTPGSAEAPNAQPLPEVSPAENPANNPNPNENPGTSPNPEPDPDLNPDANPDTDGQPGTRPDSPAVPGRTNGRDGKDGKDGKDGGLLCKFFPDILACDRLPESNPAEDLNLPSETVNVEFQKSGIFQDSAQCPAPVTFTVTVLDSSRQFAFSFENACTIAERLRYMLLALAWAVAAFFCIRTVSREV

SEQ ID NO: 7765 - protein, 50 aa, Neisseria meningitidis
MSQIAEKRGGIGDKREGGVPTAPPRRECGAKSFRLRNICLMRQPCLLRKG

SEQ ID NO: 7766 - protein, 94 aa, Neisseria meningitidis
MKLLAALIPLLMSVAGRILTALGLMAVTYSGVDRLVAHFQQAITNSITGAPQAMLQLFYISGGGTVLNILFGAIAFILSFKQMTKLATSIGKKK

SEQ ID NO: 7767 - protein, 367 aa, Neisseria meningitidis
MAEICLITGTPGSGKTLKMVSMMANDEMFKPDENGIRRKVFTNIKGLKIPHTYIETDAKKLPKSTDEQLSAHDMYEWIKKPENIGSIVIVDEAQDVWPARSAGSKIPENVQWLNTHRHQGIDIFVLTQGPKLLDQNLRTLVRKHYHIASNKMGMRTLLEWKICADDPVKMASSAFSSIYTLDKKVYDLYESAEVHTVNKVKRSKWFYTLPVIVLLIPVFVGLSYKMLSSYGKKQEEPAAQESAATEQQAVLPDKTEGEPVNNGNLTADMFVPTLSEKPESKPIYNGVRQVRTFEYIAGCIEGGRTGCACYSHQGTALKEVTELMCKDYVKNGLPFNPYKEESQGQEVQQSAQQHSDRAQVATLGGKP

SEQ ID NO: 7768 - protein, 318 aa, Neisseria meningitidis
MNIIGLDISKDTIDATLHKTNGSIHYIKFKNNDDGLKQFRLWIKGNRIRKVYIGMEATGIYYEKAADMLSSYYTVYVINPLKIKDYGKSRFNRTKTDKADSNLIADYIKRHQDTLIPYQIPKNKALQKLINLKNQLHQHQKQIKNRLHSTEEDFIRNIHQDLIDTIQDKMEQVKIAISEQIKKQTDNNHYRNLQTIPSIGKDTASVLYAQLTEKHFKTANQFVSYAGLNPAIIQSGTSVRGRGRLSRYGNRRLKSTLYMPALCAYRFNAFPKLINNLKKAGKPKMVIIVAIMRKLAKLAYYIVKTGQPYDAERHRLNQ

SEQ ID NO: 7769 - protein, 105 aa, Neisseria meningitidis
MSTFFQQTAQAMIAKHIDRFPLLKLDRVIDWQLIEQYLNRQKTRYLRDHRGRPAYPLLSMFKAVLLGQWHSLSDPELEHSLITRIDFNLFCRFDELSIPDYSIVD

SEQ ID NO: 7770 - protein, 544 aa, Neisseria meningitidis
MTKFIFVTGGVVSSLGKGIAAASIAAILESRGLNVTMLKLDPYINVDPGTMSPFQHGEVFVTDDGAETDLDLGHYERFIDSTMTRRNSFSTGQVYENVIAKERRGDYLGGTVQVIPHITDEIKRRIHEGAAGYDVAIVEIGGTVGDIESLPFLEAIRQMRSQLGRNNTLFAHLSYVPYIAAAGEIKTKPTQHTVKEMLSIGLQPDILICRMDRTMPADERRKIALFCNVEERAIVGSYDVDSIYECPEMLHDQGIDNIITEQLQLNVQQADLTAWKKIVHAIQNPKHTVKIAMVGKYVDLTESYKSLIEALKHAGIHTETDVQITFVDSENIEKNKGDVSMLKDMDAILVPGGFGSRGVEGKIAAVRYARENNVPYLGICLGMQIALIEYARDVAGLKGANSTEFDLKCAAPVVALIDEWQTADGSVETRDESTDLGGTMRLGAQEVELKAGSLAAKIYGSGHIRERHRHRYEVNNNYVPTLEQAGLVIGGVSAGRERLVETIELPNHPWFFACQFHPEFTSNPRKGHPLFTAFVKAALNNKKA

SEQ ID NO: 7771 - protein, 556 aa, Neisseria meningitidis
MEKIWLDSYEKGVSAEIDITQYNSVSDVFRQSVEKFADQPAFQNMGKTLTYAETGKLATDFASYLQNVLKLPRGERVAIMLPNVLQYPVALFGILQAGLVAVNTNPLYTPRELEHQLKDSGATAIIVLENFANTLELVLPRTQIKHVIVASVGEMFGLLKGSLINFVIRKIKKMVPEYRIRETVSFQTALKEGAKHVFQPVALNREDTALLQYTGGTTGVAKGAVLSHGNICANMLQAKEWIKNQLREGKETVIAALPLYHIFALTVNLMIFANAGSKIILITNPRDMKGFIGELKKQRVNVFIGVNTLFNAMVNRPDFAEVDFSELRLTLGGGMATQKAVAEKWKKITGTPIVEAYGLTEASPGVCCNPLNIESYSGSIGLPVSSTEVELRDANGKEVPVGQPGELWVKGPQVMQGYWNRPEETAKAIDARGFLETGDIAVMDEKGWLKLVDRKKDLVVVSGFNVYPNEIEEVIAHHGKVMEVACIGVPDEKTGEALKVFVVKKDPSLTKEELIAFCRTELTAYKVPKNIEFRDELPKSNVGKILRRELRQSTGK

SEQ ID NO: 7772 - protein, 367 aa, Neisseria meningitidis
MNTTANPSNIIVGLSGGVDSSVTAALLKQQGYQVRGVFMQNWEDDDNDEYCSIKQDSFDAIAVADIIGIDIDIVNFAAQYKDKVFAYFLQEYSAGRTPNPDVLCNAEIKFKCFLDYAVGQGADTIATGHYARKEVRNGVHYLLKGLDRNKDQSYFLYRLKPFQLERAIFPLGGLEKPEVRRLAAEFKLPTAAKKDSTGICFIGERPFREFLQKYLPTDNGKMVTPEGKTVGEHVGLMFYTLGQRKGLGIGGAGEPWFVAAKDLTKNELIVVQGHDHPLLYTRSLVMNDLSFTLPERPKAGRYTCKTRYRMADAPCELRYLDDETAELVFDEPQWAVTPGQSAVLYDGDICLGGGIIQTTDKPVIITR

SEQ ID NO: 7773 - protein, 157 aa, Neisseria meningitidis; identical to SEQ ID NO: 732

SEQ ID NO: 7774 - protein, 127 aa, Neisseria meningitidis
MEPSSYAAEKKGKGGIRRVINAFGYSIDGIAAAYRYEAAFRQVLWLNVLLVCAAFFWVSETAVRLPLIIASFVSVIVELFNTAVEAAVDHTSTEKHELAKLAKDAGSAAQLFAMLMLAAVWLSALFG

SEQ ID NO: 7775 - protein, 319 aa, Neisseria meningitidis
MMKVLFIADPMASFKTYKDTTYAMMREMAKRGWRLFHTLSGELSVNGGLVTAQASAFEFLGAKNDDDHAWFKSADKVQTALEAFDAVIMRTDPPFDMQYLYATQLLTLAEQQGAKVFNSGQAMRDFNEKLAILNFSRFIAPTLVTTRSADVRTFLKEHGDIIIKPLDGMGGMGIFRLTEKDPNIGSILETLMQLDSRTIMAQRYIPEIVHGDKRILIIGGEVVPYALARIPQNGETRGNLAAGGRGVAQELGGRDREIAETLAPELKRRGILLAGLDVIGSNLTEVNVTSPTGFQEIMKQKGFDVAAMFADAVAAWSVR

SEQ ID NO: 7776 - protein, 562 aa, Neisseria meningitidis
MLNKDQFADNHFIRTIIEEDLESGKHTAVQTRFPPEPNGYLHIGHAKSICLNFGLAYIYDGLCNLRFDDTNPEKENDEYVNAIKEDVEWLGFHWAGEPRFASNYFDQLYDYAVGLIKDGKAYVDDLTPEEMREYRGTLTEAGKNSPYRDRSVEENLDLFTRMKNGEFPDGSKTLRLKIDMASGNINMRDPVIYRIRRAHHHNTGDKWCIYPMYDYTHCISDAIEGITHSLCTLEFEAHRPLYDCVLDNIPAPHATRPRQYEFSRLELLYTITSKRKLNQLVVEKHVSGWDDPRMPTISGMRRRGYTPEGLRLFAKRAGISKSENIVDMSVLEGAIREELENSAPRLMAVLNPLKVTLTNFETGRTQSRRAAFHPNHEEMGEREVPISQTIYIEADDFAENPPKGFKRLIPGGEVRLRHGYVIKCDEVVKDEAGNVVELKCSIDHDTLGKNPEGRKVKGVIHWVSAEHAAEIKVRLYDRLFTVERPDAVRGEDGEYLPFTDFLNPESVKEITAYAEPAAKDLPAESRWQFERIGYFVTDRKDHGKDTPVFNRTVTLKDSWQPK

SEQ ID NO: 7777 - protein, 257 aa, Neisseria meningitidis
MKPKIQRHGEILSLVRRHQFMSVDELAAALDVTPQTIRRDIRELEEVGSLKRHHGGASSGGNLPEGLPADRQTRCQNEKNAIARLIAEHIPDGSSLFVSIGTTMEAVVSELVRRRGSLRVITNNIHAASIASARTDYTVIITSGVVRPLDGGITGVATVDFINQFKVDYAVMSTHGVESDGSLLDDDYKEVSVMQAMIANARVRFLGVDHSKFRSNALVRLGDITAFDKVFTDRLPDTAMQKMLKEAGVECLIADAV

SEQ ID NO: 7778 - protein, 300 aa, Neisseria meningitidis; identical to SEQ ID NO: 3316

SEQ ID NO: 7779 - protein, 238 aa, Neisseria meningitidis
MNFENDDIIHAPTTSSLILEERHDSELFRVYALILDGITDQVLLPGKKLTESELCRQMVCSRNTVRGALSLLAHDKIVDLQPNRGAFVHVPDLKEMQDVFNARIEMETMILNILADLPDLETRLKPLYAMIRREEEASGRGDRVGWNRLSNAFHVELARLVGNDVLFDIMNTLCARSSLIVAVAGVHREEKHAINTHTHSEHREILDLLLAGRRNRVVKILRRHLGNCMERLEKTLED

SEQ ID NO: 7780 - protein, 140 aa, Neisseria meningitidis
MQVTSKWIDGMCFVGTTEGGHSVVMEGSAAEGKAKRGPSPLEMLLLGVAGCSSIDVVMIAEKQRQKVTDCRATVTAKRADDAPRVFTEIHIHFKVFGHDLKESAIERAVQMSAEKYCSASIMLGKAAKITHSFEIAGADK

SEQ ID NO: 7781 - protein, 223 aa, Neisseria meningitidis; identical to SEQ ID NO: 776

SEQ ID NO: 7782 - protein, 208 aa, Neisseria meningitidis
MKNIVILISGRGSNMQAIVNAAIHNVRIAAVLSNSETAAGLQWAAERGIPTDSLNHKNFTSRLAFDTAMMEKIDAYQPDLVVLAGFMRILTPEFCARYEGRLMNIHPSILPSFTGLHTHERALEAGCRVAGCTIHFVTAELDCGPIVSQGVVPILDGDTADDIAARVLAVEHKLYPKAVADFAAGRLIIEGNRVRNSENADAARFLTA

SEQ ID NO: 7783 - protein, 272 aa, Neisseria meningitidis; identical to SEQ ID NO: 2728

SEQ ID NO: 7784 - protein, 146 aa, Neisseria meningitidis
MPKATFYTHVAQVPIFTCRLIARAIRDGGRILVWSDSFGQLQELDKMLWQYEAESFIPHEIWETEEAMPSEPSVLLACGGNLPRIPEGMTVLNLSDGFWNTAPVLPARVLEIVGNSLEELADARERFTAYRRSGFAIEHHGMEGKA

SEQ ID NO: 7785 - skipped

SEQ ID NO: 7786 - protein, 371 aa, Neisseria meningitidis; identical to SEQ ID NO: 500

SEQ ID NO: 7787 - protein, 356 aa, Neisseria meningitidis
MNLISRYIIRQMAVMAVYALLAFLALYSFFEILYETGNLGKGSYGIWEMLGYTALKMPARAYELIPLAVLIGGLVSLSQLAAGSELTVIKASGMSTKKLLLILSQFGFIFAIATVALGEWVAPTLSQKAENIKAAAINGKISTGNTGLWLKEKNSIINVREMLPDHTLLGIKIWARNDKNELAEAVEADSAVLNSDGSWQLKNIRRSTLGEDKVEVSIAAEENWPISVKRNLMDVLLVKPDQMSVGELTTYIRHLQNNSQNTRIYAIAWWRKLVYPAAAWVMALVAFAFTPQTTRHGNMGLKLFGGICLGLLFHLAGRLFGFTSQLYGIPPFLAGALPTIAFALLAVWLIRKQEKR

SEQ ID NO: 7788 - protein, 861 aa, Neisseria meningitidis
MLEAYRKAAAERAALGIPALPLNAQQTADLVELLKSPPAGEGEFLVELLAHRVPPGVDDAAKVKASFLAAVAEGSASSPLISPEYATELLGTMLGGYNIHALIELLDDDKLASIAAKGLKHTLLMFDSFHDVQEKAEKGNKYAQEVLQSWADAEWFASRAKVPEKITVTVFKVDGETNTDDLSPAPDAWSRPDIPLHALAMLKNPRDGITPDKPGEVGPIKLLEELKAKGHPVAYVGDVVGTGSSRKSATNSVIWHTGEDIPFVPNKRFGGVCLGGKIAPIFFNTQEDSGALPIEVDVSALKMGDVVDILPYEGKIVKNGETVAEFELKSQVLLDEVQAGGRINLIIGRGLTAKAREALKLPASTAFRLPQAPAESKAGFTLAQKMVGRACGLPEGQGVRPGTYCEPRMTTVGSQDTTGPMTRDELKDLACLGFSADMVMQSFCHTAAYPKPVDVKTHKELPAFISTRGGVSLRPGDGVIHSWLNRLLLPDTVGTGGDSHTRFPIGISFPAGSGLVAFAAATGVMPLDMPESVLVRFSGKLQPGVTLRDLVNAIPLYAIKQGLLTVAKAGKKNIFSGRILEIEGLPDLKVEQAFELTDASAERSAAGCTVKLNKEPIIEYMKSNVVLMKNMIANGYQDPRTLERRIKAMEKWLANPELLEADKDAEYAAVIEINMDDIKEPIIACPNDPDDVCFMSERSGTKIDEVFIGSCMTNIGHFRAASKLLEGKADTPVRLWIAPPTKMDAKQLSDEGHYGVLGRAGARMEMPGCSLCMGNQAQVREGATVMSTSTRNFPNRLGKNTFVYLGSAELAAICSKLGKIPTVEEYQANIGIINEQGDKIYRYMNFNEIDSYNEVAETVNV

SEQ ID NO: 7789 - protein, 331 aa, Neisseria meningitidis
MNLKNRHFLKLLDFTPEEITAYLDLAAELKAAKKAGREIQRMKGKNIALIFEKTSTRTRCAFEVAARDQGAGVTYLEPSASQIGHKESIKDTARVLGRMYDAIEYRGFGQEVVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVTEEIFESPASIVFDQAENRMHTIKAVMVAALGD

SEQ ID NO: 7790 - protein, 337 aa, Neisseria meningitidis
MQVYYDKDADLSLIKGKTVAIIGYGSQGHAHAANLKDSGVNVVIGLRQGSSWKKAEAAGHVVKTVAEATKEADVVMLLLPDETMPAVYHAEVTANLKEGATLAFAHGFNVHYNQIVPRADLDVIMVAPKGPGHTVRSEYKRGGGVPSLIAVYQDNSGKAKDIALSYAAANGGTKGGVIETTFREETETDLFGEQAVLCGGVVELIKAGFETLTEAGYAPEMAYFECLHEMKLIVDLIFEGGIANMNYSISNNAEYGEYVTGPEVVNASSKEAMRNALKRIQTGEYAKMFIQEGNVNYASMTARRRLNADHQVEKVGAQLRAMMPWITANKLVDQDKN

SEQ ID NO: 7791 - protein, 97 aa, Neisseria meningitidis
MSNIKIVALVTVKPEYTETLAAQFKELVKASRAEEGNISYDLHQEIGKPNRFVFVENWKSQAAIDEHNASAHFQAFVQSVDGKTEALEIVLMNEVAD

SEQ ID NO: 7792 - protein, 163 aa, Neisseria meningitidis
MRHILSVLIENESGAMSRVVGLFSARDYNIDSLAVAPTEDKTLSRMTIVTHGDEQVIEQITKQLNKLIEVIKVVDLNESRFVERELMLVKVRAAGKDRDEFLRLTEIYRGSIIDVTDRSYTIEITGSTDKLDSFLETVGRAQILETVRTGAAGIGRGERILKI

SEQ ID NO: 7793 - protein, 575 aa, Neisseria meningitidis
MQLSGAQIIVQSLKAEGVEYVFGYPGGAVIEIYDALFQLNKFKHILTRHEQAAVHAADAYARVSGKVGVALVTSGPGVTNALTGIATAYTDSIPMVVISGQVGNSLIGTDAFQEVDTVGITRPCVKHNFLVTDINELAETIKKAFQIAASGRPGPVVVDVPKDVTQAMAKFSYPQEDIFIRSYQPVVQGHIGQIKKAVQMLASAKRPVVYFGGGVVLGNASEELTRFVRMTGAPCTGTLMGLGAYPSGDRQFLGMLGMHGTYEANLAMQNADVVLAVGARFDDRVVSVPSKFFEKAKKVIHIDVDPSSIAKRVKVDIPIVGDVKNVLSEMVALWQKQESVPSEDALGKWWKTIEEWRSRDCLWFDNGSEIIKPQYVIQKLAEITGNSAIITSDVGQHQMFAAQYYPFERPRQWLNSGGLGTMGVGLPYAIGAKLAAPDQDVFCITGDGSIQMNIQELSTCFQYRIPVNVITLNNGYLGMVRQWQEIYYGGRESETYFDSLPDFVKLAEAYGHIGIRVDKKSDVEGALLEALNQKDRLVFIDFLTDQKQNVMPMVGNGKGLDEMVLPPHMRADGKA

SEQ ID NO: 7794 - protein, 217 aa, Neisseria meningitidis
MFSVPRSFLPGVFVLAALAACKPQDNSAAQVASSSASASAAENAAKPQTRGTDMRKEDIGGDFTLTDGEGKPFNLSDLKGKVVILSFGFTHCPDVCPTELLTYSDTLKQLGGQAKDVKVVFVSIDPERDTPEIIGKYAKQFNPDFIGLTATGGQNLPVIKQQYRVVSAKVNQKDDSENYLVDHSSGAYLIDKNGEVAIFSPYGSEPETIAADVRTLL

SEQ ID NO: 7795 - protein, 217 aa, Neisseria meningitidis
MQDNALTIALSKGRIFEETLPLLAAAGIVPTEEPEKSRKLIIGTNHENIRLVIVRATDVPTYVRYGAADFGIAGKDVLIEHGGTGLYRPLDLEIAKCRMMVAVRKGFDYEAASQPGCRLKIATKYPEIAASHFAGKGVHVDIIKLYGSMELAPLVGLSDAIVDLVSTGNTLKANGLEAVEHIVDISSRLVVNKAALKTKYALLEPIIQAFGGAVKAK

SEQ ID NO: 7796 - protein, 299 aa, Neisseria meningitidis
MVAKIKKFSDSTLSVLNNGERRFYVYCLTDLKKDKILYIGKGCGNRIFEHEWVASRSQDPVSGEIIDRKLKAISKCKKLGRYIISYHLTEVEALAAESALIHFVKSVLGKKLKNKIAGHGPGGISVEELDRRFGFSSLPLNEINPDGLILAIKIHNAFDLDTDEELDYLFDNQDDANLKSRTLGNWVIGKDVASKVKYVIGVHTGLQNAVVSAYEVDGFETMVEETKNGRKQSRYRFRTTSRSEEVLAKLGLQQKCLPELKFGSGGEKAYIRPKTETETEQENIQTTPNPKIKKEKTKS

SEQ ID NO: 7797 - protein, 429 aa, Neisseria meningitidis
MKKLNTQSPDFQAGLKALLAFETAQNPETERIVADICADVQKRGDAALIEYTNKFDQTNAKSIDDLILTQADLNAAFERIPNDVQTALQTAARRVESYHQRQKMESWSYTDEDGTLLGQQITPLDRVGIYVPGGKAAYPSSVIMNAMPAHVAGVKEIIMVVPTPKGERNDIVLAAAYVAGVTKVFTVGGAQAVAALAYGTETIPQVDKITGPGNAFVAAAKRRVFGVVGIDMVAGPSEILVIADGTTPADWVAMDLFSQAEHDEIAQAILIGTSQAYLDEVEAAMDRLIETMPRRDIIEASLGNRGAMILAKDLDEACEIANYISPEHLELSVENPQEWAKKIRHAGAIFMGRYTGESLGDYCAGPNHVLPTSRTARFSSPLGTYDFQKRSSLIQVSEQGAQKLGETASVLAHGESLTAHARAAEFRMK

SEQ ID NO: 7798 - protein, 365 aa, Neisseria meningitidis
MKSVRSFIRDDIQAMSAYQIADVPPGFAKLDSMESPVHPFAGHETLLQEWQARLAAAPIHLYPNPSGSGLQEALRSAFDIPDCADIALGNGSDELIQFITMLTAKPGAAMLAAEPSFVMYRHNAALYGMDYVGVPLNGDFTLNLPAVLEAVRKHRPALTFIAYPNNPTGVCFTRAEIEAVIEASDGIVVVDEAYGAFNGDSFLPQAGRIPNLIVLRTLSKIGFAGLRIGYAAGCPEVIGELQKILPPYNMNQLSLTTAKLALRHYGIISANIDSLKNERERMFAELGKICRLNTFSSQANFITIRVPDADLLFDTLKQNRILVKKLHGAHPLLEHCLRITVGSPAQNDAVLNIIRQLYCQPTDFL

SEQ ID NO: 7799 - protein, 305 aa, Neisseria meningitidis
MNLTKTQRQLHNFLTLAQEAGSLSKLAKLCGYRTPVALYKLKQRLEKQAEDPDARGIRPSLMAKLEKHTGKPKGWLDRKHRERTVPETAAESTGTAETQIAETASAAGCRSVTVNRNTCETQITVSINLDGSGKSRLDTGVPFLEHMIDQIARHGMIDIDISCKGDLHIDDHHTAEDIGITLGQAIRQALGDKKGIRRYGHSYVPLDEALSRVVIDLSGRPGLVYNIEFTRALIGRFDVDLFEEFFHGIVNHSMMTLHIDNLSGKNAHHQAETVFKAFGRALRMAVEHDPRMAGQTPSTKGTLTA

SEQ ID NO: 7800 - protein, 289 aa, Neisseria meningitidis
MSANEYAQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 7801 - protein, 143 aa, Neisseria meningitidis
MNQLDQLGTRINLICNVFDKWIGQQDLNYNLFAVLYTLATEGSRTQKHIGEKWSLPKQTVSGVCKTLAGQGLIEWQEGEQDRRKRLLSLTETGKAYAAPLTESAQEFSDKVFATFGDKRTTRLFADLDALAEVMEKTISENKK

SEQ ID NO: 7802 - protein, 288 aa, Neisseria meningitidis; identical to SEQ ID NO: 1016

SEQ ID NO: 7803 - protein, 367 aa, Neisseria meningitidis
MMDNIDMFMPEQEEIQSMWKEILLNYGIFLLELLTVFGAIALIVLAIVQSKKQSESGSVVLTDFSENYKKQRQSFEAFFLSGEEAKHQEKEEKKKEKAEAKAEKKRLKEGGEKSAETQKSRLFVLDFDGDLYAHAVESLRHEITAVLLIAKPEDEVLLRLESPGGVVHGYGLAASQLRRLRERNIPLTVAVDKVAASGGYMMACVADKIASAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 7804 - protein, 187 aa, Neisseria meningitidis
MPWNLPIFLTWLRVLLIPVLTALFYLPFPWFAEETINLTAAVIFAVAALTDWFDGFLARLWKQTSDFGAFLDPVADKLMVAVSLLLLVKLDRTYVLFAMIIIGREITISALREWMAQMGKRNSVAVATVGKFKTAAQMLAIFLLLLNFPDFYGFNLAFIGNVLMFIASLLTVWSMLYYLKMAWKEIA

SEQ ID NO: 7805 - protein, 80 aa, Neisseria meningitidis
MVCRHKLSAVVRRFYCTLPDGISRTRKNIRICGIDRYRPQPQRTGNQTGCRRAALPAFLLWVRQFVHRRQYRQNHQGGAG

SEQ ID NO: 7806 - protein, 111 aa, Neisseria meningitidis
MFKDWKEHTALVKKSFGELGKAHPKMLQAYGALEQAAAAEALDAKTRELIAIAVAITTRCESCISVHAAAATKAGATDSEIAGALATAIALNAGAAYTYALRALEAVETQK

SEQ ID NO: 7807 - protein, 301 aa, Neisseria meningitidis; identical to SEQ ID NO: 1646

SEQ ID NO: 7808 - protein, 162 aa, Neisseria meningitidis; identical to SEQ ID NO: 3792

SEQ ID NO: 7809 - protein, 287 aa, Neisseria meningitidis
MLVAAACFTIMNVLIKEASAKFALGSGELVFWRMLFSTVALGAAAVLRRDTFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLGEELFWQEILGMCIIILSGILSSIRPTAFKQRLQSLFRQR

SEQ ID NO: 7810 - protein, 376 aa, Neisseria meningitidis; identical to SEQ ID NO: 3768

SEQ ID NO: 7811 - protein, 874 aa, Neisseria meningitidis
MKTSELRQKFLKFFETKGHTVVRSSSLVPHDDPTLLFTNAGMNQFKDVFLGFDKRPYSRATTAQKCVRAGGKHNDLENVGYTARHHTFFEMMGNFSFGDYFKRDAIHFAWEFLTSPEWLNIPKDKLLATVYAEDDEAYNIWLNEIGMPSERIVRIGDNKGAKYASDNFWQMGDTGPCGPCSEIFYDHGEEIWGGIPGSPEEDGDRWIEIWNCVFMQFNRDEQGNMNPLPKPSVDTGMGLERIAAVMQHVHSNYEIDLFQDLLKAVARETGAPFRMEEPSLKVIADHIRSCSFLIADGVLPSNEGRGYVLRRIIRRAVRHGYKLGQSKPFFHKLVADLVKEMGGAYPELKEKQAQIEEALKNEESRFAQTLETGMALLENALVKGGKTLGGEIIFKLYDTYGFPYDLTADICRERNIEPDEAGFEREMEAQRARARAAQSFKANAQLPYDGQDTEFKGYSERQTESKVLALYKDGEQVNELNEGDSGAVVIDFTPFYAESGGQVGDVGYIFSGENRFEVRDTQKIKAAVFGQFGVQTSGRLKVGDSVTAKVDDEIRNANMRNHSATHLMHKALRDVLGRHVEQKGSLVTAESTRFDISHPQAVTAEEIAEVERRVNEAILANVAVNAAIMSMEDAQKTGAMMLFGEKYGEEVRVLQMGGFSTELCGGTHVSRTGDIGLFKIISEGGIAAGVRRIEAITGLNALKWAQEQERLVKDIIAETKAQTEKDVLAKIQAGAAHAKALEKELARAKAELAVHAGAKLLDDAKDLGAAKLVAAQIEADAAALREIVTDLTGKSDNAVILLAAVNDGKVSLCAGVSKPLTGKVKAGDLVKFAAEQVGGKGGGRPDLAQAGGTDADKLPAVLDSVKDWVGAKLV

SEQ ID NO: 7812 - protein, 68 aa, Neisseria meningitidis
MQRGRLKGLVCRRLGRDPTNFVKYKNVGHDPTYLPFCTKRLSERPCLPYGGSRPSRFLLGYDPSYLLR

SEQ ID NO: 7813 - protein, 143 aa, Neisseria meningitidis
MSISLIGLHITIAIILFFTTNFMGKKSSIFGYYQLSFSEENHSPAFNIFYRAFTPILFIVIFSWVVTSLEIPISLEKINYVVIYYFIIRLLSVFVFEKTHIVNWFNQLTIPILSITLSFIVYNKMILPKSFLLPSSQEVATTF

SEQ ID NO: 7814 - protein, 63 aa, Neisseria meningitidis
MHKKFESYFGKIIDKIIKEDSYNNDDFLTDKKKALIYSVLIYENFNRGLVYRYFEKNYFVLVE

SEQ ID NO: 7815 - protein, 95 aa, Neisseria meningitidis
MQVTSAEYLSNEESIKKGGNILMEKYNEKYNESIDGNKTLYKSYYESRRESIKNYNPDAKYINEIESIYMMLGEIYPNAPDFMSPHFEGDCSEGE

SEQ ID NO: 7816 - protein, 85 aa, Neisseria meningitidis
MSGINARPTNSIFSNLCQIFSSLQGCLKTQTPFSDGLFSLKSPYRSIRKHRRIIMEVTISAIINGEFADQYGKRGSQFNENGMLI

SEQ ID NO: 7817 - protein, 335 aa, Neisseria meningitidis
MSTFFQQTAQAMIAKHIDRFPLLKLDRVIDWQLIEQYLNRQKTRYLRDHRGRPAYPLLSMFKAVLLGQWHSLSDPELEHSLITRIDFNLFCRFDELSIPDYSTLCRYRNRLAQDNTLSELLELINRQLTEKGLKIEKASAAVVDATIIQTAGSKQRQAIEVDEEGQISGQTTPSKDSDARWIKKNGLYKLGYKQHTRTDAEGYIEKLHITPANAHECKHLSPLLEGLPKGTTVYADKGYDSAENRQHLEEHQLQDGIMRKACRNRPLSEVQTKRNRYLSKTRYVVEQSFGTLHRKFRYARAAYFGLIKVSAQSHLKAMCLNLLKAANRLSAPAAA

SEQ ID NO: 7818 - protein, 372 aa, Neisseria meningitidis
MLIHYIDIAKRNFVIAVSSLSKTKTETNNPKGIAHTIEYLKKHKVALVVTESTGGLEIPAAKAIHRAGIAVIIANPRQTHQFAQSQSLTKTDAKDAKMPAFFAQMKAQKEDWQTMPYHPPTEAEEVLEALVNRRNQSADMRTAEKNRLHQVHETQVGSVKQLIAHFDRLIDESDKQIDDHTHTHFDGKAQVAEQIKGIGSITTATLMAMLPELGRLSHKRIASLVGIAPHPRKSGEAKFKSRCFGGRSAVLKALYMATVAATRFEPLIRDFHQRPLSEGKPYKVAVTACMRKLLETFAKFLSLTTTEIPTQVFGCFRPKYRLILPKHPLNPPRTPDNQASGLPFRRQRAHLACWRLSTGSNTSPSDGFAHSL

SEQ ID NO: 7819 - protein, 314 aa, Neisseria meningitidis
MSASKKFPIPLSYFSIALGLFALGLSWRYGASVGLLPALAAESLLAAASVVWLLLVAAYLIKMFAYRNDFLSDLRDLVQCCFISAIPITAMLEGLALKPYQAGAAAVLIYVGVAGQLAFSMYRAAGLWRGLHSLEATTPIIYLPTVATNFVSASSLAALGHHDYAALFFGAGMFSWLSLEASILGRLRTAAPVGTAARGVVGIQLAPAFVGCGAYFAVGGKVDGFALALIGYGCLQLLFLLRLTRWFWEGGFTMSFWGFSFGFAAMAGCGLHLAASGVLSGLGLTLATAGSAGVALLLVGTLHRIATGRFLVRS

SEQ ID NO: 7820 - protein, 227 aa, Neisseria meningitidis
MELVFIRHGQSEWNAKNLFTGWRDVKLSEQGLAEAAAAGKKLKENGYEFDIAFTSVLTRAIKTCNIVLEESDQLFVPQIKTWRLNERHYGQLQGLDKKQTAEQYGDEQVRIWRRSYDTLPPLLDKDDEFSAHKDRRYAHLPADVVPDGENLKVTLERVLPFWEDQIAPAILSGKRVLVAAHGNSLRALAKHIEGISDEDIMGLEIPTGQPLVYKLDDNLKVIEKFYL

SEQ ID NO: 7821 - protein, 767 aa, Neisseria meningitidis
MNTQAHAPHTDSNTLMLGRYAERAYLEYAMSVVKGRALPEVSDGQKPVQRRILFAMRDMGLTAGAKPVKSARVVGEILGKYHPHGDSSAYEAMVRMAQDFTLRYPLIDGIGNFGSRDGDGAAAMRYTEARLTPIAELLLSEINQGTVDFVPNYDGAFDEPLHLPARLPMVLLNGASGIAVGMATEIPPHNLNEVTQAAIALLKKPTLETADLMQYIPAPDFAGGGQIITPADELRRIYETGKGSVRVRARYEIEKLARGQWRVIVTELPPNANSAKILAEIEEQTNPKPKAGKKQLNQDQLNTKKLMLDLIDRVRDESDGEHPVRLVFEPKSSRIDTDTFINTLMAQTSLEGNVSMNLVMMGLDNRPAQKNLKTILQEWLDFRTVTVTRRLKFRLNQVEKRLHILEGRLKVFLHIDEVIKVIRESDDPKADLMAAFGLTEIQAEDILEIRLRQLARLEGFKLEKELNELREEQGRLNILLSDENEKRKLIVKEMQADMKQYGDARRTLVEEAGRAVLTQTTADEPITLILSEKGWIRSRAGHNLDLSQTAFKEGDCLKQTLEGRTVLPVVILDSSGRTYTLDAAEIPGGRGDGVPVSSLIELQNGAKPVAMLTGLPEQHYLLSSSSGYGFITKLGDMVGRVKAGKVVMTADSGETVLPPVAVYASSFINPDCKIIAATSQNRALAFPIGELKIMAKGKGLQIIGLNAGESMTHTAVSSELEILIESEGRRGAAHKDRIPISLLEAKRGKKGRLLPISGSLKQLSSPK

SEQ ID NO: 7822 - protein, 505 aa, Neisseria meningitidis
MVISNPRELEKLKDRIPNLINIIRVAIVFPLMIMHILGLETGSRANLHASWTAWAFYVWLAIACWLIFFSIIHPHWQWQSLKMPRFSAVADITMIGVLTYLFGGIDSGFGILILPFVVCSCLLSYGRYPLLYSSYAAILLIFNAIADGDIGKYPLISDARTASATFILVAASYLSAIFTSLSVKYIDRAGKLAYDSHIAYHRIKGLSQTVLERVQEAVVVINAEGLAVLFNRKAKDLFPALEIGRRAGLSDSAAELWDQASPHTFEYVLGTPGLNAGIRAVPVNKGSDKLLILYIRPQSEIQAEALSVKLAALGQLTANLAHEIRNPMSAIRHANDLLRENMEAGAADPFNAKLCKIIDGNICRIDKMLEDISSLNKRNKTERETIGLIPFWEEFKQEFLLGHPDAADCIRPDIQGGSPTAYFDPAHLRQIMWNLANNAWRHSRKQPGSISVTIRPAQKNTVCILFADRPKCRNTCSNPFTPRRKTAPASGCMSPANWRTPISAI

SEQ ID NO: 7823 - protein, 155 aa, Neisseria meningitidis
MTELQHPVLVVDDETDILDLMEMTLMKMGLRVHTASGVAEAKNKLDSQRYSLVLTDMRMPDGSGLEVVQHINSRLLDTPVAVITAFGNADQAQEALRCGAFDPDTMQIQDYLDQIERDIIEQTLKQTEGNRTQAAKRLGISFRSMRYRMERLNIG

SEQ ID NO: 7824 - protein, 250 aa, Neisseria meningitidis
MTDILIDNTATETVRTLIRAFPLVPVSQPPEQGSYLLAEHDTVSLRLVGEKSSVIVDFASGAAQYRRTKGGGELIAKAVNHTAHPTVWDATAGLGRDSFVLASLGLAVTAFEQHPAVACLLSDGIRRALLNPETQNTAAHINLHFGNAAEQMPALVQTQGKPDIVYLDPMYPERRKSAAVKKEMTYFHRLVGEAQDEAALLHTARQTAKKRVVVKRPRLGEHLAGQDPAYQYTGKSTRFDVYLPYGTDKG

SEQ ID NO: 7825 - protein, 389 aa, Neisseria meningitidis
MSKKLHPQTLAIRGGKEQTEYREHNQALFLTSSFMWDNAQHAADLFSKKIKGFTYTRTANPTTAAFEKRIAALEGAERAVATSAGMSAIQAAFFTFLQAGDHVISSRSLFGTTVGFINNIVAKFGIEVSHVSPTDINEWKAAVKANTKLLFLETPSNPLGEVADLEALAELAHGIGALLVVDNSLLSPVGSQPLKHGADISVSSATKAIDGHGRVMGGVLAGSEELLAQVAMYCNSCGLAMSPFNAWQLLSGVETLSLRMEKQFDNALKIAQWLQAQPQVQAVYYTGLSDHPQAALIRKQQNGGGIVIGFEVADQEAAWKVVDGVELFSRTANLGDVRSTITHPWTTTHGRMQPEEKLAANIRPGLVRLSVGLEYVGDLIDDLKQALAR

SEQ ID NO: 7826 - protein, 253 aa, Neisseria meningitidis
MDANKEPNWEKRLENLRQTRRMKAVPTYAPLSRPSETGTDAPVPKLDDESRARVLKAYLKKWQEEHNAAVADCGEEVETDPMIVLQENWLNAQASLQMSVSEKHIESRRRIRFDTKKDSVEFETGQIESGENADEAESGTNEPAVSENGENDAEETLMPVQINILNPKAVNRREVFCLSEQELTERLIKRLRPHLTDTVNGIIRTAVQKQMAVFTYQLQQMLHEQAGAVVEDVLEHDVRKILNDIKYELKYKR

SEQ ID NO: 7827 - protein, 83 aa, Neisseria meningitidis
MGSIEQRLEYLEEANDVLRMQNHVLSTAFKALIRALPAETAEIAVESIQLAFEDALAELSYEDSPHTDLFHDVTYAFFREKER

SEQ ID NO: 7828 - protein, 268 aa, Neisseria meningitidis
MNMKKWIAAALACSALALSACGGQGKDTAAPAANPDKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKNMNKVGVVTGYTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEDGQAAK

SEQ ID NO: 7829 - protein, 507 aa, Neisseria meningitidis; identical to SEQ ID NO: 1202

SEQ ID NO: 7830 - protein, 470 aa, Neisseria meningitidis
MKILILGNGQVGSTVAQNLAAIPNNDVTVIDIDEKALQETGSRLDVQTVFGNGASPFTLERAGAEDADLLLALSRSDETNIVACKVAADLFNIPGRIARVRSSEYLEYLSPKLENNENGSLSIFGITETISPEQLVTEQLAGLIDCPGALQVLRFADDRVRMVIIQARRGGLLVGRSIADIAQDLPDGADCQICAVYRNNRLIVPAPQTVIIEGDEILFAAAAENIGAVIPELRPKETSTRRIMIAGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 7831 - protein, 87 aa, Neisseria meningitidis
MFSGESAASEHTAHAHIDLPSLAHRVHRRPLRLKIKLPSVVGITTQKNELLDIPMFFICFYIVMRSDKRPPDICLDGIVLLNFYKYV

SEQ ID NO: 7832 - protein, 268 aa, Neisseria meningitidis
MKSSFVQTLTIAGSDSGGGAGIQADLKTFQMRGVFGTCVITAVTAQNTLGVSAVHLVPTETITAQIQAIREDFDIRAYKIGMLGTAEIIECVADKLKHCSFGRRVLDPVMIAKGGAPLLQDSAVAALTRLLLPDTDVLTPNLPEAEALTGVHIENRKDAERAAKILLDYGVKNVVIKGGHLNGSTSGRCTDWLFTQNETLEFDSPRFPTAHTHGTGCTFSACITAELAKGSDVCEAVQTAKAYITAAISNPLEIGAGHGPVNHWAYRD

SEQ ID NO: 7833 - protein, 289 aa, Neisseria meningitidis
MKERIVGQSGELFCFGQMPVWKVENLPEVLLSGYSSEEGEWVCLNVLQGDVEVRAPDGSAEVWSADGGDCVFAPQQVFSVKPKTDDAEIRLSLYCAAADYFHKKYGMSATHSAVAAARDTVPAGRALDMGCGQGRNALFLGLKGFEVTAVDHNPAALANVAELAEAEGLNVRTLEYDLNAAALQGEFDYIVATVVLMFLMPQRVPDVIADMQAHTAAGGYNLIVSAMDTADFPCPMPFPFKFKEGELKDYYRDWELVEYKEELGSMHAKDENGNPIRFKFVTMLAKKPE

SEQ ID NO: 7834 - protein, 145 aa, Neisseria meningitidis
MNQTVYLYTDGACKGNPGAGGWGVLMRYGSHEKELFGGEAQTTNNRMELTAVIEGLKSLKRRCTVIICTDSQYVKNGMENWIHGWKRNGWKTASKQPVKNDDLWKELDALVGRHQVSWTWVKGHAGHAENERADDLANRGAAQFS

SEQ ID NO: 7835 - protein, 134 aa, Neisseria meningitidis
MTAQPCPICTAQNEDVLLQTPNLRVIAVHNDSGSPAFCRVIWRKHIAEMTDLSAAERGELMEMVYKVEAAMRQVFRPAKINLASLGNVVPHLHWHIIARFENDASFPAPIWANPVRKHGMTLPQDWTEQLKKLL

SEQ ID NO: 7836 - protein, 394 aa, Neisseria meningitidis
MTEPTSRRRFLKTCTAAAGAGLLQACGTSATSVPPLPSSHSVVKARTVPLQTPRRQSSDGNLLRVVASSGFAEDTNRVNTALTRLYNVGFTVTNQQAGSRRFQRFAGTDTQRAADFQEVASGRVATPKVLMGLRGGYGAARILPHIDFASLGARMREHGTLFFGFSDVCAVQLALLAKGNMMSFAGPMAYSDFGKPAPGAFTMDAFIKGATQNRLTVDVPYIQRADVETEGILWGGNLSVLASLAGTPYMPDIDGGILFLEDVGEQPYRIERMLNTLYLSGILKKQRAIVFGNFRMEKIRDVYDPSYDFSAVANHVSRTAKIPVLTGFPFGHIADKITFPLGAHARIRMNGNSGYSVAFEGYPTLDASALTLDTLLPPPDLPIFPESGVADISE

SEQ ID NO: 7837 - protein, 177 aa, Neisseria meningitidis
MGIYDFQMKDAEGNAVDLSGYRGKVLLIVNTATRCGLTPQYEALQKLYAQYTAEGLEILDFPCNQFREQAPESSGEIAQVCMMKFGTKFKIFDKIEVNGANTAPLYAYLKSVKPQDKGNHLFKDFVLKLAALGEKRDEGDIKWNFTKFLVNRDGEVVERFAPSVTPEEIEADIRALL

SEQ ID NO: 7838 - protein, 751 aa, Neisseria meningitidis
MGQYKKLWYLLFAVLAVCFTILGYMGSEVYKKAPPYPEQVVSASGKVLMTKDDILAGQSAWQTTGGMEVGSILGHGAYQAPDWTADWLHRELVAWLDLTAQQTYGKKFDEVSPEEQAVLKTRLADEYRNQSRVKEDGSVVISDTRVKAIESILPYYHGVYSDDPKFQTTREHFAMKNNTLPSQEAREKLFNFFFWTSWSASTNRPDENFTYTNNWPHEPLINNVPTTENYMWSFTSVVLLLMGIGLLMWGYSFLTKHEEVEVPSEDPISKIQLTPSQKALGKYVFLTVALFVVQVLLGGLTAHYTVEGQGFYGIDEALGFEMSDWFPYALTRTWHIQSAIFWIATGFLTAGLFLAPIVNGGKDPKFQRAGVNFLYIALFIVVGGSYAGNFFALTHILPPEFNFWFGHQGYEYLDLGRFWQLLLMVGLLLWLFLMLRCTVSAFKEKGVDKNLLAIFVASMVGVGVFYAPGLFYGEKSPIAVMEYWRWWVVHLWVEGFFEVFATAAFAFVFYNMGFVRRSTATASTLAAAAIFMLGGVPGTLHHLYFSGSTSASMAIGACFSALEVVPLVLLGREAYEHWSYQHLSDWAKRLRWPLMCFVAVAFWNMIGAGVFGFLINPPISLFYIQGLNTSAVHAHAALFGVYGFLALGFVLLVARYLKPNAQFDDKLMTWGFWLLNGGLAGMIAISLLPVGAIQAYASITHGLWYARSEEFLQMEILDTLRWVRTAADLVFIGGAICVAIQATKIVFGRDK

SEQ ID NO: 7839 - protein, 390 aa, Neisseria meningitidis
MKRQALAAMIASLFALAACGGEPAAQAPAETPAAAAEAASSAAQTAAETPSGELPVIDAVTTHAPEVPPAIDRDYPAKVRVKMETVEKTMTMEDGVEYRYWTFDGDVPGRMIRVREGDTVEVEFSNNPSSTVPHNVDFHAATGQGGGAAATFTAPGRTSTFSFKALQPGLYIYHCAVAPVGMHIANGMYGLILVEPKEGLPKVDKEFYIVQGDFYTKGKKGAQGLQPFDMDKAVAEQPEYVVFNGHVGAIAGDNALKAKAGETVRMYVGNGGPNLVSSFHVIGEIFDKVYVEGGKLINENVQSTIVPAGGSAIVEFKVDIPGSYTLVDHSIFRAFNKGALGQLKVEGAENPEIMTQKLSDTAYAGNGAAPAASAPAASAPAASASEKSVY

SEQ ID NO: 7840 - protein, 251 aa, Neisseria meningitidis; identical to SEQ ID NO: 2480

SEQ ID NO: 7841 - protein, 318 aa, Neisseria meningitidis; identical to SEQ ID NO: 7768

SEQ ID NO: 7842 - protein, 367 aa, Neisseria meningitidis; identical to SEQ ID NO: 7767

SEQ ID NO: 7843 - protein, 94 aa, Neisseria meningitidis; identical to SEQ ID NO: 7766

SEQ ID NO: 7844 - protein, 517 aa, Neisseria meningitidis
MLGMFSVNSYAERFKYPIGNSDVRLDIDHKKSVVTDFRVDGQRFSGRIIEPSIIEHVPTGARSLEKVPVKFTASVSRAAVLSGVGKLARLGAKLSTRAVPYVGTALLAHDVYETFKEDIQAQGYQYDPETDKFVKGYEYSNCLWYEDKRRINRTYGCYGVDSSIMRLMSDDSRFPEVKELMESQMYRLARPFWNWHKEELNKLSSLDWNNFVLNRCTFNWNGGDCLVNKGDDFRNGADFSLIRNSKYKEEMDAKKLEEILSLKVDANPDKYIKATGYPGYSEKVEVAPGTKVNMGPVTDRNGNPVQVVATFGRDSQGNTTVDVQVIPRPDLTPGSAEAPNAQPLPEVSPAENPANNPNPNENPGTSPNPEPDPDLNPDANPDTDGQPGTRPDSPAVPGRTNGRDGKDGKDGKDGGLLCKFFPDILACDRLPESNPAEDLNLPSETVNVEFQKSGIFQDSAQCPAPVTFTVTVLDSSRQFAFSFENACTIAERLRYMLLALAWAVAAFFCIRTVSREV

SEQ ID NO: 7845 - protein, 121 aa, Neisseria meningitidis
MTCFKIRLSKQPLKGRTMNKPFITQAQLALYKYQPSSKYYGKTMAYTFASELLDYSKVNKFIIHEEIQCFLNRRISNNIWKIYFSDESVAYIKILELQDDYSRGIEIKTFDFNPNVGDVFG

SEQ ID NO: 7846 - protein, 100 aa, Neisseria meningitidis
MGYRVGINCFDTRLHADDYLLSSLPPTVTQDGKIIRPERVGEKWVLNGKPVMLSYPKCSNFEQIKQGSYVGSTVLILFVVIYGFRLLINFLKDMGKVGID

SEQ ID NO: 7847 - protein, 94 aa, Neisseria meningitidis; identical to SEQ ID NO: 7762

SEQ ID NO: 7848 - protein, 66 aa, Neisseria meningitidis; identical to SEQ ID NO: 7761

SEQ ID NO: 7849 - protein, 103 aa, Neisseria meningitidis; identical to SEQ ID NO: 7760

SEQ ID NO: 7850 - protein, 402 aa, Neisseria meningitidis
MSEAEYFSHFISNGNGKLLEIPQRRGRQDGVFIDWLSFTLHEDSLLKVSGCPLVSDAEYMFVLSKKLEEILGFGITSRCKSKGNKFYDSMFRLGSEEVDYGEVHYGGQRNTVLIELKGVGCNIANPGWELRLKQFLEDSLRPRITRVDLALDFFDGEYTPEQALLDHDNGFFDNSNMRPKSEMVGTAWRREDGSGKTFYVGRKKNSRFVRVYEKGRQLGDKESKWVRFEIQFNHGDMEIPLDILINQGSYFSGAFPICQKFKNMPNPERFDYRKKVANLTFQHKLRYAKNAVGKLINFMFDMGFDSDEIVRYLKADLGYPKGLEPEKYSLAGLKESLKFGFIHEQPDVDLEVELEELGIIKFKQSDKFDPDKRLFDPHHDVESERQYQLYLDRMYDLHANQN

SEQ ID NO: 7851 - protein, 73 aa, Neisseria meningitidis
MSVANVIFSCSYWRIFKKSDYCVLCFYQFRHGEPHKLAEQENFSKLYQAFDYIDSVGSNFPVIITTDGCGLSS

SEQ ID NO: 7852 - skipped

SEQ ID NO: 7853 - protein, 185 aa, Neisseria meningitidis
MDALKLLTNRRSSKKLKHPAPDAAELEQIFQAATQVPDHGNMRPFRFTVIQGEVGLQRFRDVLKQTVAELNFGDDAMKKAEKVGNMAPMVIGVTFAPNRDVPKPKPEWEQMLTAGCAAYALQLAATAQGFDNVWITGMWVNSPLLREAFGCADKDKIIGLMMVGTPTEEVHKPKNTDLEAFVSHW

SEQ ID NO: 7854 - protein, 544 aa, Neisseria meningitidis
MIKPNLRPKLGSSALIAFLSLYSSLVLNYAFFAKVVELHPFNGTGADIFLYTMPVVLFFLSNFVFHVIALPFVHKVLIPLILVISAAVSYQEIFFNIYFNKSMLNNVLQTTAAESARLITPGYVLWIVCLGVLPALAYIAVKVKYRVWYKELLTRLVLAAVSFLCALGIAMLQYQDYASFFRNNKSVTHLIVPSNFIGAGVSKYKDWKRSNIPYTQLDMAVVQNRPAGSLRRFVVLVVGETTRAANWGLNGYSRQTTPLLAARGDEIVNFPQVRSCGTSTAHSLPCMFSTFDRTDYDEIKAEHQDNLLDIVQRAGVEVTWLENDSGCKGVCGKVPNTDVTSLNLPEYCRNGECLDNILLTKFDEVLNKNDKDAVLILHTIGSHGPTYYERYTEAERKFTPTCDTNEINKCTRATLVNTYDNTVLYVDQFIDKVIRKLENRDDLESVVHYVSDHGESLGENGMYLHAAPYAIAPSGQTHIPMVMWFSKAFRQHGGIDFQCLKQKAAENEYSHDHYFSTVLGLMDISNSQTYRKEMDILAACRRPR

SEQ ID NO: 7855 - protein, 109 aa, Neisseria meningitidis
MSRCCLKRLQTASAVSAFSGGVLEVVRLCCRRLSVLFNPSVMLFVPDCPVGGAAGFFQYEMLCPFFWQGRLQTGSNLAYDVFMSAGRLNGGRNPPHSRRFLALLCSVAL

SEQ ID NO: 7856 - protein, 368 aa, Neisseria meningitidis
MSLYPIYNFSAGPAVLPEAVLETARQEMLDYNGTGFPVMAMSHRSEMFLSILHHAEQDLRQLLKVPDNYKILFLQGGATTQFNMAAMNLAHGFRTADAVVTGNWSRIAYEQMSRLTDTEIRLAAHGGEQFDYLDLPPVETWDVAPDSAFVHFAVNETVNGLQYREVPCLSEGMPPLVCDMSSEILSREFDVADYGLIYAGAQKNIGPAGVTVVIVREDLLERCPNDIPDVFNYRSHINRDGMYNTPSTYAIYMSGLVFRWLQAQGGVKKIEAVNRLKAQTLYETIDGSDGFYINRIRPNARSKMNVVFQTGDEELDRRFVLEAELQGLCLLKGYKTVGGMRASIYNAMPLEGVRALADFMRDFQRRYG

SEQ ID NO: 7857 - protein, 149 aa, Neisseria meningitidis
MYIGSSMDIQTILEKTLPGLGYELVDFELTAQGTLRVFIDKESGITVEDCATVSNHLSRVFMVEDIDYKNLEISSPGLDRPLKKAADFVRFAGQNAKIKTRLPIDGQKNFIGKIEGCENDTVTVSFDGKTVQIELGNIDKARLRPEFKF

SEQ ID NO: 7858 - protein, 500 aa, Neisseria meningitidis
MSREMLQLAEALASEKNVDAEVVFQALEFALSTAAKKKADREHMDVRVQINRDTGEYQTFRRWLIVADEDYTYPDVEKTIEEIQEEIPGTTIQIGEYYEEQLPNEGFGRQAAQTAKQIILQRIRDAEREQNLNEFLAVKEDIVSGTVKRVERHGIIVEVVAGKLDALIPRDQMIPRENFRSGDRIRALFLRVEEIGNTGRKQVILSRTSGDFLVKLYANEVPEIADGMLEIRAVARDPGQRAKVAVKANDQRIDPQGTCIGVRGSRVNAVSNELSGERIDVVLWSPEPAQFVMSALSPAEVSRIVIDEDKHAVDVIVAEDQLALAIGRGGQNVRLASDLTGWQLNIMTSAEADERNAAEDAAIRRLFMDHLNVDEETADVLVQEGFATLEEVAYVPAAELLAIEGFDEEIVDMLRNRARDAILTMAIAAEEKLGEVSDDMRNLEGIDADMLRSLAEAGITTRDDLAELAVDELIEITGVNEETAKAVILTAREHWFTEDK

SEQ ID NO: 7859 - protein, 962 aa, Neisseria meningitidis
MSNTTVEQFAAELKRPVEDLLKQLKEAGVSKNSGSDSLTLDDKQLLNAYLTKKNGSNSSTISIRRTKTEVSTVDGVKVETRKRGRTVKIPSAEELAAQVKAAQTQAAPVRPEQTAEDAAKARAEAAARAEARAKAEAEAAKLKAAKAGNKAKPAAQKPTEAKAETAPVAAETKPAEESKAEKAQADKMPSEKPAEPKEKAAKPKHERNGKGKDAKKPAKPAAPAVPQPVVSAEEQAQRDEEARRAAALRAHQEALLKEKQERQARREAMKQQAEQQAKAAQEAKTGRQRPAKPAEKPQAAAPAVENKPVNPAKAKKEDRRNRDDEGQGRNAKGKGGKGGRDRNNARNGDDERVRGGKKGKKLKLEPNQHAFQAPTEPVVHEVLVPETITVADLAHKMAVKGVEVVKALMKMGMMVTINQSIDQDTALIVVEELGHIGKPAAADDPEAFLDEGAEAVEAEALPRPPVVTVMGHVDHGKTSLLDYIRRTKVVQGEAGGITQHIGAYHVETPRGVITFLDTPGHEAFTAMRARGAKATDIVILVVAADDGVMPQTIEAIAHAKAAGVPMVVAVNKIDKEAANPERIRQELTAHEVVPDEWGGDVQFIDVSAKKGLNIDALLEAVLLEAEVLELTAPVDAPAKGIIVEARLDKGRGAVATLLVQSGTLKKGDMLLAGTAFGKIRAMVDENGKSITEAGPSIPVEILGLSDVPNAGEDAMVLADEKKAREIALFRQGKYRDVRLAKQQAAKLENMFNNMGETQAQSLSVIIKADVQGSYEALAGSLKKLSTDEVKVNVLHSGVGGITESDVNLAIASGAFIIGFNVRADASSRKLAENENVEIRYYNIIYDAINDVKAAMSGMLSPEEKEQVTGTVEIRQVISVSKVGNIAGCMVTDGVVKRDSHVRLIRNNVVIHTGELASLKRYKDDVKEVRMGFECGLMLKGYNEIMEGDQLECFDIVEVARSL

SEQ ID NO: 7860 - protein, 446 aa, Neisseria meningitidis
MNKQPLSLAVVGHTNTGKTSLLRTLLRDSGFGEVKNAPSTTRHVEEAAISDGADTLVFLYDTPGLEDAGGVLEWLENHTDNRSDGIERLQQFLGSHGAHHDFNQEAKVLRQVLQSDMAMYVIDAREPVLDKYRDELTILSWCAKPVMPVFNFTGGQLPESWTTMLARRNLHVFAGFDTVAFDFEGELRLWENLATMLPERSTLDRLTAMRRREWQRLDGEARREIADFLIDAAAFRQEVDENEDTATVLQTMQAEIRQLERQMQQRLFALYRFYHSEIDGGDWMPQAFRQDPFDSELLKQYGIRTGTGAATGALIGLGLDIATLGGSLGLGTAIGGFLGGILPNTRTISDKLAGRQTLHTDPETLTLLAARALDLLHVLQTRGHAAQSDIELHSRKVPWDAARLPPELNKARSHWKWSSLNTHRPETSRAERREYAEKLGIRLAGK

SEQ ID NO: 7861 - protein, 446 aa, Neisseria meningitidis; identical to SEQ ID NO: 200

SEQ ID NO: 7862 - protein, 208 aa, Neisseria meningitidis
MYTGERFNTYSHLSGLILAAAGLALMLLKTIGHGDGYRIFSVSVYGISLLLLYLSSSLYHGIAAGKLKSILKKTDHCMIYVLIAGSYTPFALVSLRNGPGWTVFSLSWLLAAAGIAQELTIGRKSEKRLLSIVIYVVMGWMVLAVMKSLTASLPSAGLAWLAAGGMLYSVGIYWFVNDEKIRHGHGIWHLFVLGGSITQFVSVYGYVI

SEQ ID NO: 7863 - protein, 472 aa, Neisseria meningitidis
MENILSVLVGTVNRFLWDYLLIYALLGIGLFFTLYLGAPQITKLGAGFKSVFGGLFAKGDKDDKSLSQFQALAVAISAQIGTGNVAGVATAITAGGPGAIFWMWVSAVLGMSTIFAEALLAQKYRVVSHGKYIGGPAFYITHGLTPKIGRGAARFLSGFFSIALIIALGFIGNATQANSIASAVTIAFDVPSLAVGIVLAVLAGMVVIGGVNRIANIAQFVVPFMAVVYILCAVVILFEFSDHIVPMFNHIFTAAFNPEAVLGGAAGIGMREAIRFGVARGLFSNEAGMGSTPHAHATADVKHPVQQGMAAFVGVFIDTILVCTATALIILLTDANLSGEQGAAVTQFAFNKAFPGFGSQLLAVCLTFFAFTTIIGWYYFGESNIRFLFRGRHLGIYRALVLLAIVLGTLGKVDLVWSLSDMFNGFMVIPNLIALFLLRKEIRAIYDDYLAQKKAGRDLSYQYEFHEFHDKG

SEQ ID NO: 7864 - protein, 242 aa, Neisseria meningitidis
MAGHSKWANIQHKKARQDAKRGKIFTRLIKEITVAARMGGGDPGSNPRLRLALEKAAENNMPKDNVQRAIDKGTGNLEGVEYIELRYEGYGIGGAALMVDCLTDNKTRTVADVRHAFTKNGGNLGTDGCVAFNFVHQGYLVFEPGVDEDALMEAALEAGAEDVVTNDDGSIEVITAPNDWAGVKSALEAAGYKSVDGDVTMRAQNETELSGDDAVKMQKLIDALEDLDDVQDVYTSAVLNLD

SEQ ID NO: 7865 - protein, 162 aa, Neisseria meningitidis
MTPLFRKAVWLLFAVSVCAFAGSLAAQYVLGMEPCVLCISQRLCVLATALCTAIVLMCRPRRRAGGLFGAVFISIPAVTGISVAAYQLWLQSLPPGTAPSCGAPWTFRLKGWPLFDWFEPVVRGFGNCAEPDYLLGIALPVWSVAYFLAVVLTVWWAWARAK

SEQ ID NO: 7866 - protein, 154 aa, Neisseria meningitidis
MKELDKIDFRILKILQQNARIPMTELAEKVGLSTTPVTERVRRLEREHYISGYHAHLNPHLLGKPLLVFVELKLQSKSGNIFEDFKKEVLKIPQIMECHLVSGEYDYLIKVRLPDMSAYRDMLGNILLQLPAASESRSYVVMEEVKENPVLDLD

SEQ ID NO: 7867 - protein, 352 aa, Neisseria meningitidis
MRPLNVQIRLGNLRHNYRILKEMHGGKLLAVVKADAYGHGAVRCAFALADLADGFAVATIDEGIRLRESGITHPIVLLEGVFEASEYEAVEQYSLWPAVGNQWQLEALLIRHWKKTVKVWLKMDSGMHRTGFFPHDYASAYAALKQSEYVDSIVKFSHFSCADEPESGMTEIQMEAFDLGTEGLEGEESLANSAAILNVPEARRDWGRAGLALYGISPFGGGDDRLKPVMRLSTRIFGERVLQPHSPIGYGATFYTSKSTRVGLIACGYADGYPRRAPSNSPVAVDGKLTRVIGRVSMDMMTIELDASQEGLGHEVELWGDTVNINTVAEAAGTIPYELMCNIKRAKFTYIE

SEQ ID NO: 7868 - protein, 451 aa, Neisseria meningitidis
MSIQSGEILETVKMVADQNFDVRTITIGIDLHDCISSDINVLNQNIYNKITTVGKDLVTTAKYLSAKYGVPIVNQRISVTPIAQIAAATHADSYVSVAQTLDKAAKAIGVSFIGGFSALVQKGMSPSDEVLIRSIPEAMKTTDIVCSSINIGSTRAGINMDAVKLAGETVKRTAEITPEGFGCAKIVVFCNAVEDNPFMAGAFHGSGEADAVINVGVSGPGVVKAALENSDATTLTEVAEVVKKTAFKITRVGELIGREASKMLNIPFGILDLSLAPTPAVGDSVARILEEMGLSVCGTHGTTAALALLNDAVKKGGMMASSAVGGLSGAFIPVSEDEGMIAAAEAGVLTLDKLEAMTAVCSVGLDMIAVPGDTPAHTISGIIADEAAIGMINSKTTAVRIIPVTGKTVGDSVEFGGLLGYAPVMPVKEGSCEVFVNRGGRIPAPVQSMKN

SEQ ID NO: 7869 - protein, 90 aa, Neisseria meningitidis
MNNSVITVIGKDRVGIVYDVSKILAENQINILNISQQLMDDFFTMIILVDTSKCSKSRQEVLDLFAEESKKLALDIRMQNEEIFQAMHRI

SEQ ID NO: 7870 - protein, 245 aa, Neisseria meningitidis; identical to SEQ ID NO: 700

SEQ ID NO: 7871 - protein, 303 aa, Neisseria meningitidis
MVHIMFNQAAQELTTIRDILRFAVSRFNEAGLFFGHGTDNAHDEAAYLILHTLNLPLDMLAPYLDAKLLEAEKEEVLAVIERRAVEHIPAAYLTHQAWQGEFDFYVDERVIIPRSFIYELLGDGLRPWIEYDELVHNALDLCTGSGCLAIQMAHHYPDAQIDAVDVSLDALEVAGINVEDYGLEERIRLIHTDLFEGLEGTYDLIVSNPPYVDAESVELLPEEYLHEPELALGSGADGLDATRQILLNAAKFLNPKGVLLVEIGHNRDVLEAAYPELPFTWLETSGGDGFVFLLTREQLLGEE

SEQ ID NO: 7872 - protein, 197 aa, Neisseria meningitidis
MADGMGNLIGWEKTGLVVGKQWITAKDDKVSDVCNANGEMGVIGLYEPFSHGALTIPGHPNCRCEVVSVSGGELGEFAEKKELRKAAMQYARDNFIGKSYVNKNSGHELKVTWQGVKHAASKANQAELSIMTKLDDLLRYAKYEGSYSDRKGHPNIIAAHKYRAVAKVGNESLNIGVIVREFPDDHKHYDHFILKDE

SEQ ID NO: 7873 - protein, 205 aa, Neisseria meningitidis
MVPRLPIPNRTVKRLSADDSVVLPCESRSLPNTHSENPRLFGGFCFARKKCLLCPEKMSVMAGRHPYGVRSGLRRNGLKLWDIHFRMTRFIVARCGLLFATLKGKTMKKMFVLFCMLFSCAFSLAAVNINAASQQELEALPGIGPAKAKAIAEYRAQNGAFKSVDDLTKVKGIGPAVLAKLKDQASVGAPAPKAPAKPVLPADKK

SEQ ID NO: 7874 - protein, 394 aa, Neisseria meningitidis
MGKHILLGVTGSIAAYKSCELVRLLKKQGHSVTVVMSRSATEFVSPLTFQALSGNPVLTDTHGGNGSNGMEHINLTRNADVFLIAPASMNTVAKICNGVADNLLTSLAAARKCPLAIAPAMNVEMWLNPANQRNIAQLVSDGITVYMPGLGEQACGENGMGRMPEPAELLDLLPDLWTPKILKGKKVLITAGATFEAIDPVRGITNISSGKMGVALARACRAAGAEVSLIHGQLQTALPFGISDTVQAVSAENMHRAVHRLIDKQDAFISVAAVSDYRVKNRSTQKFKKDKNAKPLSIELDENPDILASIASLPNPPFCIGFAAETENVMTYAREKRIKKKLPMIVANDVSIAMGKPTNRITIIGDDGELSFPETSKDEAAMRIVERLAVYLSK

SEQ ID NO: 7875 - protein, 718 aa, Neisseria meningitidis
MPAPQPSAPYDPLTAEARALLFHTASYLKPEEQAELEKAVAYAFRAHDGQTRKSGEPYITHPIAVATQLALWHMDIQGLCAGVMHDVLEDTGVTKGEMAAVFGNTIAEMVDGLSKLEKLKFEDHAEHQAESFRKLILAMTKDVRVIVVKLADRLHNMRTLGSMRPDKRRRIARETLEIYAQIANRIGLNNAYQELQDLSFQNLHPNRYETLKKAMDKSRKNRQDVVGKVLRAFGQRLVGANIEAKIKGREKNLYGIHQKMMAKKLRFAEVMDIYGFRVIVNSIPACYAALGALHTLYQPKPGRFKDYIAIPKSNGYQSLHTTLVGPYGLPIEVQIRTKEMDAVAEGGIAGHWSYKSYSKTVDQAVLHTNRWLKNILDLQASSANAIEFLEHVKVDLFPNEIYILTPKGKILTLPKGATPVDFAYAVHTDIGHKTVAARINNIMMPLRTKLKTGDSVEIITSEHAKPNPAWLNFAVSGRARSAIRQYIKNLNRHDAVVLGESLLQKALSSLLPKDVLLSDGIKEKYLADLNDKQTSFEEVLYNVGMGHTLPVYVAMHIAELAGEHFGSEVRLSSIKVDGQESGHIHFAECCHPVPGDSIRLLLVKGKGMIIHRDTCPTLLKSDPEQQLDADWENMNGQNYRVGLQVQSEDSHGLLALMAQAISDSGADIESVETPSKSQSGTEGFVEFKFLLKVKNLNQLNQIIQNLHSIPYIRKVIRS

SEQ ID NO: 7876 - protein, 68 aa, Neisseria meningitidis
MARITTEDCTGKISNHFDLTLVAARRARQLENGNTPLVDDVRNNKPTVTALREIAAGHIGTELLTRNK

SEQ ID NO: 7877 - protein, 205 aa, Neisseria meningitidis
MSAYRKGNIFIISAASGTGKTTLVSRLLANHNGLRVSVSHTTRPPREGEANGVHYHFVSKEEFESLIAQEAFLEYADVFGNYYGTGAEGVNALAAAGYDVILEIDVQGAAQVRDALPEAVGIFILPPSFDVLAARLNGRGTDSREVIQRRLSKARHEIEQSVLFDFVVVNDDLARAEEDLRHIVNACRLKRSRQLGFIADLLENS

SEQ ID NO: 7878 - protein, 188 aa, Neisseria meningitidis
MLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 7879 - protein, 262 aa, Neisseria meningitidis
MNPKIVFFDIDDTLYRKYTDTLRPSVKTAVAALRGKGILTALATGRSLATIPEKVRDMMAEAGMDAVVTINGQFALLHGKTVREVPMDAGLMGRVCAHLDGLGMDYAFVGGEGIAVSALSECVCRALKHIASDFFADKDYFSSKPVYQMLVFAEENEMPLWSDIVEREGLKTVRWHEEAVDLLPAGASKTDGIRSVVEALGWEMADVMAFGDGLNDVEMLSEVGFGVAMGNGEQAAKEAAKYVCPSVDEDGVLRGLQDLGVI

SEQ ID NO: 7880 - protein, 451 aa, Neisseria meningitidis
MKAPELLLPAGGLERMRAAYDYGADAVYAGSPRYSLRARNNEFAKLDVLEQGIKEAHERNKKFFLTVNTLPHNSKLKTFVADMEPLIAMKPDALIMADPGLIMTVREKWPEMPIHLSVQANTTNYWGVKFWQNIGVERIILSRELSMEEIAEIRQECPDIELEVFIHGALCIAYSGRCLLSGYFNHRDPNQGTCTNSCRWDYKVHNATESDAGDAQLLQGFNFEKAQEEANQNFEGINGQKRHPYADKVFLIEESNRPGEMMPIMEDEHGTYIMNSKDLRGIEVVEKLAKIGVDSLKVEGRTKSLYYVARVAQSYRKAIDDAVAGRPFDYSLLSELEGLANRGYTSGFLERHQTQDYQNYLTGHSTAKQSQYVGHVTEIDENGWATVEVKNRFAVSDSLEIIHPSGNQTIKLEQMTRKGQPVDVAPGNGIQVKIPNMQGKEKALIARVLNP

SEQ ID NO: 7881 - protein, 128 aa, Neisseria meningitidis
MRKILLDTHALLWWLLDDKKLGISARKLIENPRNAIFVSAASIWEISIKQNKGLLKLPEEFFDVLQEEDFEMLPIGLFHAKQAGSLPEIHKDPFDRMLIAQTQAEGFELMTVDEYIPQYGIRVVNASS

SEQ ID NO: 7882 - protein, 82 aa, Neisseria meningitidis
MFQANIHQAKTNLSQLIQRAEAGEIVIIAKAGKPCVQLIGIEKPARNAGRLKKFSHMENTDISRILEDDNETAALFFEESAL

SEQ ID NO: 7883 - protein, 68 aa, Neisseria meningitidis
MPSEKCFRRHFLVADMLTDDVGAHDHADVERACLTVVLSALQRLLVEVAVEAGNAASARVAADAALCL

SEQ ID NO: 7884 - protein, 791 aa, Neisseria meningitidis
MKPLQMLPIAALVGSIFGNPVLAADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYAVEGEGSGANIRGSARGIPDSSKHKYHSFLGKIAYQINDNHRIGASLNGQQGHNYTVEESYNLTASSWREADDVNRRRNANLFYEWMPDSNWLSSLKADFDYQKTKVAAVNNKGSFPMDYSTWTRNYNQKDLDEIYNRSMDTRFKRFTLRLDSHPLQLGGGRHRLSFKTFVSRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYGICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPAKNLTLRAGVYNLFNRKYTTWDSLRGLYSYSTTNAVDRDGKGLDRYRAPGRNYAVSLEWKF

SEQ ID NO: 7885 - protein, 209 aa, Neisseria meningitidis
MSETENQALTFAKRLKADTTAVHDSVDNLVMSVQPFVSKENYIKFLKLQSVFHKAVDHIYKDAELNKAIPELEYMARYDAVTQDLADLGDKPYEYGKPLPHETGNKAIGWLYCAEGSNLGAAFLFKHAQKLDYNGEHGARHLAPHPDGRGKHWRAFVEHLNALNLTPEAEAEAIQGAREAFAFYKVVLRETFGLAADAEAPEGMMPHRH

SEQ ID NO: 7886 - protein, 503 aa, Neisseria meningitidis
MFLSRYFTILYRIGILSNGFGSRRTTAQKIFLPDTKGLFILPNLPVLHPDWVYRLFSFIMPPLIFATFPMKPFAENIPHSLRGNCCDEALPPHTVDCPECGCRADVPRLDSGEAAFCPRCGHKLFRVGRHPFSAPPAYAAASLILMAFAYGMTYIEVGIPGAASVLSLPEMMRLMVFQDYGFLAEVMFVLTFGAPVLFLLLCLYVYAALIRKQAYPALRLATRVMVRLRQAMMVDVFFVSTLVAYIKLSSVAEVRFGPAFYLMFALSVMLIRTSVSVPQHWVYFQIGRLTGDNAVQTASEGKTCCSRCLYFRDSAESPCGVCGAELYRRRPKSLSISSAFLTAAVILYFPANILPIMISSNPAATEVNTILNGIAYMWDEGDRLIAAVIFSASILVPVLKIAAMSVLIASARFALPTGAKKLSHLYRITEAVGRWSMIDIFVIIILMCSFHTYAARVIPGSAAVYFCLVVILTMLSAYYFDPRLLWDKRASDGIAFNETEKHD

SEQ ID NO: 7887 - protein, 553 aa, Neisseria meningitidis; identical to SEQ ID NO: 1616

SEQ ID NO: 7888 - protein, 172 aa, Neisseria meningitidis; identical to SEQ ID NO: 3246

SEQ ID NO: 7889 - protein, 183 aa, Neisseria meningitidis
MNYCEFAASLPENTDNPNKHYHDTQYGFPIEDDNELFERLVLEINQAGLNWTLMLKKRQAFQTAFEGFDIDTVAAFDDTDRERLLADAGIVRNRLKIDAAIFNARQIQALQQEYGSFKNWLDTHHPRSKDEWVKLFKKHFKFVGGEIVGEFLMSTGYLKGAHAESCPVYRETLKYHPKWLDAI

SEQ ID NO: 7890 - protein, 213 aa, Neisseria meningitidis
MPSEKPMNRRTFLLGAGALLLTACGRKSARTHAKIPEGSTVLALGDSLTFGYGANPGESYPAQLQKLTGWNIVNGGVSGDTSAQALSRLPALLARKPKLVIVGIGGNDFLRKVPKEQTRANIAKIIETVQKENIPAVLVGVPHITLGALFGHLSDHPLYEDLSEEYGIPLFGGAWAEILGDNNLKSDQIHANGKGYRKFAEDLNQFLRKQGFR

SEQ ID NO: 7891 - protein, 102 aa, Neisseria meningitidis
MEYCEPEEASDPYATYRRANLMAGLPLFVVILVLLNIVFPLPAHPLAWLVPAGFMVLGGGFPLSLPLVALLVLTCCILAHCPPLSRLLCYPCPNHPMSKNSA

SEQ ID NO: 7892 - skipped

SEQ ID NO: 7893 - protein, 279 aa, Neisseria meningitidis; identical to SEQ ID NO: 1482

SEQ ID NO: 7894 - protein, 397 aa, Neisseria meningitidis
MYRHIEYYPGDPILSLVETFKNDPRPEKVNLSIGIYFDDEGKMPVLESVSRAETARAAAPAPSPYLPMEGLDTYRSAVQHLLFGKDNPALAQGRIVTVQTLGGSGALKVGADFLHRWFPEARAYVSDPTWDNHRGIFEGAGFEVGTYPYYDPATVGVKFDEMTAFFNTLPENSVLILHPCCHNPTGVDMSERQWDEVLHIIKTRKLIPFMDIAYQGFGGDLDSDAYAVRKAVEMELPLFVSNSFSKNLSLYGERVGGLSVVCPNKEEADLVFGQLKFTVRRIYSSPPAHGAYIAADVMNSPELYALWQNEVYMMRDRIRAMRQKLYDVLTAQIPNRDFTYFIKQRGMFGYTGLSVEQVRRLRDEFAVYLLDSGRMCVAGLNTSNTDYVARAFAEVLK

SEQ ID NO: 7895 - protein, 362 aa, Neisseria meningitidis
MNDYTQQLQGKKDYLKTLFAGLDVPEWEVYESPDKHYRMRAEFRIWHEGGEMFYAMFEKGQKASGASMIRCDRFEAASEAVNRLMPELIAAAAQSPELKKRWYAVEFLSTLSGEMLVTMIYHKRLDAEWMQAAQALQQQLDISVIGRSRGQKIVLKQDYVTETLKVGNRDFRYRQIEGSFTQPNAAVCQKMLEWACRTAEGLGSDLLELYCGNGNFTLPLSRYFRQVLATEISKTSVSAAQWNIEANRIGNIKIARLSAEEFTEAYTGKREFKRLKDGGIALTDYAFSTIFVDPPRAGIDEETLKLVSQFDNIIYISCNPETLRANLDTLAETHAVERAALFDQFPFTHHIESGVLLKKKIL

SEQ ID NO: 7896 - protein, 366 aa, Neisseria meningitidis
MAGNTFGQLFTVTTFGESHGAGLGCIIDGCPPGLELSEADIQFDLDRRKPGTSRHVTQRREADQVEILSGVFEGKTTGTPIALLIRNTDQRSKDYGNIATSFRPGHADYTYWHKYGTRDYRGGGRSSARETAARVAAGAVAKKWLKEKFGTEITAYVTQVGEKEIRFEGCEHISQNPFFAANHSQIAELENYMDSVRKSLDSVGAKLHIEAANVPVGLGEPVFDRLDAEIAYAMMGINAVKGVEIGAGFDSVTQRGSEHGDELTPQGFLSNHSGGILGGISTGQDIRVNIAIKPTSSIATPRRSIDINGNPIELATHGRHDPCVGLRSAPIAEAMLALVLIDHALRHRAQNADVQVNTPDITLSNK

SEQ ID NO: 7897 - protein, 141 aa, Neisseria meningitidis
MTQETALGAALKSAVQTMSKKKQTEMIADHIYGKYDVFKRFKPLALGIDQDLIAALPQYDAALIARVLANHCRRPRYLKALARGGKRFDLNNRFKGEVTPEEQAIAQNHPFVQQALQQQSAQAAAETLSVEAEAAESSAAE

SEQ ID NO: 7898 - protein, 661 aa, Neisseria meningitidis
MAKNNQYSESSITVLKGLEPVKERPGMYTRTDSPTHICQEVIDNASDEALGGFATAIDVQIHEDGSLSVHDNGRGIPVGLHPEEGVSVVELVFTRLHAGGKFNKKDGGSAYAFSGGLHGVGVSVTNALSTRLEVTVKREGKIHRIVFAGGDVVEPLAQVGKCAVKDSGTEVRVWPDGKYFESPNYSIPELERLLRAKAVLLPGVRVSLTRPVKGEDEAHTQTWHYPDGLKSYLTDLIADAQEAVPLFSCENYISDEHNGDFSIGEGAAFALTWLEEGSCANESYVNLIPTPLGGTHEAGLKQAVFNAVNNFINLHNLLPRGVKVQSDDVFGKTAFVLSARVLDPQFQGQTKDKLTNRDALKLVATVSGDPLELWLNQNVDFGKKIAELAIRQAQARMRSVKKIEKKKGSGVAVLPGKLTDCESEDIRENELFLVEGDSAGGSAKLARDKATQAILPLRGKVLNSFEVHPDQLFGNAEIHDISVAIGVDPHGINDHPDLSGLRYGKIAILSDADVDGSHIQVLLLTLFYRHFPKLVADGHIYVAQPPLFRVDVNAQGKSKPARKFYALDQNELDSILERLQKEGVKETAYSISRFKGLGEMNPDQLKDTTMHPDTRRLLQVQIPEGADDETRDIFVKLMGKGEAAARRAWMEREGDTAELDI

SEQ ID NO: 7899 - protein, 174 aa, Neisseria meningitidis
MLDREGYRPNVGIILINNRNEVFWGKRVREHSWQFPQGGIKPGESPETAMYRELYEEVGLLPQHVKIIGRTRDWLRYDVPNNWVRREWRGSYRGQKQIWYLLRLTGRDCDVNLRATRHPEFDGWRWHQYWAPVDEVIDFKRDVYLGALKELSSRFLRGMESYEDFAARQSSDNR

SEQ ID NO: 7900 - protein, 431 aa, Neisseria meningitidis
MLDIQLLRSNTAAVAERLARRGYDFDTARFDTLEERRKSVQVKTEELQASRNSISKQIGALKGQGKHEEAQAAMNQVAQIKTDLEQAAADLDAVQKELDAWLLSIPNLPHESVPAGKDETENVEVRKVGTPREFDFEIKDHVDLGEPLGLDFEGGAKLSGARFTVMRGQIARLHRALAQFMLDTHTLQHGYTEHYTPYIVDDTTLQGTGQLPKFAEDLFHVTRGGDETKTTQYLIPTAEVTLTNTVADSIIPSEQLPLKLTAHSPCFRSEAGSYGKDTRGLIRQHQFDKVEMVQIVHPEKSYETLEEMVGHAENILKALELPYRVITLCTGDMGFGAAKTYDLEVWVPAQNTYREISSCSNCEDFQARRLKARFKDENGKNRLVHTLNGSGLAVGRTLVAVLENHQNADGSINIPAALQPYMGGVAKLEVK

SEQ ID NO: 7901 - protein, 332 aa, Neisseria meningitidis
MKIAIYGTKSYDREHFTRANRHFGFELEFFDFMLDAKTAKMAEGAEAVCIFVNDDGSRPVLEKLAQIGVKTVALRCAGFNNVDLKAAEELGLKVVRVPAYSPESVAEHTVGLMLTLNRRIHKAYQRTRDANFSLEGLTGFNMYGKTAGVIGTGKIGIATMRILKGFGMNLLAYDPFCNPEAEKIGGKYVDLDELYARSDIITLHCPATPENHYMLNEAAFDKMKDGVMIINTSRGGLIDSAAAIEALKRRKIGALGMDVYENERELFFEDKSNDVITDDVFRRLSSCHNVLFTGHQAFLTEEALGNISEVTLSNIREVGQTGDCGNAVRADG

SEQ ID NO: 7902 - protein, 358 aa, Neisseria meningitidis
MKPSILEKLQQLSDRLEEVTHLLGQPEATSDMDNYRKLTREHAELTPVVEVFQNYRLAQSDLADAEEMLSDPEMKDFAAEEIEAAKAKIGELDTELQKLLLPKDADDDKNIFIEIRAGTGGDEAALFAGDLLRMYSRYAERNRWQVEIVSANESELGGYKEVIARIVGLGAYSRLKFESGGHRVQRVPATESQGRIHTSACTVAVMPEADELEDIELNPADLRIDTFRASGAGGQHINKTDSAVRITHLPTGMVVECQDGRSQHANKAQAMKVLAARLNDAQKREAQAKEAAERKSLIGSGDRSERIRTYNYPQGRVTDHRINLTLHKLDFVMDGDLEEITNALIAEHQAELLAAMGD

SEQ ID NO: 7903 - protein, 256 aa, Neisseria meningitidis
MNFTDTHCHLADPALRENLPHILTAARKVGVKRFIVPATRPQDWQDVADLAEMPSEHGQIRIALGIHPWFSDGIAERDFVRLETMLAHYPQAWVGEIGLDFYDKTQTSQQRERQIQVFVRQLEIAQTLRRRVIIHNLKATADIAAAVKQTGFAQGGIVHAFSGSAEEARVLTKLGFKIGIGSLLLNPNARKVRDTLKALNDGDFVLETDSPFMLKKEINTPANIPGIAKIAAEIRGTCVEEIAKVTERNADALLGR

SEQ ID NO: 7904 - protein, 333 aa, Neisseria meningitidis
MMSMKQKIFVLYTGGTIGMTQSSEGLRPDTALVSQALSPFSDGLDFEWHVCNPLIDSSSVTLQHWRDWLDIIADKLPSCDGILILHGTDSMAYTANLLALALQGLGKPIVLTGSQWPYAAENSDAPRNLSTAVAAFSLKLKQTVIAFDGKLYPAVGSSKVSTETAAGFDNPHFGTLAEWDETRGWHNLRLPSQDAAAVSDGLKIRYPDPQAKIAVRTLIPGFAVQELADGLGQLPAQALILQSYGHGNTPADEGFIRAVRDFARQGKLLLNISQVRQGKTAAVYAQGNAFRNSGIINGGKCNLETATALMTLAVSQGWGKEDVYKELVRLKLV

SEQ ID NO: 7905 - protein, 227 aa, Neisseria meningitidis; identical to SEQ ID NO: 722

SEQ ID NO: 7906 - protein, 444 aa, Neisseria meningitidis
MAKKYFGTDGVRGEVGQFPITPDFVLKLGYAAGQVLVQHDTDQKPTVLIGKDTRISGYMLEAALVAGFTAAGVNVVQTGPLPTPGVAYLTRALRLSAGVMISASHNAYSDNGIKFFAEGGVKLSDEVELEIEAKIDGEMKTQPSARLGRARRISGADDRYIEFCKSTFPSHSDLRGLKLVVDTANGAGYGVAPKVFHELGAQVVSIGNEPNGYNINEKCGATYTKTLQAAVLQHEADYGIALDGDGDRLMMVDKNGQVYDGDSLIYVIAKARAREGINIGGVVGTVMTNMAMEIALKEQGVDFCRAKVGDRYVLEQLNQRGWLIGGEASGHILCMDKHNTGDGIISALQVLAALQTLNQDLATVCADWQPYPQTMINVRIQKGQQWQEASKDVLAEVEKELEGKGRVVLRASGTEPVVRVMVEARQADWAREGAERIAAAIGGI

SEQ ID NO: 7907 - protein, 285 aa, Neisseria meningitidis
MARHVWQAGRFEIGLDKPKIMGIVNLTPDSFSDGGVYSQNAQTALAHAEQLLKEGADILDIGGESTRSGADYVSPEEEWARVEPVLAEVAGWGVPISLDTRRTVIMEKALALGGIDIINDVAALNDEGAVELLARQADTGICLMHMQGLPKTMQINPKYQDVVGEVARYLKARSAECIAAGIAPQRIILDPGFGSGFGKPLQHNIALMRHLPELMAETGFPLLIGVSRKSTIGELTGEANAAERVHGSVAAALASVARGAQIVRVHDVKATADALKVWEALGINL

SEQ ID NO: 7908 - protein, 297 aa, Neisseria meningitidis
MIIVMSRRAAEADIAGVVAFIRSRGLREHISHGDERTVIGAIGDDRVLSVREVQTLPEVEKAVRILDTWKTVSRENRAEDSRVAAKGVAFGGGETVRIAAEPSVWRNADAVFLDPFFTSANLYDTSSADEGRGRCRRLAEQTASAHDAGKPVLVRVRNVRHVEAALNAGADILYLGGGLMSDLAVLNEAGNLNIPLVLCKDKHHSAEDWLNAAEYVVSRGNRHLILGESGVLNHTKGHPYRLDVESIVKVRQISHLPVIANITGLWNRDMPQEILYGLAKAAGACGIVGTCFEKSGG

SEQ ID NO: 7909 - protein, 704 aa, Neisseria meningitidis; identical to SEQ ID NO: 3636

SEQ ID NO: 7910 - protein, 494 aa, Neisseria meningitidis
MNMKYKDLRDFIAMLEQQGKLKRVAHPISPYLEMTEIADRVLRAEGPALLFENPIKPDGTRYGYPVLANLFGTPERVAMGMGADSVSKLREIGQTLAYLKEPEPPKGIKDAFSKLPLLKDIWSMAPNVVKNAPCQEIVWEGEDVDLYQLPIQHCWPEDVAPLVTWGLTVTRGPHKKRQNLGIYRQQLIGKNKLIMRWLSHRGGALDYQEFRKLNPDTPYPVAVVLGCDPATILGAVTPVPDTLSEYQFAGLLRGSRTELVKCIGNDLQVPARAEIVLEGVIHPNETALEGPYGDHTGYYNEQDYFPVFTVERITMRENPIYHSTYTGKPPDEPAVLGVALNEVFVPLLQKQFPEITDFYLPPEGCSYRMAVVSMKKQYAGHAKRVMMGCWSFLRQFMYTKFIIVVDDDVNVRDWKEVIWAVTTRMDPVRDTVLVENTPIDYLDFASPVSGLGGKMGLDATNKWPGETDREWGRVIKKDPAVTAKIDGIWEELGL

SEQ ID NO: 7911 - protein, 326 aa, Neisseria meningitidis
MELQQRTLTIGLGNDIAVQTEGVGFIRGQLVADHAEINSVFKVVVKAALIVVKTLFADGYPHAIFQRFLMPDNRNRQHRADKAVGLVGIADDAEIRIAFCLISNAFFFTELIIGIGCGKADCGHFFVVFAAGSASVHKVSDFQNEFAVKPFAGKQHPHQYIGNHAGINRPPIISPQPCQQSGKRPVDYKKYAPNLRYPAGIAHGFFRQVGLLQPRKFFNHRLPGKQAAAEHRQHHQIDEDGIPIHRIMPPEHQYCGKKQCNKQSRITLLGQFGSQGAQQPQPAHRRRQPNKPARLPAVYSGLTKTSTALPRLAVLSAASSPCPDFC

SEQ ID NO: 7912 - protein, 81 aa, Neisseria meningitidis
MTEQEIYRLLRDTLTELFEIEPERITPDTNLYEDLEIDSIDAIDLIDRIKRETGRKLQAEDFRNVRTVNDVVQAVLKIQAG

SEQ ID NO: 7913 - protein, 86 aa, Neisseria meningitidis
MNDLENQIKQLIIDSLALEDITAADIGSEDALFGDGGLGLDSVDALELGLAVQKHFGFRLDGEQENLREHFANVKTLAAFVKSRQA

SEQ ID NO: 7914 - protein, 252 aa, Neisseria meningitidis
MDKLDYCRRFFATWLGFVIFGVGGIMMKLVLLPYTLNGTSGSVARQLAARRIIGTSWRLFVAYLKWSGVLEVSFKGVEKLNRPGQLILANHPSLLDVVLLVGHVPEMNCIVKKDLQHNPAMSSQIKGAGYIPNEESEAMLETVKAVFDSGQSLLVFPEGTRTGWDGRVKMHRGAVSLGLRYAEVITPVCIKMNPPNFKKGQPWYRIPPKRIRYEITVGDDILPQDWLAEKPLPIAARRLNEYLQDYFTRKTI

SEQ ID NO: 7915 - protein, 121 aa, Neisseria meningitidis
MSEQTALAVCADGVETALAEAASLLEEGCGSVLVLAADDPLPEGYAVSATRAPFAYALAMVLTKGTRYSLTLSASDDMPSEAGMLPEAYWSGLEWVRFLLNGSRECRRVYRNREWLWQRNG

SEQ ID NO: 7916 - protein, 121 aa, Neisseria meningitidis
MGGGNVPSRVAYQTRRLTQTAALHSGQERQFRPDIGQTVGKIRTFRPFCPLGHIAHFAARNPPGGDVEVEPANNRRHSFFQKFTLCRILTKAYPPDNAEIQTHFCPLSPTTPPLGKPPELA

SEQ ID NO: 7917 - protein, 166 aa, Neisseria meningitidis
MDTLPECPITNTASLLPHSGRMVLIDRITRYGDDFVEAGAQVSPNHILLLDDKLPYTAFIELMAQAVGAYAGIQARKNARSVRLGFLLGTRKLEIFAQSVPIGTHLLATAHMSIQDAGGMGVFDCELRWTDAPETSSETLPSDGILARASLNVYSPEHPAGTTDAV

SEQ ID NO: 7918 - protein, 242 aa, Neisseria meningitidis
MTETVLITGSNRGIGKAVAFGLAEDGFDIAVHCRSRRDEAEAVAEEIRALGRNARVLQFDVSDREACREILTADIEANGAYYGVVLNAGLTRDNTFPAFSDDDWDVVLRTNLDGFYNVLHPLVMPMIRRRKAGRIVCMASVSGLTGNRGQVNYSASKAGIIGAAKALAVELAKRKITVNCVAPGLIDTDIIDENVPVEEILKAVPAALMGLPEEVAHAVRFLMDEKAAYITRQVIAVNGGLC

SEQ ID NO: 7919 - protein, 416 aa, Neisseria meningitidis
MLNTRRVAVTGIGGITAFGRDWQSIQAAFKAEKNAVKYMDWHERFPELEAQLGAPIENYAPPKHWTRKQLRSMGRVSYLCVDAAEQALADAGLLGDESITDGRMGVACGSSSGSTKDIGDVGELLLTGTSRNFSANTYVRMMPHTTAANIGIFFGLKGRIIPTSSACSSGSQGIGYAYEAIKYGLTDMMLAGGGEEFFPSEVYVFDSLYAASRRNGEPEKTPRPYDANRDGLVIGEGAGIFVLEELEHAKRRGAIIYAELVGYGANSDAYHISTPRPDAQGAILAFQTALQHANLAPEDIGWINLHGTGTHHNDNMESRAVAAVFGNNTPCTSTKPQTGHTLGAADAIEAAFAWGIADRQSNPEGKLPPRLWDGQNDPNLPAINLTGSGSRWETEKRITASSSFAFGGSNCVLIIG

SEQ ID NO: 7920 - protein, 252 aa, Neisseria meningitidis
MKKVSVLIVAKNEANHIQECIESCRFDKEVIVIDDYSTDNTAEIAEGLGAKVFRRHLNGDFGAQKTFAIEQAGGEWVFLIDADERCTPELSDEISKIVQTGDYAAYFVERRNLFPNHPATHGAMRPDSVCRLMPKKDSSVQGKVHETVQTPYPKRRLKHFMYHYTYDNWEQYFNKFNKYTSISAEKYREQGKPVRFVRDIILRPIWGFFKIYILNKGFLDGKMGWIMSVNHSYYTMIKYVKLYYLYKSGGKF

SEQ ID NO: 7921 - protein, 354 aa, Neisseria meningitidis
MEKEFRILNIVSAKIWGGGEQYVYDVSKALGLRGCTMFTAVNKNNELMHRRFSEVSSVFTTRLHTLNGLFSLYALTRFIRKNRISHLMIHTGKIAALSILLKKLTGVRLIFVKHNVVANKTDFYHRLIQKNTDRFICVSRLVYDVQTADNPFKEKYRIVHNGIDTGRFPPSQEKPDSRFFTVAYAGRISPEKGLENLIEACVILHRKYPQIRLKLAGDGHPDYMCRLKRDVSASGAEPFVSFEGFTEKLASFYRQSDVVVLPSLVPEAFGLSLCEAMYCRTAVISNTLGAQKEIVEHHQSGILLDRLTPESLADEIERLVLNPETKNALATAAHQCVAARFTINHTADKLLDAI

SEQ ID NO: 7922 - protein, 56 aa, Neisseria meningitidis
MQQTTKLYSFIGKKHPEFILQNKKIPISPDITQPIGKVLQRLPRLVLPRQVLCYNV

SEQ ID NO: 7923 - protein, 445 aa, Neisseria meningitidis
MSNHTSWSSKIGFVLAAAGSAIGLGAIWKFPYTAGTNGGAVFFLLFLIFTILVALPVQLAEFYIGRTGGKNAVDSFRVLRPGTQWLWVGRMGVAACFILLSFYSVVGGWVLNYVVHSFTGAVHTGADFEALFGATISNPAGSLSYQALFMLITVWVVKGGISDGIEKANRYLMPGLFILFIALAIRSLTLPGAMEGVSFLLKPNWSYFKADTMITALGQAFFALSIGVSAMITYASYLGKDQDMFRSGHTIMWMNLLVSLLAGLVIFPAVFAFGFEPSQGPGLIFIVLPAVFMKMPFGTVLFAVFMLLVVFATLTSAFSMLETVIASTIRQDERKRKKHTWLIGTAIFIIGIPSALSFGVWGEFKVFGKTIFDLWDYVISAVIMPIGALSVSIFTAWIQDKQSVLKDAGAGSTVPRAVLLLWLNTLRYLAPIAIIIVFINSLDIL

SEQ ID NO: 7924 - skipped

SEQ ID NO: 7925 - protein, 264 aa, Neisseria meningitidis
MKAYLDLMRHVLDNGTDKSDRTGTGTRSVFGYQMRFDLGKGFPLLTTKKLHLRSIIHELLWFLKGDTNIKYLKDNNVSIWDEWADENGDLGPVYGYQWRNWPAPDGRHIDQIANVLEQIKKNPDSRRLIVSAWNPALVDEMALPPCHALFQFYVADGKLSCQLYQRSADIFLGVPFNIASYALLTMMMAQVCGLEAGEFVHTFGDAHLYRNHFEQAALQLEREPRALPVMKINPEVKDLFSFKFEDFELEGYDPHPHIKAAVSV

SEQ ID NO: 7926 - protein, 444 aa, Neisseria meningitidis
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMTEAQLAALIELKEVRRERVATYAKEQGLQYFEKQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 7927 - protein, 259 aa, Neisseria meningitidis
MKLVRPQKISDQVLSVLEERIAEGVYAEGGKIPPERVLAEEFGVSRPSVRSALNVLVARQVLEARQGDGYYVSVKPQQDFLQSWQELLGKHSNWEQDVFDFSCHIEGCMAALAAERRTDADLKRIGFWLEKFEEACESGNLEHQSEADVSFHQTIADAAHNLLFSHLSGGLLKMLYRQTRSSLIYLNQEEDPRPKLMAQHRVLYEAISNRRPGEASEAAKAHLNYVASSILKDREYQSRNRHADTLAQNDLKRVQDWAV

SEQ ID NO: 7928 - protein, 99 aa, Neisseria meningitidis
MQRCFNWFDHYCRRLEKYFRRCSIMETWVQNYTAIGGSLYLTAAAALLPIVFFFAALTVLKLKGYQAGLYTLLIALAVAVFGFGMPTGMAVSSLPPQPH

SEQ ID NO: 7929 - protein, 321 aa, Neisseria meningitidis
MSYTQLTQGERYHIQYLSRHCTVTEIAKQLNRHKSTISREIRRHRTQGQQYSAEKAQRQSRTIKQRKRQPYKLDSQLIQHIDTLIRRKLSPEQVCAYLCKHHRITLHHSTIYRYLRQDKSNGSTLWQHLRICSKPYRKRYGSTWTRGKVPNRVGIENRPAIVDQKSRIGDWEADTIVGKGQKSALLTLVERVTRYTIICKLDSLKAEDTARAAVRALKAHKDRVHTITMDNGKEFYQHTKITKALKAETYFCRPYHSWEKGLNENTNGLIRQYFPKQTDFRNISDREIRRVQDELNHRPRKTLGYETPSVLFLNLFQPLIH

SEQ ID NO: 7930 - protein, 467 aa, Neisseria meningitidis; identical to SEQ ID NO: 3448

SEQ ID NO: 7931 - protein, 1067 aa, Neisseria meningitidis
MAKFFIDRPIFAWVISIFIIAAGIFGIKSLPVSQYPSVAAPTITLRATYPGASAQVMEDSVLSVIERNMNGVEGLDYMSTSADSSGSGSVSLTFTPDTDENLAQVEVQNKLSEVLSTLPATVQQYGVTVSKARSNFLMIVMLSSDVQSTEEMNDYAQRNIVPELQRIEGVGQVRLFGAQRAMRIWVDPKKLQNYNLSFADVGSALSAQNVQISAGSIGSLPAVRGQTVTATVTAQGQLGTAEEFGNVILRANTDGSNVYLKDVARVGLGMEDYSSSTRLNGVNTTGMAVMLSNSGNAMATAKAVKERMATLEKYFPQGMSWKTPYDTSKFVEISIEKVIHTLIEAMVLVFVVMYLFLQNIRYTLIPTIVVPISLLGGFAFISYMGMSINVLTMFAMVLVIGIVVDDAIVVVENVERIMAGEGLPPKEATKKAMGQISGAVIGITAVLISVFVPLAMFSGATGNIYKQFALTMASSIAFSAFLALTLTPALCATMLKTIPKGHHEEKKGFFGWFNKKFNSWTHGYEGRVAKVLRKTFRMMVVYIGLAVVGVFLFMRLPTSFLPTEDQGFVMVSVQLPAGATQERTNATLAQVTQLAKSIPEIENIITVSGFSFSGSGQNMAMGFAILKDWNERTAPGSDAVAIAGKLTGMMMGTLKDGFGIAVVPPPILELGNGSGLSINLQDRNNTGHTALLAKRNELIQKMRASGLFDPSTVRAGGLEDSPQLKIDINRAAAAAQGISFADIRTALASALSSSYVSDFPNQGRLQRVMVQADEDARMQPADILNLTVPNKSGVAVPLSTIATVSWENGTEQSVRFNGYPSMKLSASPATGVSTGQAMAAVQKMVDELGGGYSLEWGGQSREEAKGGSQTLILYGLAVAAVFLVLAALYESWSIPLAVILVIPLGLIGAAAGVTGRNLFEGLLGSVPSFANDIYFQVGFVTVMGLSAKNAILIIEFAKDLQAQGKSAVEAALEAARLRFRPIIMTSFAFILGVVPLYIAGGASSASQRAIGTTVFWGMLIGTLLSVFLVPLFYVVVRKFFKETAHEHEMAVKHAAEAGITGSDDSQH

SEQ ID NO: 7932 - protein, 412 aa, Neisseria meningitidis
MAFYAFKAMRAAALAAAVALVLSSCGKGGDAAQGGQPAGREAPAPVVGVVTVHPQTVALTVELPGRLESLRTADVRAQVGGIIQKRLFQEGSYVRAGQPLYQIDSSTYEAGLESARAQLATAQATLAKADADLARYKPLVAAEAVSRQEYDAAVTAKRSAEAGVKAAQAAIKSAGISLNRSRITAPISGFIGQSKVSEGTLLNAGDATVLATIRQTNPMYVNVTQSASEVMKLRRQIAEGKLLAADGVIAVGIKFDDGTVYPEKGRLLFADPAVNESTGQITLRAAVPNDQNILMPGLYVRVLMDQVAVDNAFVVPQQAVTRGAKDTVMIVNAQGGMEPREVTVAQQQGTNWIVTSGLKDGDKVVVEGISIAGITGAKKVTPKEWASSENQAAAPQSGVQTASEAKPASEAK

SEQ ID NO: 7933 - protein, 210 aa, Neisseria meningitidis
MRKTKTEALKTKEHLMLAALETFYRKGIARTSLNEIAQAAGVTRGALYWHFKNKEDLFDALFQRICDDIENCIAQDAEDAEGGSWAVFRHTLLHFFERLQSNDIYYKFHNILFLKCEHTEQNAAVIAIARKHQAIWREKITAVLTEAVENQDLADDLDKETAVIFIKSTLDGLIWRWFSSCERFDLGKTAPRIIGIMMDNLENHPDLRRK

SEQ ID NO: 7934 - protein, 85 aa, Neisseria meningitidis
MVLLLIVNKYWKVNDMKNEIQKNMDKYNPWHEDDFESYEDIARDVSLTTDKTFIEHYLLEVYSEENGHFDQENVHAMIEEIKNAI

SEQ ID NO: 7935 - protein, 522 aa, Neisseria meningitidis; identical to SEQ ID NO: 136

SEQ ID NO: 7936 - protein, 1069 aa, Neisseria meningitidis
MFYLYQSNRLETLAALFARIQKVKPLKSALQPEQIIVQSQGMRRYLNTCLARDLGVAANLSFSLPAGLTWKLMKKLIPGIPELSPFAPEVMRWRLLDLFRSEAFRNTAEFEDVRNVLQDYLGSGESADYQLAGQLADIFDQYLVYRPQWIDAWQQGRRLGLGDDEIWQSKLWRYLDDGRQSAPHRVALWEKLLESLSSDKLPERYFVFGISTMAPMYLQLLHKLSEHCDVFVFALNPSGMYWGNVIEAAQILKGGGDPDLTQAGHPLLASLGKQGRDFFDFLNEMEIEGETPVFEEGGRDTLLHALQTDIQNLKMPSEMAGSVNTGDGSIRIVSAHSPLRELQILKDKLLKILHEHPDWQPHDIAVLTPNIESYTPFIEAVFGQAQPGAQALPYSVSDVKISRRQPLFHALSCLFDLLESRFEVDKVLVLLETAPVLRRFGLTEDDLPLLHDMVADLNVHWGLDGEMRGGTDQLFTWKQAVERMILGWMLPKGGNPMWQDVSAWYADVNQTAMFGRFAAFLETLTDIVRIWRQPATVGEWVARCRDLLETLFQAEADDQKSVQNLENEWVKWQAETELAQFSGQLPPHTVIRHIRRFLDSESEAGFLRGGITFCSMVPMRSLPFKVICLLGLNDGDFPRNTKAAVFDLIAKHPAKGDRARRDDDRYLFLEALISAREILYLSYIGRDIRKDEELAPSSLLGELIDTVAAMAGIGSRQLAQNLIEQHPLQAFSRRYFQEGGRSDGIFGTRTDYAAALGQTPEPPQPFFDQPVENAEPVAEIGQDEFIRFWRNPVKVWLQQQLAWSEPHIGEAWEPAEPFEPQHADQIAEIYIEARCEGRDFAQTAARIGAESLLPSGELGRLWQQDFQTAAKQIDTAVLNSPKLPPLSYAIPSDGQILKGSLGNLYRCGQVFYAYGKPNAPQRIAFLLEHLIFCAVMPSEAEMRQTFIVQSGETEILAEIAQDRALQLLSEWMAFFNIGQNRPLPFFAKTSLATAEAFAQKQDWEAALKKAQTAYHGSKVSKGQKDYTEVALVFGNASQNPLEQPLFENLVRLLADTLAAAEKKEEAGEA

SEQ ID NO: 7937 - protein, 469 aa, Neisseria meningitidis
MDTQIKTEADNQSNRRYLTVWRWHFYAGLLVMPFLTLLAVTGLGMLLFANITGKEGERIHVVPQATVQPLSVQAEAARSAVNPETSSVVQYIAPRADDMVAVFRVNNEGKATMVAVDPYTAKVVSTMPRNQGWYYTMDEIHSDMMLGAAGDYLLETAASLTIIMVVSGLYLWWVKRRGIKAMLLPSKGRARSWWRNLHGTFGTWVSLILLLFCLSGIAWAGIWGGKFVQAWSQFPAGKWGVEPNPVSVVPTHGEVLNDGKVKEVPWVLELTPMPVSGTTVGKDGINPDEPMTLETVDRFAREIGFKGRYQLNLPKGEDGVWTLSQDSMSYDMISPFADRTVHIDQYSGKILADIRFDDYNPFGKFMAASIALHMGTLGWWSVLANVLFCLAVIFIGISGCVMWWKRRPTGAVGIVPPAQKVKLPVWWMMALPLLAIALLFPTSLLAIAVIWLLDTLLLSRIPVLRRWFK

SEQ ID NO: 7938 - skipped

SEQ ID NO: 7939 - protein, 365 aa, Neisseria meningitidis
MNTTSQFTSNFWNIYIAVIVLLSFIALAWLLLSQNVVKRPKKGEEVQTTGHEWDGIAEYDNPLPRWWFWLCVLTWLFGIGYLVMYPGVGDYKGLLKWTSHNQYEKEVKKADEQYGKLYAKFADMPIEKVAKDPQAKQIAQNLFNTYCIQCHGSDAKGSKGFPNLTDSDWLWGGDPDKIHETIEKGRVATMPAWGPALGEEGVKDVAHYVMSLSKPEGQYDEERAARGQALFSGPPANCFTCHGDKGQGIQGLGPNLTDDVWLWGGTQKSIIETITNGRSSQMPAWGHFLDKDKLHIMTAYVWGLSDKDGKAPVKKAEPAPTPAPAAEPAASAPAEAAQAVSEAKPAAAEPKAEEKAAPAAKADGK

SEQ ID NO: 7940 - protein, 203 aa, Neisseria meningitidis; identical to SEQ ID NO: 2296

SEQ ID NO: 7941 - protein, 481 aa, Neisseria meningitidis
METLMDTQTYNYKVVRQFAIMTVVWGIVGMLVGVIVAAQLFAPALDLSNIGPWFHFGRLRPLHTNAVIFAFGGCGLIGTSYYVVQRTCNTRLFGGWLPAFTFWGWQAVIVAAVVSFPMGWTQGKEYAELEWPIDILITLVWVAYAIVFFGTIAKRKIKHIYVANWFYGGFILAVALLHIVNNISIPAGLMKSYPVYSGAIDAMVQWWYGHNAVGFFLTAGFLGMMYYFVPKQAARPVYSYRLSVVHFWALIFTYMWAGPHHLHYTALPDWTQSLGMVLSLILFAPSWGGMINGIMTLSGAWDKLRTDPILKFLIVSLSFYGMSTFEGPMMSIKTVNALSHYTDWTVAHVHAGALGWVGFVTIGSVYYMIPRLFGKEQMHSTKLVEAHFWIATIGVVLYIAAMWIAGVMQGLMWSSLNDDGTLTYSFVESVKRTMPYYVIRFAGGLLYLSGMCIMAYNVYRTAIGGKAVDAEIPAVSQTQHH

SEQ ID NO: 7942 - protein, 582 aa, Neisseria meningitidis
MIHYKITPSPLDHEWHILLTFTQDDDLPIEISLPNWVPGSYLIRDFSRHITSIHASCNGTSMPLEQIAKNRWHAAAVRGEWQIRYTVYAFDLSVRGSFLTTERGFFDGSCLFLKVEGTETLPHRLELTGIPSEWRIATTLPETGRFVFQAASYAELIDRPVEMGLIEFLDFEAAGIPHTIALSGIYPDFDRNRLVSDIKKICETELAVFSSPAPFQKYLFLLHVGDHIYGGLEHTDSTALLADRHSLPPYGMTDADDTYTTLLGLFSHEYFHAWNVKSIKPAAFVPYDLDKENYTEQLWAFEGITSYYDDLFLARSRTISPESYLNLLAQGITRVQQTRGRLRQTLAESSFTAWNKFYKPDENSPNAIVSYYQKGALAALCLDLIIRNRSNGRHSLDTLMDKLYREWRDTHSGIPEKHWQIRCQEITGLDLEDFFQKALYSTEDLPLAECLATAGVGLTFLPLPRQHGGGYAEHICPVPSAGDFGARFKQNTDHIVLTHVFNGGSAESAALCPQDKIIALDGYACTDFTAQWARYHVNAKINIHFFRAGILRQTVLTVQAAAADTAILHITDRNLLDNWLFG

SEQ ID NO: 7943 - protein, 142 aa, Neisseria meningitidis
MAILKLDEHLYISPQLTKADAEQIAQLGIKTVICNRPDREEESQPDFAQIKQWLEQAGVTGFHHQPVTARDIQKHDVETFRQLIGQAEYPVLAYCRTGTRCSLLWGFRRAAEGMPVDEIIRRAQAAGVNLENFRERLDNARV

SEQ ID NO: 7944 - protein, 144 aa, Neisseria meningitidis
MAFGSMNSGDDSPMSDINVTPLVDVMLVLLIVFMITMPVLTHSIPLELPTASEQTNKQDKQPKDPLRLTIDANGGYYVGGDSASKVEIGEVESRLKAAKEQNENVIVAIAADKAVEYDYVNKALEAARQAGITKIGFVTETKAQ

SEQ ID NO: 7945 - protein, 220 aa, Neisseria meningitidis
MNLKLVFESGDPVLIGVFVLMLLMSIVTWCLVVLRCIKLYRARKGNAAVKRHMRDTLSLNDAVEKVRAVDAPLSKLAQEALQSYRNYRRNEASELAQALPLNEYLVIQIRNSMAQIMRRFDYGMTALASIGATAPFIGLFGTVWGIYHALINIGQSGQMSIAAVAGPIGEALVATAAGLFVAIPAVLAYNFLNRGTKILTQDLDAMAHDLHVRLLNQKDS

SEQ ID NO: 7946 - protein, 280 aa, Neisseria meningitidis
MDKERILTPAVVFSVALLHLAMVALLWQAHKLPVIESGNVIEFVDLGDFGGGDGAPEGAGAPAAPEPQPVPEPPKPVEPPKPVLKPVVTKKADADIQQPKEEPKPEEKPKPEEKPKPEPKPEAKPVPKPAEKPVEKPSEKPAEHPGNASAKADSEQGNGEDKGTGTKGDGTGRGEGSGKGSGGVKGEHGEGAGSSKGNPLRANGSIPRPAYPTLSMENDEQGTVVLSVLVSPGGHVESVKIVKSSGFSRLDNAARKAAQNGHFQANAWTEFKVPVKFELN

SEQ ID NO: 7947 - protein, 212 aa, Neisseria meningitidis; identical to SEQ ID NO: 940

SEQ ID NO: 7948 - protein, 266 aa, Neisseria meningitidis
MKKTIFNITKMDCPSEEQLIRMRLKDVSDIYELQFDIAGRCLTVYHDNQDTTILQVLEPLNFDSHIISTEVIVDKIVFNKPDEHLEKRLLYQVLMINFVFFIIECSVGIFANSMGLIADSLDMLADSFVYILALSAIGMTLAYKKRVAFLAGITQIILALFGVIEVIRRFIGAEQLPNYQLMIGTAFLALIANWLCLYLLSKNQNKEIHIKASMIFTSNDIIINIGVIAAGALTLLTHSSYPDLIIGMIVFVIVLFGARNILKLAK

SEQ ID NO: 7949 - protein, 167 aa, Neisseria meningitidis
MDAFDFFMQGNFKKIATEQGLDRKYFIFQYIVCNLSAISSFCLMKIIHTYTILYILIAVIGIINGFLLRSKVLSIVKNKQKFLSDMFPLEMPFFFVEYKIPILARFLNRGMKWLYLPSFFCLVAICFSIYILNEEGGWMPYFACYWFGLCYPVSTYYVFLSRDYKHI

SEQ ID NO: 7950 - protein, 213 aa, Neisseria meningitidis
MKLYIYDHCPFCVRARMAAGLFGADVEEAVLANDDEATPIGMIGAKQVPVLQKEDGSFMGESLDIVRHFDREDRLKDEVRPEIRAWLDKVGGYNDKLVQPRVIKIGLPEFATPEAVKYFTDKKEKSIGSFSANLNKTAQYLERINADLQELENLMDGASDGINGGIGMEDILVFPVLRNLTVVRGIEWPQKVMGYLMTMSEKSGVPLYFDRAL

SEQ ID NO: 7951 - protein, 737 aa, Neisseria meningitidis; identical to SEQ ID NO: 1402

SEQ ID NO: 7952 - skipped

SEQ ID NO: 7953 - protein, 467 aa, Neisseria meningitidis; identical to SEQ ID NO: 3598

SEQ ID NO: 7954 - protein, 475 aa, Neisseria meningitidis; identical to SEQ ID NO: 3602

SEQ ID NO: 7955 - protein, 117 aa, Neisseria meningitidis
MFTTNDLRHFLEGLAILFSIGYWGTMLLLLWFLVRFAYKKPKRNPGKILSGSLTAAAILMLFVWIIPKQFGPIKEEIQAQEEWDRKYKEAEAVFNEQCKTAGERFTRRRTMWKGLCC

SEQ ID NO: 7956 - protein, 136 aa, Neisseria meningitidis
MGNTAMWMSCNPTIPILFGIQVKIFPLNQIFNHIHPARYAVTFENNVDSKLRRHWVAGATIRIIDRQTDEVIAKKTIYVFEKGLDGTGGARMPWKFAILCNKERLTSSEPLSDFVLSVLKPYILRPLYIASLRRDD

SEQ ID NO: 7957 - skipped

SEQ ID NO: 7958 - protein, 96 aa, Neisseria meningitidis; identical to SEQ ID NO: 6701

SEQ ID NO: 7959 - protein, 65 aa, Neisseria meningitidis; identical to SEQ ID NO: 6700

SEQ ID NO: 7960 - protein, 94 aa, Neisseria meningitidis; identical to SEQ ID NO: 6699

SEQ ID NO: 7961 - protein, 92 aa, Neisseria meningitidis; identical to SEQ ID NO: 6698

SEQ ID NO: 7962 - protein, 96 aa, Neisseria meningitidis
MNKNERDFFYISNSDLDKLSESYPDRPLSYVFYCYLKETGLLKNFSMDKCHNFFNRINFNESCFEIKFKDDSFFIIGNGKIDVSDSNNFFSVSFEC

SEQ ID NO: 7963 - protein, 501 aa, Neisseria meningitidis
MYALSEKYNDNGFKAYKVLGEGGGIHTEYNYKFDKSLNLNVLESSTGARSLEKVPVKVTASVSRAAVLSGVGKLARLGAKLSTRAVPYVGTALLAHDVYETFKEDIQAQGYQYDPETDKFVKGYEYSNCLWYEDKRRINRTYGCYGVDSSIMRLMSDDSRFPEVKELMESQMYRLARPFWNWHKEELNKLSSLDWNNFVLNRCTFNWNGGDCLVNKGDDFRNGADFSLIRNSKYKEEMDAKKLEEILSLKVDANPDKYIKATGYPGYSEKVEVAPGTKVNMGPVTDRNGNPVQVVATFGRDSQGNTTVDVQVIPRPDLTPGSAEAPNAQPLPEVSPAENPANNPNPNENPGTSPNPEPDPDLNPDANPDTDGQPGTRPDSPAVPDRPNGRHRKERKEGEDGGLLCDYFPEILACQEMGKPSDGMFHDISIPQVIDDKTWSSHNFLPSNGVCPQPKTFHVFGRQYQASYEPLCVFAEKIRFAVLLAFIIMSAFVVFGSLKGK

SEQ ID NO: 7964 - protein, 96 aa, Neisseria meningitidis
MPLLAGLIPLLGILLKMLIVRIILATGLTFVTYAGYLIALEKFKDYTSNAINSMPSDILNLLLISGFGQGLGYLFGAFSFFIGMHAFKKLTFVFPG

SEQ ID NO: 7965 - protein, 361 aa, Neisseria meningitidis
MIYLFTGNMGTGKTSRVVSMILNNEDGLFKMKLEDGTEVDRPLYFCHIDGLDKRQFKAHELTEEQIMSAPLRDVIPEGAVLIVDEAHYTYPVRAAGRPVPPYIQELTELRHHGHTVILMTQHPSQLDIFVRNLVSKHVHLERKAIGMKQYYWYKCVTSLDNPAGVSGVEVASWKPPKEAFKYYKSASQHQKFKKKVPWAVWALIAIVGFVGWKSYGIFKVYSKATDSRIEQEAQKESVVQTMTEQPASSEEMPLKNSDNLKPEDFVPTLPEKPESKPIYNTVRQVKTFEQIAGCIDGGKSDCTCYSNQGTPLKEITKIMCKEYVKNGLPFNPYKDEQQRTEQVEQSAKADKPQVLVMGGKP

SEQ ID NO: 7966 - protein, 316 aa, Neisseria meningitidis
MYLGIDVSKLTIDCCLIVDGQNYQKKFQNNKGGFEQLINWLQSHKVNDKLHCVCEATGTYYEALAEYLYSRYTITVENPRKIKGYAIAELQRSKTDTQDAKLIAQYCQDRKHKLKAWKPPTKEQKQLQEIARYLDYLKQQRATEKAKQHEAPDYIKSHIQTTISNLTAQIQIVKKQLLQFYKDNPSYNNLRKRLKTITGIGEQATAVLLSTYKRHEFKNARQFTAYLGLDPRKFQSGTSVNGKSRISKIGSSEIRKSLYMPALVAYRCNAFPEFVGRLKNKGKHIKLILIAIMRKLAVIAFTILQNGQDFQVERYK

SEQ ID NO: 7967 - protein, 126 aa, Neisseria meningitidis
MPSVELLLVIVGLPRGTFYYQLVVQSAEDKYADLKRHIHDIYQKQLKDNGLVQSMSRKGNCLDNAAMESFFGTLKSECFHTCKYDSVTELEAVLHEYIRYYNNDRIKLKLKGLSPVQYRIQSLKAA

SEQ ID NO: 7968 - skipped

SEQ ID NO: 7969 - protein, 145 aa, Neisseria meningitidis; identical to SEQ ID NO: 3572

SEQ ID NO: 7970 - protein, 33 aa, Neisseria meningitidis
MFHTLPEALKRTEIAAARQKLTELRRMLVSKGG

SEQ ID NO: 7971 - protein, 114 aa, Neisseria meningitidis
MANRCRLKPYNRRQNNACSNRTHTLPANGLRNLRLLDLRTKVTELKHIGGQSTAAIADLAGEMRRLAKKSKMLLKGLWPFLSSTISAFKINQSLFKHYYKTVQLLNCKHRKKNY

SEQ ID NO: 7972 - protein, 64 aa, Neisseria meningitidis
MVLFKSIKQESISFLSEDLKKDWMFHKVKTGEKDGYGSDEMLSVPRVYLEMMSRKTGVPYSSIL

SEQ ID NO: 7973 - protein, 76 aa, Neisseria meningitidis
MQGCDHYIFLFRSVYDFTVNCYSMCLAFQLPIFEYWRRHFHQCRNADQNSHKPYWFLWQQHLSVCSSDHKSNMIGW

SEQ ID NO: 7974 - protein, 70 aa, Neisseria meningitidis
MRSRSVRLSQMLSSPFVPICFYIRLCFSNLLISIICKGKDNYFPVRNKPILLNTLKPNTPINTILKHSLF

SEQ ID NO: 7975 - protein, 454 aa, Neisseria meningitidis
MQHLTERMTQIAKLLNSSANNPDIDIPDFLTEIKDYSEFSVTDENGTYLHWDKFRRIHTEDTRMKWRAVKESRKKIQKPIDFPFEHQFWFCIPDSLQARLHLIDKSCGSSIGTSSLGGFGRSEQNRFLLKSLIMEEAITSAQLEGAATTRKVAKDMLKSQRKPKTKDEIMIVNNYHLMKKAVELKNTPLSVEMILDLHRIATSNAIENKAEPGQFRQDDEIFIADINGNSLYQPPPHGQVHTLMEEVCAFANNTYDGVENPFIHPVVQAIILHFLIGYIHPFGDGNGRTARALFYWFMLKNGYWLFEYISISRLLKNAPAQYAKSYLYAETDDLDLTYFIYYQCDIIKRAVADLEHYISDKQKHQQEFKAAIAQYTEKIGKLNQRQIGILQKAVEESGKIFTAQEIANQYGISLNTARSDLSKLGEYRFLVPFKSGNALEYVAPQDLLERLEKK

SEQ ID NO: 7976 - protein, 168 aa, Neisseria meningitidis
METTFALLNFKESLCYIYPPTEPVRYVSSIVALNVHSPNGTGDWHSAKALSDRAYPEKFYIYGENQERNTNHLFGDNGIIDGTDRLNKMGYFPENIPVWLADHPRACVDYLYTAVLQTGSIGRVILDDWFPSDEDKQSVYDLLNQIEPHLNTQEWENLQLWKRKNPIM

SEQ ID NO: 7977 - protein, 417 aa, Neisseria meningitidis
MRKPRITYLDVWANDERIGTLEKGAMYRFAYDNPNSSLLGLHYQDRSKVYISNNMPHIFAQYFPEGFLDAHITSKYAFHDAPFEDNEMLRLAILCRETLGRIHVRCNDPLFNEWIDGLEMKNPRILTERDLLGINARQVFQQYMAEIFHHGRFVSVSGIQQKMSLDAIRRNTKQTASYIAKGFDASEYPCLAANEFLCMQTIKQAGIAVAQTSLSEDSSVLLVRRFDVSEQGYFLGMEDFTSLRQYSVEDKYKGSYAAIAQIIRQISGRPDEDLIHFFNQLAASCILKNGDAHLKNFSVLYHDEYDVRLAPVYDVLDTSIYRVGTQGIFDAYDDTLALNLTNHGKKTYPSKNTLLDFAEKYCDLGREDASFMIDTIVQAKEQVLVKYSDVLRENEWLAQKWHFIPDENEEGLPFTFR

SEQ ID NO: 7978 - protein, 595 aa, Neisseria meningitidis; identical to SEQ ID NO: 3838

SEQ ID NO: 7979 - protein, 152 aa, Neisseria meningitidis; identical to SEQ ID NO: 3568

SEQ ID NO: 7980 - protein, 104 aa, Neisseria meningitidis
MKKTLSNLVLISFCSTMLTACPFWGSCADWNCSKLNPRWEKAVDTCETENLTFVLHELGNQLGYKSITEVSFSEIGQHISYQCIHHGGGYNIRKDKQYGHLFVQ

SEQ ID NO: 7981 - protein, 99 aa, Neisseria meningitidis
MKKKLSKYSLFLSSVFCLTACATTLLGTVVVGTALYGTSSNWTTTDKEHQEIMNCLDKALVKLNIYFENDEEKYKNKTVMDIYYQCIKNPNYVVTHNNL

SEQ ID NO: 7982 - protein, 337 aa, Neisseria meningitidis; identical to SEQ ID NO: 3562

SEQ ID NO: 7983 - protein, 138 aa, Neisseria meningitidis
MNKNILYIFSLLITIVIFFIFEKNVIRKISFNYNKKEFLISDITNFNWDYVKLYIINSDFQKIVFYHKSKIVFEELIELDKEGNVLPQYLFDSDLKNVEYYECDYKNGKMQLLKKEKSHFFDGYFYYYKPINCRPKLL

SEQ ID NO: 7984 - protein, 2514 aa, Neisseria meningitidis; identical to SEQ ID NO: 2650

SEQ ID NO: 7985 - protein, 64 aa, Neisseria meningitidis
RLKIPFERNGKVYTVVVPNAQSATLLPIIREKVKSDGIVYTDTFRSYDVLDVSEFSHLRKFSSI

SEQ ID NO: 7986 - protein, 321 aa, Neisseria meningitidis; identical to SEQ ID NO: 7929

SEQ ID NO: 7987 - protein, 144 aa, Neisseria meningitidis
MNKNYLFYLIQNIKSIFLIGGVFFGLLIFSGLWGNDFKLSFLGVIDFIFGMVGGGFIVMLWFLIPVILSTLFRWVFQNQLAVSVILTFIVFYTYGYFSLFNSSERVGSFWYLVIPTIMFIGLSEWFIYKSSVHSLGENVTPRSN

SEQ ID NO: 7988 - protein, 612 aa, Neisseria meningitidis
MRKVCASARTRSMIYGSMPSEKLTIFQTAFVMQVNIQIPYILPRCVRAEDTPYACYLKQLQVTKDVNWNQVQLAYDKWDYKQEGLTGAGAAIIALAVTVVTAGAGAGAALGLNGAAAAATDAAFASLASQASVSLINNKGNIGNTLKELGRSSTVKNLMVAVATAGVADKIGASALNNVSDKQWINNLTVNLANAGSAALINTAVNGGSLKDNLEANILAALVNTAHGEAASKIKQLDQHYITHKIAHAIAGCAAAAANKGKCQDGAIGAAVGEILGEALLDGRDPGSLNVKDRAKIIAKAKLAAGTVAALSKGDVNAAANAAAVAVESNALSKERMDKLTKCLSGKTCSTTMEKVNAIKKDEQFSKVIDTEIQKVCSRNPLGDGCRNGINMSIKYIAMPAAWKYMPTDVSRVAKEVFGYLYNSQGASTRFDKYFNTIDNRADFFAASNLYEQNLGSKARWFGGADFVSRAAITGLGADGEASYITFAAGKVVGNPPIYEWRAASGNALIVNGFYNFRDLFNKKTNPREWDIQQLKSEQKLLQPIHQKYLSNEKDYLSLIKGVTSNKIFSIIPNPLDERKKIEDGINMLDYKSRIKYGCKLMGYSEKQGCKP

SEQ ID NO: 7989 - protein, 124 aa, Neisseria meningitidis; identical to SEQ ID NO: 6717

SEQ ID NO: 7990 - protein, 125 aa, Neisseria meningitidis; identical to SEQ ID NO: 6716

SEQ ID NO: 7991 - protein, 601 aa, Neisseria meningitidis
MKTALPSRVVAESANLQSGWDAKLQGTQFETTLGGAAIRAGVGDQARADAKIILEGIKSSVRTETVSSSKSALWQKQAGRGSNIETLQLPSFTGSVAPVLSAPGGYIVDIPKGNLKTEIEKLAKQPEYAYLKQLQVAKNVNWNQVQLAYDKWDYKQEGLTRAGAAIIALAVTVVTAGAGVGAALGLNGAAAAAADAAFASLASQASVSLINNKGDVGKTLKELGRSRTVKNLVVAAATAGVSNKLGASSLATWSETPWVNNLNVNLANAGSAALINTAVNGGSLKDNLEANILAALVNTAHGEAASKIKGLDQHYVAHKIAHAVAGCAAAAANKGKCQDGAIGAAVGEIVGEALVKNTDFSDMTPEQLDLEVKKITAYAKLAAGTVAGVTGGDVNTAAQTAQNAVENNAVKAVVTAAKVVYKVARKGLKNGKINVRDLKQTLKDEGYNLADNLTTLFDETLDWNDAKAVIDIVVGTELNRANKGEAAQKVKEVLEKNRPYIPNKGAVPNMSTYMKNNPFGKQLAQISEKTTLPTQQGQSVFLVKRNQGLLKTGDRFYLDGQHKNHLEVFDKNGNFKFVLNMDGSLNQMKTGAAKGRKLNLK

SEQ ID NO: 7992 - protein, 34 aa, Neisseria meningitidis
MPWKISTTTNLTPVPSANLSALPTTRCTTPPPTP

SEQ ID NO: 7993 - protein, 81 aa, Neisseria meningitidis
MEELLNDGSIRLHDYTDGIGIPLTGTSKEQVQKLKDIWPTLEDAQAIWPEDPWYYLEWLWWDIACPIDLADLPNIDIYEQA

SEQ ID NO: 7994 - protein, 34 aa, Neisseria meningitidis
MRNKKLRFLIFKSIYPQFLTLIKIKWVLIFKMKT

SEQ ID NO: 7995 - protein, 1995 aa, Neisseria meningitidis
MNKGLHRIIFSKKHSTMVAVAETANSQGKGKQAGSSVSVSLKTSGDLCGKLKTTLKTLVCSLVSLSMVLPAHAQITTDKSAPKNQQVVILKTNTGAPLVNIQTPNGRGLSHNRYTQFDVDNKGAVLNNDRNNNPFVVKGSAQLILNEVRGTASKLNGIVTVGGQKADVIIANPNGITVNGGGFKNVGRGILTTGAPQIGKDGALTGFDVRQGTLTVGAAGWNDKGGADYTGVLARAVALQGKLQGKNLAVSTGPQKVDYASGEISAGTAAGTKPTIALDTAALGGMYADSITLIANEKGVGVKNAGTLEAAKQLIVTSSGRIENSGRIATTADGTEASPTYLSIETTEKGAAGTFISNGGRIESKGLLVIETGEDISLRNGAVVQNNGSRPATTVLNAGHNLVIESKTNVNNAKGPATLSADGRTVIKEASIQTGTTVYSSSKGNAELGNNTRITGADVTVLSNGTISSSAVIDAKDTAHIEAGKPLSLEASTVTSDIRLNGGSIKGGKQLALLADDNITAKTTNLNTPGNLYVHTGKDLNLNVDKDLSAASIHLKSDNAAHITGTSKTLTASKDMGVEAGSLNVTNTNLRTNSGNLHIQAAKGNIQLRNTKLNAAKALETTALQGNIVSDGLHAVSADGHVSLLANGNADFTGHNTLTAKADVNAGSVGKGRLKADNTNITSSSGDITLVAGNGIQLGDGKQRNSINGKHISIKNNGGNADLKNLNVHAKSGALNIHSDRALSIENTKLESTHNTHLNAQHERVTLNQVDAYAHRHLSITGSQIWQNDKLPSANKLVANGVLALNARYSQIADNTTLRAGAINLTAGTALVKRGNINWSTVSTKTLEDNAELKPLAGRLNIEAGSGTLTIEPANRISAHTDLSIKTGGKLLLSAKGGNAGAPSAQVSSLEAKGNIRLVTGETDLRGSKITAGKNLVVATTKGKLNIEAVNNSFSNYFPTQKAAELNQKSKELEQQIAQLKKSSPKSKLIPTLQEERDRLAFYIQAINKEVKGKKPKGKEYLQAKLSAQNIDLISAQGIEISGSDITASKKLNLHAAGVLPKAADSEAAAILIDGITDQYEIGKPTYKSHYDKAALNKPSRLTGRTGVSIHAAAALDDARIIIGASEIKAPSGSIDIKAHSDIVLEAGQNDAYTFLKTKGKSGKIIRKTKFTSTRDHLIMPAPVELTANGITLQAGGNIEANTTRFNAPAGKVTLVAGEELQLLAEEGIHKHELDVQKSRRFIGIKVGKSNYSKNELNETKLPVRVVAQTAATRSGWDTVLEGTEFKTTLAGADIQAGVGEKARADAKIILKGIVNRIQSEEKLETNSTVWQKQAGRGSTIETLKLPSFESPTPPKLTAPGGYIVDIPKGNLKTEIEKLAKQPEYAYLKQLQVAKNVNWNQVQLAYDKWDYKQEGLTRAGAAIVTIIVTALTYGYGATAAGGVAASGSSTAAAAGTAATTTAAATTVSTATAMQTAALASLYSQAAVSIINNKGDVGKALKDLGTSDTVKQIVTSALTAGALNQMGADIAQLNSKVRTELFSSTGNQTIANLGGRLATNLSNAGISAGINTAVNGGSLKDNLGNAALGALVNSFQGEAASKIKTTFSDDYVAKQFAHALAGCVSGLVQGKCKDGAIGAAVGEIVADSMLGGRNPATLSDAEKHKVISYSKIIAGSVAALNGGDVNTAANAAEVAVVNNALNFDSTPTNAKKHQPQKPDKTALEKIIQGIMPAHAAGAMTNPQDKDAAIWISNIRNGITGPIVITSYGVYAAGWTAPLIGTAGKLAISTCMANPSGCTVMVTQAAEAGAGIATGAVTVGNAWEAPVGALSKAKAAKQAAPKETINNLANLAKAEQQILFRIAQRDTQLDAWKTGFNNRVRKGAGLLDASNIPITINGKTIKPVQAISLKGAPVYSGVSEQEIFALYRQMTGQNPNFRVLPDGRLANGIISTGEWAGTKIALRNFSKTENSTQARWTLDLQNPPSFIKGTKLELKFQ

SEQ ID NO: 7996 - protein, 580 aa, Neisseria meningitidis
MKFFPAPCLLVILAVIPLKTLAADENDAELIRSMQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFILGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 7997 - protein, 56 aa, Neisseria meningitidis
MMFAKHYQFIALGIMLLLYMLILYTTDFSNLTYWMLFFICFITGKILARLLEKSFK

SEQ ID NO: 7998 - protein, 100 aa, Neisseria meningitidis
MTWVGGSGNAQQSSYYCEICESAGLNDTGNPDKSLGLPNNTFSNPPGWGATIGALAGSRIGMPEFGTFASHAIENFDWSWYRRYREIAETIEREYSGGLP

SEQ ID NO: 7999 - skipped

SEQ ID NO: 8000 - protein, 117 aa, Neisseria meningitidis
MIELQLHELKLVSGGGPVTDNIAGNVANAATTKGGPTWGDLVAIPAAAAAVYYLPKNAYGAAGANGVYNVTRNWVNDAVNAPPYNGRPIFEIEHGLTAPATKADKSGNGYTDGTDYC

SEQ ID NO: 8001 - protein, 79 aa, Neisseria meningitidis
MRDSMKNWKQFTFFVILVIACYQVLYFLSDMFLLDYINKYSWNLNFIQGTLNFFSIYLPYVFVSRIFRNTNQEKEYKND

SEQ ID NO: 8002 - protein, 384 aa, Neisseria meningitidis
MSIHLDFGISPKTFRQTYLYQKPKLFKGAVRNLESASWKDINEIYQRADPTAPLFHLRKKGAIVPKEEYVESFDDLGKTRYRFIKSVIYEHMKNGASLVYNHINNEPFSDHIARQVARFAGAHTIVSGYLAFGSDESYKNHWDPRDVYAIQLFGKKRWQLTAPDFPMPLYMQQTKDTDISIPEHIDMDIILEAGDVLYIPRGWWHRPIPLGCETFHFAVGTFPPNGYNYLEWLMKKFPTIESLRHSFSDWEQDRTRINDTAAQIAAMIADPVNYEAFSEDFLGKERTDTAFHLEQFANPNATPLSDDVRLRLNANNLDTLEKGYLIGNGMKISVDELGKKVLEHIGKNEPLLLKNLLVNFNQGKYEEVRKLIYQLIELDFLEIL

SEQ ID NO: 8003 - protein, 347 aa, Neisseria meningitidis
MSKKIKVGIVGATGYTGVELLRLLAAHPDVEVAAVTSRSEAGTAVADYFPSLRGVYGLAFQTPDEAGLEQCDIVFFATPNGIAMKDAPRLIEQGVRVIDLSADFRIRDIPTWEHWYGMTHAAPDLVSQAVYGLSELNREAVAQARLVANPGCYPTCVSLPLVPLLRQCRLKPGMPLIADCKSGVSGAGRKGNVGSLLCEAGDNFKAYGIAGHRHLPEIRQTIAGLQDGIAEGFVFTPHLAPMIRGMHATVYLHLSDGSDPETVLRDYYRDSPFVDILPTGSAPETRSVRGANLCRISIQQAAQSDVWVVLSVIDNLVKGAAGQAVQNMNIMFGLEETHGLDAIPLLP

SEQ ID NO: 8004 - protein, 680 aa, Neisseria meningitidis
MMSPETRKQLKITDVSAKKLDKLNLHTAWDLVLHLPLRYEDETHIMPIKDAPIGVPCQVEGEVIHQEVTFKPRKQLIVQIADGSGSVLFLRFIHFYASHQKQTAVGKRIRAVGEIKHGFYGDEMIHPKIRDAEGGGLAESLTPVYPTVNGLNQPTLRRIIQTALDVTPLHDTLPDALLCRLKLPHLAESLRLLHSPPPSFTIHQLSDGTLPAWQRLKFDELLAQQLSMRLARQKRIGGTAAALGGDGTLTQALRQALPFALTDAQEKVVSEICRDMAQTYPMHRLLQGDVGSGKTIVAALSALTAIESGAQVAVMAPTEILAEQHFIKFKQWLEPLGIEVVRLFGSLRKKAKDEAKAKLADGSVKIAVGTHALFSDGVAFHNLGLTIVDEQHRFGVAQRLALKNKGREVHQLMMSATPIPRTLAMSFFADLDVSVIDELPPGRTPIKTRLVNNVRRAEVEGFVLGTCRKGRQAYWVCPLIEESETLQLQTAAETLARLQTALPELNIGLVHGRMKAAEKAEVMARFSSGGLNVLVATTVIEVGVDVPNAALMVIEHAERMGLAQLHQLRGRVGRGAAESVCVLLFAEPLGELAKARLKVIYEHTDGFEIARQDLNIRGPGEFLGARQSGVPMLRFAKLEEDLHLLEQARETAPMLIEQNPEIVEAHLARWLSGREGYLGV

SEQ ID NO: 8005 - protein, 147 aa, Neisseria meningitidis
MSEELQPVFSIERLYVKDLSLEVPHAPQIFLEQGEPEVEMRVSTGSQKLEDGYYNVDVTVTVTAKLDNERTMFLNEVTQSGIFRLENIPEEDADLLLGVACPNILFPYAREAVSGTVTRAGFPPVLLAPINFEAIYQQQQEAEAAGA

SEQ ID NO: 8006 - protein, 85 aa, Neisseria meningitidis
MQTVTMYTGPFCPYCAMAKRLLHAAGVGHIDEIRVDASPEAFAEMQQLSGQRSVPQIFIGETHVGGFTDLYRLQQEGGLDGLLNP

SEQ ID NO: 8007 - protein, 509 aa, Neisseria meningitidis
MQNIFITFSGKTMLSGLPIPKDIARPPETILVNITPAETRVAVLEENNICELHIERNSEHSLVGNIYLGVVRRVLPGMQSAFIDIGLERAAFLHIVDVLEQRRNPEETQRIEHMLFEGQSVLVQVIKDPINTKGARLSTQISLAGRFLVHLPQEDHIGVSQRIEDDAERSSLRERLDKLLPENACRGYIIRTNAENATDEQLQSDIDYLTKVWEHIQEQAKIRPPETLLYQDLPLSLRVLRDMVGCDTQKILVDSTVNHGRMTRFAEQYVHGALGRIELFKGERPLFETHNVEQEISRALQPRVNLNFGSYLIIESTEAMTTIDVNTGGFVGARNFDETIFRTNLEACHTIARELRLRNLGGIIIIDFIDMAQESHREAVLQELAKALAFDRTRVTLHGFTSLGLVELTRKRSRENLNQVLCEPCPSCQGRGRLKTPQTVCYEIQREIVREARRYDAESFRILAAPNVIDLFLDEESQSLAMLIDFIGKPISLAVETAYTQEQYDIVLM

SEQ ID NO: 8008 - protein, 314 aa, Neisseria meningitidis
MQENEYREDLAADAARQSVLPLLAALPLMILLTVWITHKAMRPVRKLSQSLEQRRINDLSALSVDNIPSEIRGFVTAINLLLKRADEDIRHRQRFVADAAHELRTPMTALPLQAERLNNMPLPPDAARQPAVLQQSIRRNKHLLEQLLALARSQSDEIPLTKTTFGLQSRFRQVLQELMPLALEKCQDIGVAVGGDVEVSADETEIYTLIKTFADNAVRYTPPEGRIDLGFTDEGKYLAVWVEDNGKGIPESERARVLDPFYRILGTEQQGTGLGLSIADTLAKKYGGYLELSDSRRFGRGLLIRALLDKETLK

SEQ ID NO: 8009 - skipped

SEQ ID NO: 8010 - protein, 437 aa, Neisseria meningitidis
MLTFIGLLIIGVIVWLLLTEKVSPIIALILVPLFGALLAGFDVSQLKEFYSGGTKSVMQIVIMFMFSILFFGIMNDVGLFRPMIGGLIKLTRGNIVAVSVGTVLVSVVAQLDGAGATTFLLVVPALLPLYKRLHMNPYLLFLLLTSSAGLINLLPWGGPTGRVASVLGADVGELYKPLLTVQIIGVVFILALSLLLGVREKRRIVRELGALPAVADLIKPVPLSEEEQKLARPKLFWWNVLLFLAAMSLLFSGIFPPGYVFMLAATAALLLNYRSPQEQMERIYAHAGGAVMMASIILAAGTFLGILKGAGMLDAISKDIVHILPDALLPYLHIAIGVLGIPLELVLSTDAYYFGLFPIVEQITSQAGVAPEAAGYAMLIGSIVGTFVTPLSPALWMGLGLAKLSMGKHIRYSFFWAWGLSLAILASSIAAGIVPLP

SEQ ID NO: 8011 - protein, 52 aa, Neisseria meningitidis
MIGAVSFESAHRDECPRAVPIPIYRLFRIGCRCEMTDGCRNGGRRKWEEMTD

SEQ ID NO: 8012 - protein, 190 aa, Neisseria meningitidis
MIMAKKISILVGSLRRASFARKVALNAAEMFPEGWQAEIVEIGHLPLYNFDYDDPAVEDVPLPESYTAFRETIKASDGILFVTSENNRTIPACLKNAVDIGSKPNADVAWKNKPAGIISHSVGKMGGYSSQKNLRLALSYFDMPVTGQPEVFLGNSPTLFDENGKLIDSARDFVQSYINQFVGLIERNAK

SEQ ID NO: 8013 - protein, 469 aa, Neisseria meningitidis
MNFPKTAASLLLLLASLAAHALDTGRIPQNEIAVYVQELDSGKVIIDHRSDVPVNPASTMKLVTAFAAFKTFGSNYRWATEFKSNGTVNDGTLDGNLYWAGSGDPVFNQENLLDAQKQLREQGILNITGHLMLDHSLWGEVGSPDDFEADSGSPFMTPPNPTMLSAGMVMVRAERNAAGSTDILTDPPLPHIFAQNNLKITASQAACPSIKKLMRASFSDNTLKLRGNIPESCLGKPVGVRMFALDELIRQSFTNHWLLGGGRISDGIGIADTPEGAQTLAVAHAKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVANNIISGGDGWLDAKLMCKERRA

SEQ ID NO: 8014 - skipped

SEQ ID NO: 8015 - protein, 389 aa, Neisseria meningitidis
MSEYLFTSESVSEGHPDKVADQVSDAILDAILAQDPKARVAAETLVNTGLCVLAGEITTTAQVDYIKVARETIKRIGYNSSELGFDANGCAVGVYYDQQSPDIAQGVNEGEGIDLNQGAGDQGLMFGYACDETPTLMPFAIYYSHRLMQRQSELRKDGRLPWLRPDAKAQLTVVYDSETGKVKRIDTVVLSTQHDPSIAYEELKNAVIEHIIKPVLPSELLTDETKYLINPTGRFVIGGPQGDCGLTGRKIIVDTYGGAAPHGGGAFSGKDPSKVDRSAAYACRYVAKNIVAAGLATQCQIQVSYAIGVAEPTSISIDTFGTGKISEEKLIALVREHFDLRPKGIVQMLDLLRPIYSKSAAYGHFGREEPEFTWERTDKAAALRAAAGL

SEQ ID NO: 8016 - protein, 67 aa, Neisseria meningitidis
MNIMSTAGNIAKFPYSYHSVEKYSHLNSTLESLPVRFLQAKKFPHQAGLDCSGEPHRLFNRPPYFSF

SEQ ID NO: 8017 - protein, 298 aa, Neisseria meningitidis; identical to SEQ ID NO: 568

SEQ ID NO: 8018 - protein, 354 aa, Neisseria meningitidis
MLVLGIESSCDETGVALYDTERGLRAHCLHTQMAMHAEYGGVVPELASRDHIRRLVPLTEGCLAQAGASYGDIDAVAFTQGPGLGGALLAGSSYANALALALDKPVIPVHHLEGHLLSPLLAEEKPDFPFVALLVSGGHTQIMAVRGIGDYALLGESVDDAAGEAFDKTAKLLGLLYPGGAKLSELAESGRFEAFVFPRPMIHSDDLQMSFSGLKTAVLTAVEKVRAENGADDIPEQTRNDICRAFQDAVVDVLAAKVKKALLQTGFRTVVVAGGVGANRKLRETFGNMTVQIPTPKGKPKHPSEKVSVFFPPTAYCTDNGAMIAFAGAMHLGKGREVGAFNVRPRWPLSEIVR

SEQ ID NO: 8019 - protein, 395 aa, Neisseria meningitidis
MTEHYKTLPEHELLIQKSLISNLNLWDWVFAVLVFAATVFVQTRSGMHMDIYETVMLWASAGIAVFLGWFFKPMRWFVPLSVLLAYAAVGLYGGDIKSAEIFLLRYFLSSQSAIMWQCAFVFFALFAYISGAVLASVKNVPTNTLLGMGTVFAWVSAVAGFTGLLVRWHESYLLRPDAGHIPVSNLYEVFILFLVITALMYLYYEGKFAIQKLGGFVFGFMAVVVGFVLWYSVSREAHTIQPLIPALQSWWMKIHVPANFIGYGAFCISAMLGIAELVSLRAEGKGGKLWLPPSALIDEVMYKAIAVGFLFFTIATILGALWAADAWGRYWSWDPKETWAFIVWLNYAVWLHLRLVAGWRGKVLAWWAIIGLFVTAFAFIGVNMFLSGLHSYGTL

SEQ ID NO: 8020 - protein, 671 aa, Neisseria meningitidis; identical to SEQ ID NO: 330

SEQ ID NO: 8021 - protein, 207 aa, Neisseria meningitidis; identical to SEQ ID NO: 3878

SEQ ID NO: 8022 - protein, 211 aa, Neisseria meningitidis
MPMNLFQNAKFFTTINHLKDLPDTPLEIAFVGRSNAGKSSAINTLTNHVRLAYVSKTPGRTQHINFFELQNGNFMVDLPGYGYAQVPEAVRAHWVNLLGDYLQQRKQLIGLVLIMDARHPLKELDIRMLDFFHTTGRPVHILLSKADKLSKNEQIKTLSQVKKLLKPYSDRQNISVQLFSSLKKQGIDEANRTVGSWLDAADAAASSPEEN

SEQ ID NO: 8023 - protein, 798 aa, Neisseria meningitidis
MIKKILTTCFGLVFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRQELYEKYGEDAYTQGFKVYTTVRADHQKVATEALRKALRNFDRGSSYRGAENYIDLSKSEDVEETVSQYLSGLYTVDKMVPAVVLDVTKKKNVVIQLPGGRRVTLDRRALGFAARAVNNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRSSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRVGYGGTIAVPVWVDYMRFALKGKQGKGMKMPEGVVSSNGEYYMKERMVTDPGLTLDNSGIAPQPSRRAKEDDGGAAEGGRQAADDEVRQDMQETPVLPSNTGSKQQQLDSLF

SEQ ID NO: 8024 - protein, 371 aa, Neisseria meningitidis
MRLFKSLKNPKKTDAKLPKKSSGLNNRAAIGIDIDQHSIKMVQLSGRSLNQIQLEKYVIAKLPKNIIQGNKVQNYDQLVTYLQQAYAKLGTSCKNIIASVPQNLATIEQLTYTDKDAELDLQGFVESSISEVSSISLEEANYDYQVLSQSAAGEAVLAVASRKDEIEPLIDAFNAAGMKLSALDVDIFGQYNAYALWINHFAPELAAEKVAIFGVYAAQTYALVIQDGKILYKQETSVSEEQLNQLIQRTYQVTEEKAEEIINSPQKPSDYQESVANYFNQQITQEIQRVLQFYYTTQTADDMTDIKHILLTGEAARQEGIAQTVASQTNADVQCVHPARYFADNLKTDKQQFELDAPTLTRAFGLAVRGL

SEQ ID NO: 8025 - protein, 199 aa, Neisseria meningitidis
MNNLIKINLLPYREEMNKRKQQQFKTLMYGAVLTGVAAVAATYLFIDNMINNQSERNTLLETSIAHLDTELSEIQKLKQEKDAFLIKKNKIEELQLKRLQAAKILDSLNEAVPGSTYLTSLDAVTADSYRLSGRTSSDNRVAAMMRAMPNTGIFKQPELLSIKKNNSHQEFTLQATLQPIVKAAESKENPASGNAQEAN

SEQ ID NO: 8026 - protein, 215 aa, Neisseria meningitidis
MASKSSKTNLDLNNLHLLNLPARLFIALLAVAAVLGLGYAGLFKSQMESLEEYEAKETELKNTYKQKSIDAASLNNLRDELASIRSAFDIMLKQLPTDAEIPNLVQELHQAGSSNGLRLDSVMPQPPVDDGPIKRLPYSISITGNYEQISQFTRDVGSLSRIITLESLKIAQSPENGGNPDGKSSILNLSAIATTYQAKSVEELAAEAAQNAEQK

SEQ ID NO: 8027 - protein, 181 aa, Neisseria meningitidis
MKHYALLISFLALSACSQGSEDLNEWMAQTRREAKAEIIPFQAPTLPVAPVYSPPQLTGPNAFDFRRMETDKKGENAPDTKRIKETLEKFSLENMRYVGILKSGQKVSGFIEAEGYVYTVGVGNYLGQNYGRIESITDDSIVLNELIEDSTGNWVSRKAELLLNSSDKNTEQAAAPAAEQN

SEQ ID NO: 8028 - protein, 769 aa, Neisseria meningitidis
MNTKLTKIISGLFVATAAFQTASAGNITDIKVSSLPNKQKIVKVSFDKEIVNPTGFVTSSPARIALDFEQTGISMDQQVLEYADPLLSKISAAQNSSRARLVLNLNKPGQYNTEVRGNKVWIFINESDDTVSAPARPAVKAAPAAPAKQQAAAPSTKSAVSVSEPFTPAKQQAAAPFTESVVSVSAPFSPAKQQAAASAKQQAAAPAKQQAAAPAKQQAAAPAKQTNIDFRKDGKNAGIIELAALGFAGQPDISQQHDHIIVTLKNHTLPTTLQRSLDVADFKTPVQKVTLKRLNNDTQLIITTAGNWELVNKSAAPGYFTFQVLPKKQNLESGGVNNAPKTFTGRKISLDFQDVEIRTILQILAKESGMNIVASDSVNGKMTLSLKDVPWDQALDLVMQARNLDMRQQGNIVNIAPRDELLAKDKALLQAEKDIADLGALYSQNFQLKYKNVEEFRSILRLDNADTTGNRNTLISGRGSVLIDPATNTLIVTDTRSVIEKFRKLIDELDVPAQQVMIEARIVEAADGFSRDLGVKFGATGKKKLKNDTSAFGWGVNSGFGGDDKWGAETKINLPITAAANSISLVRAISSGALNLELSASESLSKTKTLANPRVLTQNRKEAKIESGYEIPFTVTSIANGGSSTNTELKKAVLGLTVTPNITPDGQIIMTVKINKDSPAQCASGNQTILCISTKNLNTQAMVENGGTLIVGGIYEEDNGNTLTKVPLLGDIPVIGNLFKTRGKKTDRRELLIFITPRIMGTAGNSLRY

SEQ ID NO: 8029 - protein, 170 aa, Neisseria meningitidis
MKNFNGKLILIGLMGAGKTTLGRQMAQRLDYRFYDSDHEIAAAAGVPIPTIFEMEGEQGFRSRETAILKKLVILPHIVLSTGGGAVLKEENRALIRKSGTVVYLHAPPETLLERTRCDNSRPLLQVADPLAKLRELYAARDPVYRQTADFTVESANCRETVQTLLKRLSR

SEQ ID NO: 8030 - protein, 359 aa, Neisseria meningitidis
MKTLTVHTPSHSYPIFIGNGLLPQAGSLLKPHLGKRAAIIANETVAPLYLGTLQTALDAAGVSHFSIILPDGEAHKNWQTLNLIFDGLMQNRAERKTTLIALGGGVIGDMVGFAAATYQRGAPFVQIPTTLLSQVDSSVGGKTAINHPLGKNMIGAFYQPQAVLADLDTLHTLPARELSAGMAEVIKYGALGDIGFFEWLEQHMPELMTLDREKLAQAVYRCCQMKADIVAQDETEQGIRAWLNLGHTFGHAIETEMGYGTWLHGEAIAAGCVLAARLSEQLGKTSAADTARLAALLEAAGLPSAPPVFAFEKWLEHMSHDKKVSGGIMRFIGLNRLGEANITEITDTDILRRTLQPYL

SEQ ID NO: 8031 - protein, 280 aa, Neisseria meningitidis
MCQLLGMNCNTPTDIMFSFEGFRRRGGITDHHADGFGIGFFEGKGVRLFHDDKPSVNSPVADLVRAYQIKSENVIAHIRKASQGQTSLANTHPFMREMWGGYWLFAHNGHLIDFFPEQGEFFHPVGTTDSERAFCHILNRLRTRFAARPDDDTLFDAIAGLTHEIRKFGLFNFMLSDGIALFAHASTLLHYIVRQAPFGKARLLDDDVMVDFAEVTTPSDRVAVIATLPLTRDESWSQLAVDELVMFREGNIVRHDRPENPVYMSAEEGLEIARAAGVAV

SEQ ID NO: 8032 - protein, 154 aa, Neisseria meningitidis
MKCPFCAHPDTRVADSRLMEERNAVRRRRHCPNCGKRFGTLETAELKMPAVIGPDKKRSPFNAQRLRNDLTAAARKSALTPEQIDETVRLTEHRLYTSGQRDIPSAALADMVLKELLRQDTEAAVRFAALHKRFDNPADFASWLAQAVKTGGKA

SEQ ID NO: 8033 - protein, 369 aa, Neisseria meningitidis
MFSDTDISMMENALRLAALGRFSTSPNPRVGCVIAHGSQIVGQGFHVKAGEPHAEVHALRQAGEMAQGATAFVTLEPCSHYGRTPPCAEALVRAGVSRVVAAMRDPNPLVAGKGLALLEAAGIKTECGLLEHQARELNRGFLSRIERRRPFVRLKCAVSLDGKTALSDGSSFWITGEDARADVQVLRAESCAVLTGIGTVLADNPRLNVRAFPTLRQPARIVLDSRLRLPPNSHLVTDGQSPTYIATLERNEDRLHPYREHAHVRILMPSETADSKIDLHHLMRLLADEGFGEIMVEAGSELTSAFLAENLADEIVLYRSPKILGSGKDLFSLLENRAALSAPPLWTPVSSEILGHNIKTVFRKNGNAF

SEQ ID NO: 8034 - protein, 473 aa, Neisseria meningitidis; identical to SEQ ID NO: 376

SEQ ID NO: 8035 - protein, 51 aa, Neisseria meningitidis
MKIVLTTSMAGLGGTGTISSIAKWRAKTTPFSPTKSSAASGATFPIGKSST

SEQ ID NO: 8036 - protein, 413 aa, Neisseria meningitidis; identical to SEQ ID NO: 14

SEQ ID NO: 8037 - protein, 391 aa, Neisseria meningitidis
MLNTFLSPWPCFTQEEADAVSKVLLSNKVNYWTGNECREFEKEFAAFAGTRYAVALANGTLALDVALKAMGIGAGDDVIVTSRTFLASASCIVNAGANPVFADVDLNSQNISAETVKAALTPTTKAVIVVHLAGMPAEMDGIMALAKEHNLWVIEDCAQAHGAKYKGKSVGSIGHVGAWSFCQDKIMTTGGEGGMVTTNDKTLWEKMWSYKDHGKSYDAVYNHEHAPGFRWLHESFGTNWRMMEMQAVIGRIQLKRLPEWTARRRENAAKLAESLGKFSSIRLVEVADYIGHAQYKFYAFVKPEHLKDGWTRDRIVGELNARKVPCYQGSCSEVYLEKAFDNTPWRPKERLTNAVELGDTSLMFLVHPTLTDDEIAFCKKHIEAVLTEAAR

SEQ ID NO: 8038 - protein, 636 aa, Neisseria meningitidis
MNLETLIALPRNIKKICFLIHDFLMIFIAFWFTQSLKADYSDEWFDFANWQSFLLTALLTITLFIRMGLYHAVTRFVSFRILTTALAGSLASAVLFFLNTLIFEERLRLALPIVYFLLLFVSVTGSRMVLRGLLSEHPKKQMIPVIIYGAGRSGRQLLEAVKQMREYSAAAFVDDDPKLWHTVIYDLAVYQPDAIAFLIERYGVEKILLAIPGATQEQRRRIINKLEAYPCEVLTIPGMKDLMDGKISIGTLKKISVSDLLGRDSVAPDDRLMSADIEGKTVMVTGAGGSIGSELCRQIIRRRPEKLLLFELSEFALYAIEKELRETCIQKRLDTEILPFLGSVQNRTLLEHVMTAFSVATVYHAAAYKHVPMVEFNTVEGIRNNIFGTLECALAATTSGVRTFVLISTDKAVRPTNTMGASKRMAELCLQALAAEPGQKTRFSMVRFGNVLGSSGSVVPLFEKQIAEGGPLTLTHPEITRYFMTIPEAAQLVIQAGAMGTGGDVFVLDMGESVKIIDLARQMITLSGLKPNTPEQPDGDIEILITGLRPGEKLYEELLIGDNVRKTGHPRIMTANETMLPWHELSALLDRIRAACDRYDQQAIRTLLINAPTGFAPSDGICDLLWVRETHRKNAV

SEQ ID NO: 8039 - protein, 430 aa, Neisseria meningitidis
MQFSAFGEKFTQHSGILQLMDDLGDALKSDKPVNMLGGGNPARIPEIDQAFADIFSKLAAEHAVENIGNYSNPQGDAVLIDALTAFLNREYSWNLTADNIALTNGSQNAFFYLFNLFGGKFNLSDGTSAEKAILLPLAPEYIGYADVHVEGQHFVSVKPKIENVEHEGEAGFFKYRVDFDALENLPELKAGKIGAICCSRPTNPTGNVLTDGEMARLDALAREHGIPLIIDNAYGMPFPNIIYSDVTLNWHENIILCFSLSKVGLPGVRTGIIVAAPEVVKAVSSLNAIVNLAPTRFGAAIATPLLESGEMKRLADQVIRPFYRNQAQTAVSLLKRELGAYPMKIHKPEGAIFLWLWFENLPVSSQTLYEMLKAEGTLIIPGEHFFVGIDTQDYPHAGECIRMSIAQDAQTLEKGIAAIGKTVRKLYDNV

SEQ ID NO: 8040 - protein, 278 aa, Neisseria meningitidis
MIDLHCHSTVSDGMLSPAEVVRLAHQNGCTLLALTDHDHTGGIAEARAEADKLGLRLINGVEISVTWRGRTIHVVGLDFDEQDENLQNLLAQVRKGRLKRLEAIAAKLEKKGIGGAYDGALALAANKEMVSRTHVAEFLIQAGHVKNKQQAFTKYLGDGKSCAVRHEWATLEDCVSAVNGAGGMAVIAHPMRYDLSATAKRNLFEEFKNLGGAGIEVHSGNCCKNDRLNYALLAERFGMLASAGSDFHRLNDFSGGILGACPELPENCKPVWEHFSRY

SEQ ID NO: 8041 - protein, 67 aa, Neisseria meningitidis
MDTTLKYKAEALLGEPLLDEPVRPESWECCGSDCGEACIQTIYWADKAKYDVQRQKLKEAGWSDDAV

SEQ ID NO: 8042 - protein, 123 aa, Neisseria meningitidis
MAAYGVSDGIFTFTEQAVRIHRRFFGNFGYGGGRCYNNGLFLQGNIMEATVYLEDNEYIALCDLLKLVGLAESGGQAKAFIAEGLVLRNGETETRKTAKIRGGEVIEFDGARLEIADGYDPEV

SEQ ID NO: 8043 - protein, 1144 aa, Neisseria meningitidis
MTEPTYIPLRLHTEFSITDGMVRIKKLIAKAQEYGLPALGISDLMNEFGLVKFYKACRSAGIKPIGAADVRIGNPDAPDKPFRAMLIIRNDAGYLRLSELLTAAYVGKDRNVHHAELNPEWLENGDNSGLICLSGAHYGEVGVNLLNGNEDAARTAALKYAAWFPDAFYMELQRLPERPEWEACVSGSVKLAEELGLPVVATHPTQFMSRDDFNAHEARVCIAGGWVLTDKKRPRDFTPGQFFIPPETMAERFADLPEALENTVEIAKRCNLHITLGKNFLPLFPTPDGLSLDDYLIKLSNEGLQERMVQLYPDEAERAAKMPEYQERLDFELNIIIQMKFPGYFLIVQDFINWAKTHGCPVGPGRGSGAGSLVAYSLKITDLDPLKYALLFERFLNPERVSMPDFDVDFCQSNRGRVIEYVREKYGAEAVSQIVTFGTMSSKAVIRDVGRVLELPFMLCDKLSKLIPLEANKPLSLEKAMETEPQIQELIEAEEADELITLAKKLEDLTRGLGMHAGGVLIAPGKISDYSPVYQADESASPVSMYDKGDVEDVGLVKFDFLGLRNLTIIEMAQNNIKNTTGDIIDVGKIPLDDQVAYQIFRDANTTAVFQFESTGMKKMLKTAHTTKFEELIAFVSLYRPGPMDNIPDFVARMKGQEFQYIHPLLEGILAPTYGIMVYQEQVMQAAQIIGGYSLGGADLLRRAMGKKKPEEMVKHREIFAEGAAKQGISREKSDEIFNYMEKFAGYGFNKSHAAAYALISYQTAWLKAHYPAEFMAATMSSELDNTDQLKHFYDDCRANGIEFLPPDINESDYRFTPYPDMKIRYALGAIKGTGEAAVESITAARQSGGKFTGLLDFCERVGKEHMNRRTLEALIRGGAFDSIEPNRAMLLANIDLAMDNADQKAANANQGGLFDMMEDAIEPVRLIDAPMWSESEKLAEEKTVIGFYLSGHPFGPYAQEVRQIAPTKLDRLKPQDSVRLAGFVTAVRTMMGKRGKIAFVSLEDLSGQVEIMVGGQTLENCADCLKADQVLIIESKVSRDDYGGGDGLRILANQVMTLQTARERYARSLSLALAPHHDIGGLVRLLAAHQLPDTPRIPLQLSYANEKASGRLQVPPKWTVTPSSALFGELETLLGSRSVRVNW

SEQ ID NO: 8044 - protein, 310 aa, Neisseria meningitidis
MLSQLEYGIAKENRPNRQADRFAGSVLPLAASLTHKPNIMKPIPTDTFQPAILPQAFETEIKSTCTGRIYRIQTATLGEIPSEGYPVLFVLDGEAFFPALFNIMQSLMNNPVTRSNAPCLIVGIGYTTGSVRDLAQRAADYTPPLGDNATADERQQFGQADRFAAFIDSELTAFLESRYTLNRNETAVFGHSFGALFGLYSLLSHRRFRRHWLVSPSIWWHNRRILDFMPSENRLNGIDVCLNIGALERGSDCKRREERDMAGQAEQMAAELDRHGAAVFFREYPNADHGNVPFYSLTDCVEYLRKAWQR

SEQ ID NO: 8045 - protein, 708 aa, Neisseria meningitidis; identical to SEQ ID NO: 3588

SEQ ID NO: 8046 - protein, 219 aa, Neisseria meningitidis
MTTPKLIIFDWDGTLADTTQPIIDTMRRSFAECGFPPPEAERVRSLIGYSLPEIIRTLLEMPSETAVADITRTYSAHYLNPNNRNMSLFPDALPCLDKLKAQGYWLAVATGKGRAGLDNAISQTATGGYWLATACAGEYPSKPSPEMVFGICGELGLDPKEALVVGDTAHDLHMAANAGAAAVGVATGAHSREQLLSAPHLAVLDGLSELPGFLAQHYA

SEQ ID NO: 8047 - protein, 322 aa, Neisseria meningitidis
MNEKTIILANPRGFCAGVDRAISIVERALEEFGAPIYVRHEVVHNKFVVDNLREKGAVFIEDLAEVPPGATLVYSAHGVSKAVRQEAAERGFRVFDATCPLVTKVHKEVARLDAQDCEIIMIGHKGHVEVEGTMGQLAPGKMLLVETVGDVAKLEVRNPDKLAYVSQTTLSVDETKDIIAALNARFPNIRNPHKEDICYATTNRQTAVKELAEQCDIVIVVGSPNSSNSNRLREVAASRGIDAYMVDNAGYLQRAWFEGKNKVGVTAGASAPEVLVREVLATIRGWGHETVREGEGAEESIVFVLPKELRREGETKPDLCKR

SEQ ID NO: 8048 - protein, 175 aa, Neisseria meningitidis
MVLFYRLLKNMSSSVSSKTRYWVLALAAIVLDQWSKWAVLSSFQYRERVNVIPSFFDLTLVYNPGAAFSFLADQGGWQKYFFLVLAVAVSAYLVRAILRDEFATLGKTGAAMIIGGALGNVIDRLIHGHVVDFLLFYWQNWFYPAFNIADSFICVGAVLAVLDNIVHRKTQEEKY

SEQ ID NO: 8049 - protein, 929 aa, Neisseria meningitidis
MTDYSKTVNLLESPFPMRGNLAKREPAWLKSWYEQKRYQKLREIAKGRPKFILHDGPPYANGDIHIGHAVNKILKDIIIRSKTQAGFDAPYVPGWDCHGLPIEVMVEKLHGKDMPKARFRELCREYAAEQIARQKKDFIRLGVLGDWDHPYLTMDFKTEADTVRMLGEIYKSGYLYRGAKPVQFCLDCGSSLAEAEVEYKDKISPAIDVAYLFKDTAALAAAFGLAGFEGKAFAVIWTTTPWTLPASQAVSAGADVVYQLIDTPKGKLVLAKDLAEDALKRYGFSDGIAILAETTGDKLENLHMNHPFLERDIPMLNGEHVTTDAGTGLVHTAPAHGLEDYAVCNKYGIELYNPVNAEGRYIGETPRVAGMRVWEANPVILQWLEETGNLLASSKIEHSYAHCWRHKTPLIYRATGQWFVGMDKAGADGKTLRDKAIKAVDDTEFFPSWGRARLEAMIEGRPDWVVSRQRYWGTPMTFFVHKETGELHPNSAELLEKVALKIEEKGIEAWFSLDKSELLSAEDCENYDKLSDTMDVWFDSGSTHYSVVKQREELEWPADLYLEGSDQHRGWFQSSMLTGCASSMGRAPYKQLLTHGFVVDGEGKKMSKSIGNVVAPQEVYNEFGADILRLWAASTDYSGELAISKEILKRVTESYRRIRNTLSFLFANLSDFNPIEDAVQQADMVEIDRYAVVLARQLQECLAGDYYPRYAFHFAVKDIVSFCSEDLGAFYLDILKDRLYTTKADSHARRSAQTALYHITRSLVLLIAPILCFTGEEAWDIIGGGEEDSVLFHTWHEFPTINEKTEAELVKKWTAIREAREAVTAAIEPLRADKTVGSSLQAEAEITAPEEMAGYLNALGEELRFALLVSKAEVKVGSELAVAAKASDGEKCERCWHYTRDVGAVAGYETVCKRCAENVGGEGETRHYA

SEQ ID NO: 8050 - protein, 306 aa, Neisseria meningitidis
MRIRLGRHNAPDFPQGAAVTIGNFDGVHLGHKHILQKLRLEADARGLPVVTVVFEPQPKEFFALRTGRMPPCRISPLRTKLELLEGTGCVDAVWVLRFDQNFSEISAQGFIDRLLRQTLNTRYLLVGDDFRFGAGREGCFELLAQQPDMQTERTPSVIVEDIRTSSTAVRQALSDGNLAYAKKLLGHDYVLSGRVVHGRKLGRTLNAPTANIRLPRHRYALGGVFVVEADGAFGTRRGVASFGFNPTVDSGCSQKLEVHLFDFQGDLYGQGLNVRFLHKLRDEEKFDGMEELKRQIEADMEAARRW

SEQ ID NO: 8051 - protein, 431 aa, Neisseria meningitidis
MSVIQDLQSRGLIAQTTDIEALDALLNEQKIALYCGFDPTADSLHIGHLLPVLALRRFQQAGHTPIALVGGATGMIGDPSFKAAERSLNSAETVAGWVESIRNQLTPFLSFEGGNAAIMANNADWFGSMNCLDFLRDIGKHFSVNAMLNKESVKQRIDRDGAGISFTEFAYSLLQGYDFAELNKRHGAVLEIGGSDQWGNITAGIDLTRRLHQKQVFGLTLPLVTKSDGTKFGKTEGGAVWLNAKKTSPYQFYQFWLKVADADVYKFLKYFTFLSIEEIDAIEAKDKASGSKPEAQRILAEEMTRLIHGEEALAAAQRISESLFAEDQSSLTESDFEQLALDGLPAFEVSDGINVVEALVKTGLASSNKEARGFVNSKAVLLNGKPAEANNPNHAAERPDDACLLNGEHKRFGKYTILRRGKRNHALLVWK

SEQ ID NO: 8052 - protein, 623 aa, Neisseria meningitidis
MSQALPYRPDIDTLRAAAVLSVIVFHIEKDWLPGGFLGVDIFFVISGFLMTTILHREMSGGGGRFSLKAFYIRRIKRILPAFFAVLAATLAGGFFLFTKDDFFLLWKSALTALGFASNLYFARGKDYFDPAQEEKPLLHIWSLSVEEQFYFVFPILLLLVARKSLRVQFGFLAALCALSLAASFIPSALDKYYLPHLRACELLIGSLTAVWMRCRQPAVGRRCAAVGALFAVCILSTCLFSYSEQTAYFPGPAALIPCLAVAALIYFNHYEHPLKKFFQSKITVAAGLISYSLYLWHWPILAFMRYIGPDNLPPYSPAAAVVLILLLSLFSYHCIEKPFKKWQGSFAQSVLWIYALPMLILGAGSFFAMRLPFMAQYDRLGLTRSNTSCHNNTGKQCLWGDTEKQPELLVLGDSHADHYKTFFDAVGKKEKWSATMVSADACAYVEGYASRVFQNWAACRAVYRYAEEHLPRYSKVVLAMRWGSQMPENSRSLAYDAGFFQKFDRMLHKLSSEKQAVYLMADNLASSYNVQRAYILSSRIPGYRQALRPDDESTLKANARIRELAAKYPNVYIIDAAAYIPADFQIGGLPVYSDKDHINPYGGTELAKRFSEKQRFLDTRHNH

SEQ ID NO: 8053 - protein, 84 aa, Neisseria meningitidis
MIFGVSRTAGMQPHQNKLPPAFPICPPRFLQNKPPAPPLREAVRHSEYPDPRYEMTFQTAFAPPRFEYSGLTLNQDKATKPQTV

SEQ ID NO: 8054 - protein, 363 aa, Neisseria meningitidis
MSLKCGIVGLPNVGKSTLFNALTQSGIEAANYPFCTIEPNVGIVEVPDPRMAELAKIVNPQKMQPAIVEFVDIAGLVAGASKGEGLGNQFLANIRETDAIVNVVRCFDDDNIVHVAGRVDPIADIETIGTELALADLASVEKAIVREEKRARSGDKDAQKLVDLCKKLLPHLDEGKPVRSFGLDAEERAMLKPLFLLTAKPAMYVGNVAEDGFENNPHLDRLKELAAKENAPVVAVCAAMESEIAELEDDEKAEFLAEMGLEEPGLNRLIRAGYDLLGLQTYFTAGVKEVRAWTIHKGDTAPQAAGVIHTDFERGFIRAQVISYDDFVSLGGEAKAKEAGKMRVEGKEYVVQDGDVMHFLFNV

SEQ ID NO: 8055 - protein, 558 aa, Neisseria meningitidis; identical to SEQ ID NO: 1538

SEQ ID NO: 8056 - protein, 143 aa, Neisseria meningitidis
MGSNAWLFWALASAGFASLTAIFAKMGLQGIDSDFATFIRTLVILAALLLFLTYTGKWQGVNGFTGRNWTFLILSGLATGASWLAYFKALQLGNASQVAPIDKFSLVLVALMAVVFLDERPNTQEWIGLGLVTAGVLVLALKR

SEQ ID NO: 8057 - protein, 231 aa, Neisseria meningitidis
MKAMILAAGRGERMRPLTDTTPKPLLDVAGKPLIGWHLCRLKQAGFTEIVINHAWLGRQIEDALGDGSAYGVNIAYSPEPAGGLETAGGIAQALPLLGGQPFLVVNGDVLTDIDFTAAFQTASSLPEHISAHLWLVENPPHNPDGDFSLLPDSSVRPEVNGGNGLTFSGVGIYRPEMFDGIEAGSVAKLAPVLRGEMRQNRVSGQKHTGLWLDVGTVCRLKEAQALAGAWK

SEQ ID NO: 8058 - protein, 166 aa, Neisseria meningitidis
MADLQKNFQTSFRDAMASCAAGVHVITTDGAAGRYGITMTAVAPVTDEPPTVMLCINRSARIIPILSENGSLCINTLADEHQDVAEHFAGLTGLSPEERFAYHIWHRGKTGQLEIEGALAHLHGHIVGKHEIGTHFVFYVRLDEIKNCGCKRPALLYFRRQFRFLD

SEQ ID NO: 8059 - protein, 146 aa, Neisseria meningitidis
MPTQSKHASINIGLIQAREALMTQFRPILNQANITDQQWRIIRLLAENGTLDFQDLANQACILRPSLTGILTRLEKAGLVVRLKPSNDQRRVFLKLTAEGEKLYEEIGEEVDERYDAIEEVLGREKMLLLKDLLAELAKIEDALNS

SEQ ID NO: 8060 - protein, 40 aa, Neisseria meningitidis
MRFIAYCCYMFVLLYNGCIKIYAHRLSRRFESLIFDNLET

SEQ ID NO: 8061 - protein, 169 aa, Neisseria meningitidis
MKKKLLSGIKFAVQTALVFLLVSLFLDWIRKPEEPAGAAGRPLTLLSGQRLTLGQFSRDKAVLVYFWGSWCGVCRYQSPIIDDLAADGVPVVGVAVRSGSSAEVAAYMAKRGLGFPTVNDEDGGLARSWRIVATPAVVLVKNGKMVHYTTGISSYWGLRARIFQADVFG

SEQ ID NO: 8062 - protein, 359 aa, Neisseria meningitidis
MNIQNIRTLLDTVAVPNTARTLGGEKAVRSVEQRSDGIHIALHFGFPVAHIASETADRIQEILMPETGDTHIHLSMDTEIGTHKVQPGVTTIKGVKNIIAVASGKGGVGKSTTTANLAAAMARMGARVGVLDADLYGPSQPTMLGVDDRKPDQKNQKLIPVESSDGIQVMSIGFLVDTDQAVVWRGPMVSQALQQLMFQSEWDEVDYLFIDLPPGTGDIQLTLSQRIPVTGSVIVTTPQDIALIDARKAVDMFRKVNIPILGVLENMSVHICTNCGHSEALFGTDGGKDFAARLNVPLLGQLPLSLPVREAMDGGTPAQLFDEHPAIARIYTDAAFQIALSIADKGKDFSSRFPKIVVE

SEQ ID NO: 8063 - skipped

SEQ ID NO: 8064 - protein, 114 aa, Neisseria meningitidis
MGIPESSGIPESSGIPESSGIPESSGIPESSGIPESSGIPESSGIPESSGIPESSGIPESSGIPESSGIPESSGIPESSGIPESSGIPESSGIPEPSFPRRRESRPVGAETYRV

SEQ ID NO: 8065 - protein, 377 aa, Neisseria meningitidis
MSTPALLVLADGSVFHGTSIGYEGSTSGEVVFNTSMTGYQEILTDPSYCKQIVTLTYPHIGNTGTNAEDEESRSVYAAGLIIRDLPLLHSNFRASESLHDYLVRNKTVAIADIDTRRLTTLLREKGAQGGAILTGADATIEKAQELIAAFGSMVGKDLAKEVSCTETYEWTEGEWALGKGFVTPDEQPYHVVAYDFGVKTNILRMLASRGCRLTVVPAQTSAEDVLALNPDGVFLSNGPGDPEPCTYAIKAVQKLIESGKPIFGICLGHQLISLAIGAKTLKMRFSHHGANHPVQDLDSGKVVITSQNHGFAVDADTLPANARITHKSLFDNTLQGIELTDKPVFCFQGHPEASPGPQDVGYLFDKFIGNMKAAKRA

SEQ ID NO: 8066 - protein, 91 aa, Neisseria meningitidis
MPADRYATGNGFTGIIRTRHQTFKRHRSAHRRNGQNPIGLPARSRWQPAGNQQLLIFRRLMQNKKQPAQAVFLAASLTPTAAPSSLPVGKR

SEQ ID NO: 8067 - protein, 86 aa, Neisseria meningitidis
MPSPRPSPTGEGEGCSRFCGCRRFERQLRFAAVVSGHLKNKKQPAQPVFLAKPLIPTATTSSLPWERVRERATNCKAYTNSNPTTE

SEQ ID NO: 8068 - protein, 129 aa, Neisseria meningitidis
MSTHEKLLTADNPVLHQRAKAMRQEMSEAEAKLWQHLRAGRLNGYKFRRQQPMGNYIVDFMCVTPKLIVEADGGQHAEQAVYDHARTAYLNSLGFTVLRFWNHEILQQTNDVLAEILRVLQELEKQYAQ

SEQ ID NO: 8069 - protein, 90 aa, Neisseria meningitidis
MPEISTAGIFQAAFIARQVEQTPRTFFQTTFELIGRECAARHARGGLGLQGKWRTRAYVPHIPYIRATACYDTGVSIYKLGFSKPNILDN

SEQ ID NO: 8070 - protein, 213 aa, Neisseria meningitidis
MSIPINFNNLKYLLNDMRNKNRIIEAFPFNYNQRQYAVILTRYKPDEPRPDDYAQAKLEFFNLNSENSIFAYADFYEVHFKSATDFINFFKINVQAGAAKIREIFQSFSNLFADFIPTQTKKDLDIIYKKIVATRLEPNSPNTIYCYDVRRNGKDKAGKPNRRSVENSEKAKILRPELYEKFKADSNYSFFFSDNPSDEKTDAEIIREVTNRQ

SEQ ID NO: 8071 - protein, 1071 aa, Neisseria meningitidis
MPKRTDLKSILIIGAGPIVIGQACEFDYSGAQACKALREEGYKVILVNSNPATIMTDPEMADVTYIEPIMWQTVEKIIAKERPDAILPTMGGQTALNCALDLARNGVLAKYNVELIGATEDAIDKAEDRGRFKEAMEKIGLSCPKSFVCHTMNEALAAQEQVGFPTLIRPSFTMGGSGGGIAYNKDEFLAICERGFDASPTHELLIEQSVLGWKEYEMEVVRDKNDNCIIICSIENFDPMGVHTGDSITVAPAQTLTDKEYQIMRNASLAVLREIGVDTGGSNVQFAVNPANGEMIVIEMNPRVSRSSALASKATGFPIAKVAAKLAVGFTLDELRNDITGGKTPASFEPSIDYVVTKIPRFAFEKFPAADDRLTTQMKSVGEVMAMGRTIQESFQKALRGLETGLCGFNPRSEDKAEIRRELANPGPERMLFVADAFRAGFTLEEIHEICAIDPWFLAQIEDLMKEEKAVSDGILSDLDFAALRRLKRKGFSDKRLAQLLNVSEKEVREHRYALKLHPVYKRVDTCAAEFATETAYLYSTYEEECESRPSDRKKVMILGGGPNRIGQGIEFDYCCVHAALALRESGFETIMVNCNPETVSTDFDTSDRLYFEPLTLEDVLEIVRTENPWGVIVHYGGQTPLKLANALVENGVNIIGTSADSIDAAEDRERFQKVLNDLGLRQPPNRIAHNEEEALVKAEEIGYPLVVRPSYVLGGRAMQVVHSAEELQKYMREAVQVSEDSPVLLDFFLNNAIEVDVDCVSDGKDVVIGGIMQHVEQAGIHSGDSGCSLPPYSLSEEIQDEIRRQTKAMAYALGVVGLMNVQFAVQDGVVFVLEVNPRASRTVPFVSKATGVPLAKVGARCMAGISLKEQGVEKEVVPDFYAVKEAVFPFIKFPGVDTILGPEMRSTGEVMGVGASFGEAYYKAQLGAGERLNPTGKIFLSVREEDKERVIKTAKNFQVLGYGICATRGTAQYLTEHGLIVQTINKVPEGRPHIGDALKNGEIALVVNTVSSDPQSVSDSHIIRQSALQQRVPQYTTTAGGEAMSEGAKSRDHLGVYSVQELHGRLKNRN

SEQ ID NO: 8072 - protein, 299 aa, Neisseria meningitidis; identical to SEQ ID NO: 1640

SEQ ID NO: 8073 - protein, 192 aa, Neisseria meningitidis
MNILLLDGGKAFGHSHGGLNRTLHKKAKEVLTALGHNVQETVIDAGYDVEAEIEKFVWMDAVIWQMPGWWMHEPWTVKKYIDEVLTAGHGKLYQSDGRHSVNPTEGYGTGGLLQGKKHMISLTWNAPIEAFTREGDFFEGKGVDVLYMHFHKANEFLGMTRLPTFLCNDVVKNPQVEKYLADYQAHLEKVFG

SEQ ID NO: 8074 - protein, 128 aa, Neisseria meningitidis
MTYSGLNLNQDKATKPQTVQIVRQGEATLYWFLLIHYRFRRERRETQSLLMTRNTLKFIPFWSYKHITYAIFLYSRLPENSGQEYLTQRKAEKATKNNLHLSRLVSPTLGVQTIQSFRLPLFVYKINF

SEQ ID NO: 8075 - protein, 346 aa, Neisseria meningitidis
MDISDFDFTLPEKLIAQHPPEVRGSSRLLVALPDMPLQDRVFGDLPDYVEAGDVLVFNNTKVMKARLFGQKDSGGRIEALIERVLDNHTALAHIRSSKSPKPGMGLVFEGGIRAVTVGREGELFCLRFEGGETVYELLEQNGHLPLPPYIERAADADDDSRYQTVYAKYQGAVAAPTAGLHFTEELLHRLKDKGAVTAEVTLHVGAGTFQPVRVDKIEEHKMHSEWFEVPSETAAAVEAAKARGNKVWAVGTTSMRALESAARATGRLKAGQGDTDIFITPGYRFNVVDRLVTNFHLPKSTLLMLVSAFSGMGHIRAAYRHAVEREYRFFSYGDAMVLGRNEGVVR

SEQ ID NO: 8076 - protein, 151 aa, Neisseria meningitidis
MDLRKLKKLIDLVEESGIAEIEVTEGEEKVRITRTIAAAPVYAAPVPAAAPAVTPAAAPVAASAPAAAPAARDLSDAQKSPMVGTFYRAPGPNAAPFVEVGQQVKAGDTLCIIEAMKLMNEIEAEKSGTVKEILVENGTPVEFGEPLFIIG

SEQ ID NO: 8077 - protein, 453 aa, Neisseria meningitidis
MLKKVLIANRGEIALRVLRACREMGIATVAVHSEADKDSLHVKLADESVCIGPAASAQSYLNVPAIIAAAEVSCADAVHPGYGFLAENADFAEQVEQSGFTFIGPKPDTIRLMGDKVSAKHAMIAAGVPCVPGSDGALPDDGEEILKIADKVGYPVIIKASGGGGGRGMRVVEKKEDLLQSVEMTKAEAGAAFGNPMVYMERYLQRPRHVEIQVIADEHGNAIYLAERDCSLQRRHQKVIEEAPAPFITEKERAKIGNACADACKRIGYRGAGTFEFLYEDGEFFFIEMNTRVQVEHPVTELITGVDIVQEQLRIAAGLPLQYKQKDIQVEGHAFECRINAEDPYNFIPSPGLIESCHLPGGFGIRVDSHIYQGYRIPPYYDSLIGKICVHGKTREQAMAKMRVALAELAVTGIKTNTPLHRDLFADAGFQKGGVSIHYLEHWLEDRKAKQDK

SEQ ID NO: 8078 - protein, 295 aa, Neisseria meningitidis
MPYQQITVNVNDAVAERLADALMEHGALSAAIEDAYAGTQNEQAIFGEPGMPAEQIWQQSKVIALFGEHDEAAAIIQTATQECGLKDLAYTGETIEDQDWVRLTQSQFDPIRISDRLWITPSWHEVPEGSAVNLRLDPGLAFGTGSHPTTRLCLKWLDTQLKNGESVLDYGCGSGILTIAALKLGAGFAVGVDIDEQAVRAGKDNAAQNNVDAQFFLPDGLPQGQFDVVVANILANPLRMLGEMLAARTKQGGRIVLSGLLDEQAEELGGIYSQWFDLDPAETEEGWARLSGVKR

SEQ ID NO: 8079 - protein, 187 aa, Neisseria meningitidis
MQDKNNLCWLDMEMTGLNPETDRIIEVAMIITDSDLNVLAQSEVYAVHQSDDVLNKMDEWNTATHGRTGLTQRVRESSHTEAEVEQKLLDFMSEWVPGRATPMCGNSIHQDRRFMVKYMPKLENYFHYRNLDVSTLKELAKRWNPPVAKSVVKRGSHKALDDILESIEEMRHYREHFLISAPRAEAQ

SEQ ID NO: 8080 - protein, 427 aa, Neisseria meningitidis
MNRNEILFDRAKAIIPGGVNSPVRAFGSVGGVPRFIKKAEGAYVWDENGTRYTDYVGSWGPAIVGHAHPEVVETVCEAALGGLSFGAPTEGEIVIAEEIAKIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGNEIACVIVEPFVGNMNLVRPTEAFVKALRGLTEKYGAVLIYDEVMTGFRVALGGAQSLHGITPDLTTMGKVIGGGMPLAAFGGRKDIMECISPLGGVYQAGTLSGNPIAVAAGLKTLEIIQREGFYENLTARTEQLVQGFRTAADAAGIEFTADSVGGMFGLYFAAHAPRNYADMARSNIEGFKQFFHGMLDRNVAFGPSAYEAGFVSAAHTPELIDETVAVAVEVFKAMAE

SEQ ID NO: 8081 - protein, 72 aa, Neisseria meningitidis
MPSERQVSGLEAESPILSFFRLRQGFARFFADHANRIPDDGTLVFFHFMCKAVVSDDSLPVVIHTPLPMSAF

SEQ ID NO: 8082 - protein, 442 aa, Neisseria meningitidis
MKKVFIRTFGCQMNEYDSDKMLAVLAEEHGGIEQVTQADEADIILFNTCSVREKAQEKVFSDLGRVRPLKEKNPGLIIGVAGCVASQEGENIIKRAPYVDVVFGPQTLHRLPKMIVDKETSGLSQVDISFPEIEKFDHLPPARVEGGAAFVSIMEGCSKYCSFCVVPYTRGEEFSRPLNDVLTEIANLAQQGVKEINLLGQNVNAYRGEMDDGEICDFATLLRIVHEIPGIERMRFTTSHPREFTDSIIECYRDLPKLVSHLHLPIQSGSDRVLSAMKRGYTALEYKSIIRKLRAIRPDLCLSSDFIVGFPGETEREFEQTLKLVKDIAFDLSFVFIYSPRPGTPAANLPDDTPHEEKVRRLEALNEVIEAETARINQTMVGTVQRCLVEGISKKDPDQLQARTANNRVVNFTGTPDMINQMIDLEITEAYTFSLRGKVVEA

SEQ ID NO: 8083 - protein, 637 aa, Neisseria meningitidis
MNPSPLLDLIDSPQDLRRLDKKQLPRLAGELRTFLLESVGQTGGHFASNLGAVELTIALHYVYDTPEDKLVWDVGHQSYPHKILTGRKNQMHTMRQYGGLAGFPKRCESEYDAFGVGHSSTSIGAALGMAAADKLLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCVPNMIVAAPSDENECRLLLSTCYQADAPAAVRYPRGTGTGAPVSDGMETVEIGKGIIRREGEKTAFIAFGSMVAPALAVAEKLNATVADMRFVKPIDEELIVRLARSHDRIVTLEENAEQGGAGGAVLEVLAKHGICKPVLLLGVADTVTGHGDPKKLLDDLGLSAEAVERRVRAWLSDRDAAN

SEQ ID NO: 8084 - protein, 301 aa, Neisseria meningitidis
MGLDGLAAYLDAYLENIVREGKSEHTVAAYRRDLQELLALLEEMPSANPSNCTRGDFVQALRRLSGRGLGERTLARKLSSWRQYCVWLVKRGLMHADPTADIKPPKQPERVPKALPQEWLNRMLDLPVDGGDPLAVRDHALFELMYGSGLRVSEIHGLNADDVYLDEAWVHVIGKGRKQRQVPLVGKSVEALKNYLPLRQTASDGKALFTGRNGTRLSQRQIQKRLAQWAAQNGDGRHVSPHMMRHSYAGHLLQASRDIRAVQELLGHSSLSTTQIYTKLDFDHIARLYDEAHPRAKRQDE

SEQ ID NO: 8085 - protein, 354 aa, Neisseria meningitidis
MALVSMRQLLDHAAENSYGLPAFNVNNLEQMRAIMEAADQVDAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVCFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMASRYAKGELNQIVK

SEQ ID NO: 8086 - protein, 320 aa, Neisseria meningitidis
MPSEPPFGRHLIFASLTCLIDAVCKKRYHNQNVYILSILRMTRSKPVNRTAFCCLSLTTALILTACSSGGGGVAADIGAGLADALTAPLDHKDKGLQSLTLDQSVRKNEKLKLAAQGAEKTYGNGDSLNTGKLKNDKVSRFDFIRQIEVDGQLITLESGEFQVYKQSHSALTAFQTEQIQDSEHSGKMVAKRQFRIGDIAGEHTSFDKLPEGGRATYRGTAFGSDDAGGKLTYTIDFAAKQGNGKIEHLKSPELNVDLAAADIKPDGKRHAVISGSVLYNQAEKGSYSLGIFGGKAQEVAGSAEVKTVNGIRHIGLAAKQ

SEQ ID NO: 8087 - protein, 225 aa, Neisseria meningitidis
MQADFNRPVLAVDTGTSRLSLALRADGETRLFHQEVGSRQSELILPEIRTLFRDAGITAADLGAVVYAQGPGAFTGLRIGIGVAQGLATPFDTPLIGVPSLDAAASLPPPQSCILAATDARMGEVFYAWFDTLNCHRLSDYQVGRAADIRLPEGCAFSDGIGSAFALEEAPPFSGRPDMPTAADFLALAAKGGYPAVHAAHAGLLYVRNKIALTAKEQAERRARP

SEQ ID NO: 8088 - protein, 146 aa, Neisseria meningitidis
MNIRRAVCADCEELAALDAVCNPSAWTQRQFESALVSPSEQVFLAEKDGGIAAFIVWQNLPDESELHLIATAPECRRQGIASALLEYWFTHLPEDTQRLLLEVRAGNTAAQALYTAHGFSITGRRKNYYRTADGKTEDAVLMEKIC

SEQ ID NO: 8089 - protein, 245 aa, Neisseria meningitidis
MLSARYLHLHEALGLGPMWLKQAAAVLPPKNTPAPSAQARPQTVRAAPIRPSQPHNGQARLETMKALETAAVPTRKPAPETETPLPGLSDGIAPVPAASGITKLAVVSLCPPIEDAVYGQLFHGKAGILLDNILKAVGLDAAYVHKTCWVKTAAVGNPMPSEQAVANALGQIARELDGCRAPAVLFLGQAFVQPERQTMIETLCGSRPFFIIDHPARLLRQPELKARAWQVLKQLKRALRQGGGS

SEQ ID NO: 8090 - protein, 213 aa, Neisseria meningitidis; identical to SEQ ID NO: 1120

SEQ ID NO: 8091 - protein, 144 aa, Neisseria meningitidis
MPACFCPHCKTRLWVKETQLNVAQGFVVCQKCEGLFKAKDHLASTKEPIFNDLPEAVSDVKLVHRIGTRAIGKKQISRDEIAGILNGGTTQPDIPPATAATPAAAPQVTVPPAAPARQDGFNWTIATLFALIVLIMQLSYLVIL

SEQ ID NO: 8092 - protein, 436 aa, Neisseria meningitidis
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 8093 - protein, 671 aa, Neisseria meningitidis; identical to SEQ ID NO: 1144

SEQ ID NO: 8094 - protein, 195 aa, Neisseria meningitidis
MCALHLDFSLEKLRRWHDEGLLDERLFSPQTIGRFALQRLAQNAAALTAAACPLLQRPFESDGFGLLADEAAALELSARLLRFTFRRHDNGYRRRRIDEAADILQHEFARPLTIAEIARRVGLNECYLKRYFKAQTGETVAGCLRRLRLEHALALIESGSTVQAAMHFCGYRHAGRFNEAFRRHYGFLPSDVKKC

SEQ ID NO: 8095 - protein, 103 aa, Neisseria meningitidis
MNTAAIYRQYQTYVRSDKSGWALDGCSDSALIAQAKQPGLHLEMCINRFDSGITLSRMRGGGTGAFPTEIHNFSHNCALFVMVSGQNRLQMGGREYRPSAGEI

SEQ ID NO: 8096 - protein, 321 aa, Neisseria meningitidis
MKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGARQLIQAAEQLKAAFKKAEPVAAGKK

SEQ ID NO: 8097 - protein, 107 aa, Neisseria meningitidis
MQNETINLKQHLAAIKEYWQPEIINRHGFQFHLVKLLGDYGWHTHGYSDKVLFAVEGDMAVDFADGGSMTIREGEMAVVPKSVSHRPRSENGCSLVLIELSDPSEAV

SEQ ID NO: 8098 - protein, 725 aa, Neisseria meningitidis; identical to SEQ ID NO: 666

SEQ ID NO: 8099 - protein, 96 aa, Neisseria meningitidis
MRQAFQTAFLKCVYLWCSKRSSESAASAKLKRGINEVKICLNLKGSLHPNPLSRGRGLGRGGQTESLLGRHFQCAGCFYSGLTKIRTRRRSRRQYK

SEQ ID NO: 8100 - protein, 107 aa, Neisseria meningitidis
MDIVQLGPAELKAWMDEGRMFCLLDVRTDEETAVCSLPNALHIPMNLIPLRQNELPDDVPLVVYCHHGIRSLHTAMYLADAGFENLYNLQGGIDAWAAEIDGNMMRY

SEQ ID NO: 8101 - protein, 218 aa, Neisseria meningitidis
MDFEKARFNMVEQQIRPWDVLDFDVLDALAEIPRELFVDEDLQGLAYADMALPLANGHKMLEPKVVARLAQGLKLTKNDTVLEIGTGSGYATALLAKLAGRVVSDDIDVEQQNRAKAVLDGLGLDNIDYVQNNGLTELSAGAPFDAVYVGGAVNLVPEVLKEQLKDGGRMVVIVGRKPVQRALLITRRGDVFEEKVLFDTLVAHLDDKDADPFGGFDF

SEQ ID NO: 8102 - protein, 167 aa, Neisseria meningitidis
MHALHFSASDKAALYREVLPQIESVVADEADWVANLANTAAVLKEAFGWFWVGFYLVDTRSDELVLAPFQGPLACTRIPFGRGVCGQAWAKGETVVVKDVNAHPDHIACSSLSRSEIVVPLFSDGRCIGVLDADSEHLAQFDETDALYLGELAKILEKRFEASRQAV

SEQ ID NO: 8103 - protein, 257 aa, Neisseria meningitidis
MYRQIGMWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 8104 - protein, 116 aa, Neisseria meningitidis
MEAFKTLIWIVNIISALAVIVLVLLQHGKGADAGATFGSGSGSAQGVFGSAGNANFLSRSTAVAATFFFATCMAMVYIHTHTTKHGLDFSNVQQTQQAPKPVSNTEPSAPVPQQQK

SEQ ID NO: 8105 - protein, 30 aa, Neisseria meningitidis
MAVKPLGYIRGIGRQRNALKTQFEPLKAID

SEQ ID NO: 8106 - protein, 122 aa, Neisseria meningitidis
MRIFKNQWIVKFAKKHKINDSELLEAVERADNGLIDADLGGGVIKQRIARQGQGRSGGYRSLILFKQADKAFFVYAFAKNDRENISDKELDVYRKAAAYYLKYTRAELAALKEDGIITEIES

SEQ ID NO: 8107 - protein, 103 aa, Neisseria meningitidis
MKYKNEALAAIHEMMEGAYNIGAIDKKTMRDFDKSCLTEIKPLSGGDIKAIREKEALSQAAFAIYLNVGKNHVSAWERGVKKPSGAALKLLTIVKNKGIEAIA

SEQ ID NO: 8108 - protein, 70 aa, Neisseria meningitidis
MPDRIKPSRNGGGADDIARQQGTAQTGAKPETSPTARYGDFLRPLQGGIGFKRRGLEGKTGGAQNCLNAV

SEQ ID NO: 8109 - skipped

SEQ ID NO: 8110 - protein, 43 aa, Neisseria meningitidis
MRDFDKPAEEAAEYAAEGAVKFIEGKPAKKIIAVPGRLENIVV

SEQ ID NO: 8111 - protein, 47 aa, Neisseria meningitidis
MISNHDTEFTRDIYSSAILKTVEVQRNIAAKGSSSRKKVGELLAIYA

SEQ ID NO: 8112 - protein, 267 aa, Neisseria meningitidis
MNLFFDTELGKQQNKATHKIRVMSEAWLEKNGYCPCCGSKPMQRFANNKPVADLFCPNCHEQYELKSKNQKTIGNSVPDGAYHTMLERIRSDTNPNFFFLAYKKADYSIRQLVLVPKHFITPDMIIPRNKGIKNRPNHIMCSINLAPLPESGKIFLIDNSRIIEPETVLKKWQSNLFLRNQNAERKGWLLAVMKCIDQLPEEFTLSQMYEFENKLSIQFPQNNHIRDKIRQQLQILRDQNTIEFIGRGLYKKSINCAQLPRYFDFKS

SEQ ID NO: 8113 - protein, 876 aa, Neisseria meningitidis
MQEQYRPAAIEPAAQKKWDDARIFNVSEDASKPKYYCLSMFPYPSGKLHMGHVRNYTIGDVLSRFKLLNGFNVMQPMGWDAFGMPAENAAMKNNVAPAAWTYDNIEYMKTQLKSLGFAIDWARETATCKPEYYRWEQWLFTKLFEKGIVYRKNGTVNWDPVDQTVLANEQVIDGRGWRSGALIEKREIPMYYFKITDYAEELLNDLDKLEHWPEQVKTMQRNWIGKSRGMTVRFAVSDDSKQGLEGDYAKFLQVYTTRPDTLMGATYVAVAAEHPLAAAAAADKPELQAFIAECKAGSVAEADMATMEKKGVPTGRYVVNPLNGDKLEVWIANYVLWGYGDGAVMAVPAHDERDFEFATKYNLPKKQVIAVGDNAFDENQWQEWYGDKENGVLVNSGDLDGLDFQTAFDAVAAKLQSQGAGEPKTQYRLRDWGISRQRYWGCPIPIVHCEQCGDVPVPADQLPVVLPENVVPDGMGSPLAKMPEFYETACPCCGGAAKRETDTMDTFMESSWYFFRYMSPKFSDGMVDPAAAKYWGAVDQYIGGIEHAILHLLYARFFTKLMRDEGLVNVDEPFERLLTQGMVVCETYYRENDKGGKDWINPADVELTFDDKGRPISAVLKADGLPVVISGTEKMSKSKNNGVDPQELINAYGADTARLFMMFAAPPEQSLEWSDSGVEGAHRFLRRLWRTVYEYLKQGEAVKAFAGSQDGLSKELKDLRHKLHATTAKVSDDYGRRQQFNTAIAAVMELLNQYDKTDTGGEQGRAVAQEVLETAVRLLWPIVPHICETLWSELNGAKLWEAGWPTVDEAALVKSEIEVMVQVNGKLRGKITVAADASKADLEAAALATEGAVKFMEGKPAKKIIVVPGRLVNIVV

SEQ ID NO: 8114 - protein, 171 aa, Neisseria meningitidis
MKIKQIVKPGLAVLAAGVLSACATKSNVKADGTTDNPVFPKPYSVTLDNKRGTFPTYDELDQMRPGLTKDDIYKILGRPHYDESMYGVREWDYLFHFHTPGVGIDPENTSGVEDVTTCQYKVIFDKDKFARSFYWNPVFPKDAACPPPAPKAEPQVIIREIVPAKPKRIRQ

SEQ ID NO: 8115 - protein, 147 aa, Neisseria meningitidis
MPFRLFLGILCGLSMVAPVYAQGQPDTVGDFIQKKKVIVDTSKAELCFADDRQCHPVLIGVATPKGTFGLTLNSTDKPGYGGEVIGFKQEGDFLFALHRVWNQIPSERRNERIASPSVSDRIMTNGCINVSDAVYEKLRHYFVLEVI

SEQ ID NO: 8116 - protein, 716 aa, Neisseria meningitidis
MPSETGADAAKPSDGIACPLRPNNNHLWENLMPEQNRILCRELSLLAFNRRVLAQAEDQNVPLLERLRFLCIVSSNLDEFFEVRMAWLKREHKRCPQRRLDNGKMPSETIADVTEAARSLIRHQYDLFNNVLQPELAQEGIHFYRRRNWTDTQKKWIEDYFDRELLPILTPIGLDPSHPFPRPLNKSLNFAVELDGTDAFGRPSGMAIVQAPRILPRVVPLPSELCGGGHGFVFLSSILHAHVGKLFPGMNVKGCHQFRLTRDSDLTVDEEDLQNLRAAIQNELHDREYGDGVRLEVADTCPAYIRDFLLAQFKLTAAELYQVKGPVNLVRLNAVPDLVNRPDLKFPTHTPGRLKALGKTASIFDLVRQSPILLHHPYQSFDPVVEMMREAAADPAVLAVKMTIYRTGTRSELVRALMKAALAGKQVTVVVELMARFDEANNVNWAKQLEEAGAHVVYGVFGYKVHAKMALVIRREDGVLKRYAHLGTGNYHQGTSRIYTDFGLITADEQITADVNILFMEITGLGKPGRLNKLYQSPFTLHKMVIDRIARETEHAKAGKPARITAKMNSLIEPTVIEALYRASAAGVQIDLIVRGMCTLRPGVKGLSENIRVRSIVGRQLEHARVYYFHNNGTDDTFISSADWMGRNFFRRIETATPITAPELKKRVIHEGLTMALDDNTHAWLMQPDGGYIRAAPAEGESEADLQNDLWTLLGG

SEQ ID NO: 8117 - skipped

SEQ ID NO: 8118 - protein, 367 aa, Neisseria meningitidis
MLILQAERDSLLKPLQAVTGIVERRHTLPILSNVLIEGKGGQTKLLATDLEIQIDTAGPEGGAGDFRITTNAKKFQDILRALPAGALVSLDWDDSRLTLKAGKSRFALQTLPAADFPMMNVGEDISATFSLEQERFKTMLSQVQYSMAVQDIRYYLNGLLMQVEGSQLRLVATDGHRLAYAACAIDADLPRAEVILPRKTVLELFKLLNNPDDPIQIELLDKQVRFQCNGTTIVSKVIDGKFPDFNRVIPLDNDKIFVLSRAELLGALERASILANEKFRGARLFLQPGLLSVVCSNNEQEEAREEIEIAYQGGELEVGFNIGYLMDVLRNIHSDDMQLAFGDANRSTLFTVPNNPNFKYIVMPMRI

SEQ ID NO: 8119 - protein, 518 aa, Neisseria meningitidis
MTLAEFWPLCLRRLHDMLPQGQFAQWIAPLTVGEEGGVWVVYGKNQFACNMLKSQFAGKIEAVREELAAGRSAFVFKPGEGVRYEMAAVEGAVEPAEPSLHAVSEGMPVQEVLLDELPSEEPVKPAASKTAADILAERMKNLPHEPRQAAGSASRPESVAVAKARTDVQRDAEEARYEQTNLSPDYTFDTLVEGKGNRLAAAAAQAIAESPGQSYNPFFLYGSTGLGKTHLVQAVGNELLKNRPDAKVRYMHSDDYIRSFMKAVRNNTYDVFKQQYKQYDLLIIDDIQFIKGKDRTMEEFFYLYNHFHNEKKQLILTCDVLPAKIEGMDDRLKSRFSWGLTLELEPPELEMRIAILQKKAEAAGISIEDEAALFIANLIRSNVRELEGAFNRVGASSRFMNRPVIDIDLARTALQDIIAEKHKVITADIIIDAVAKYYRIKISDVLGKKRTRNIARPRQVAMSLTKELTTLSLPSIGDSFGGRDHTTVMHGIRAVAKLREEDPELAQDYEKLLILIQN

SEQ ID NO: 8120 - protein, 44 aa, Neisseria meningitidis
MKRTYQPSVTKRKRTHGFLVRSKTRGGRAVLAARRAKGRKRLAV

SEQ ID NO: 8121 - protein, 121 aa, Neisseria meningitidis
MDYRFGRQYRLLKTDDFSSVFAFRNRRSRDLLQVSRSNGNGLGHPRIGLVVGKKTAKRANERNYMKRVIRDWFRLNKNRLPPQDFVVRVHRKFDRATAKQARAELAQLMFGNPATGCRKQA

SEQ ID NO: 8122 - protein, 73 aa, Neisseria meningitidis
MNFLLSKLLLGLIRFYQYCISPLIPPRCRYTPTCSQYAVEAVKKYGAFKGGRLAIKRIARCHPFGGHGHDPVP

SEQ ID NO: 8123 - protein, 545 aa, Neisseria meningitidis; identical to SEQ ID NO: 52

SEQ ID NO: 8124 - protein, 241 aa, Neisseria meningitidis
MSEGMMSPVLYLIPTPLGTPDTPCLLPHEQQAIVGLTDFVVEAEKTARAHLKHLGVTTPIRELNLQTLNEHTDLKTLPELLKPLQEGRSMGIVSEAGCPAVADPGANLVALAHKHGFEVRPLVGPSSLLLALMASGANGQSFAFKGYLPSEKNERIQAFRALEQRSRQCGETQIFIETPYRNDALLADAVENLHPETRLCTATDLTLPTQEIISQTIVQWRKRKEMPNLKKRPTIFVMYAG

SEQ ID NO: 8125 - protein, 196 aa, Neisseria meningitidis
MGLELPLILGTSSVFRREQMERLGIAFQAASPDFDETPMLGESAPQTALRLAEGKARSLTGRFPEALIVGADQVAWCDGRQWGKPMNLANAQKMLMHLSGREIEFYSAIVLLNTVTGRMRRHIDKTVVVMRQLDELHILRYLEREPDAVYCSCALKSEDLGALLIERIESTDPNALIGLPVFRLVDFLKNEGVEVL

SEQ ID NO: 8126 - protein, 167 aa, Neisseria meningitidis
MSDPNLIDLEIFAAEGQNLQGSFLLEELDERVSSHDYPADRQTKISFTLTGGRDRLQRLFLDLNVKADMPLICQRCIKPMPFMLDESSRIVLFSNEESLDESMLADEELEGILIEKELDVRTLVEDQILMSLPFSPRHEDCGDNGTLEEVNRDKPNPFAVLAGLKSN

SEQ ID NO: 8127 - protein, 59 aa, Neisseria meningitidis
MAVQQNKKSPSKRGMHRSHDALTAPALSVDSTTGEVHRPHHISPNGMYRGRKVVKAKGE

SEQ ID NO: 8128 - protein, 175 aa, Neisseria meningitidis
MKQKIWYTYDDIHRVIKALAEKIRNADIKYDAMIAIGGGGFIPARMLRCFLEIPIYAVTTAYYDSDNEGQVTEEVKKVQWLDPVPEALRGKNVLVVDEVDDSRVTMEFCLKELLKEDFGTIGVAVLHEKIKAKAGKIPEGIPYFSGITVEDWWINYPWDALDIDEHNRLAEAGRG

SEQ ID NO: 8129 - protein, 351 aa, Neisseria meningitidis
MITLAVDAMGGDQGLAVTVPGATAFLQAHPDVRLIMTGDETQLRQALTAAGAPMERIDICHTTQVVGMDEAPQSALKNKKDSSMRVAINQVKEGKAQAAVSAGNTGALMATARFVLKTIPGIERPAIAKFLPSDTDHVTLALDLGANVDCTSEQLAQFAVIGSELVHALHPQKGQPRVGLVNVGTEDIKGTDTVKQTYKLLQNSKLNFIGNIESNGILYGEADVVVADGFVGNVMLKTIEGAVKFMSGAIRREFQSNLFNKLAAVAALPALKGLKNKLDPRKFNGAILLGLRGIVIKSHGGTDETGFRYALEEAYHEAKSAGLSKIEQGVAEQLAALETAKAVQNENVGGL

SEQ ID NO: 8130 - protein, 83 aa, Neisseria meningitidis
MKTLEKRMKALDKRIMKFGKSLEGRLDARLIESALDYIHYSERFLAFEILCTYIEDFDVRLTEQESREISFINKEFEIESTSD

SEQ ID NO: 8131 - protein, 129 aa, Neisseria meningitidis
MKTSTVVFGGFFMADNGERIQIPVLENPDIREINHFFSVSNFEKKTGVLVFRIIPEPEFGNTELTVYFKKGYYSGLTKTSTALPRLAVLVFVNPLYQTKTNTRANSLTATRQSKCRLKQLGLSDGISFA

SEQ ID NO: 8132 - protein, 320 aa, Neisseria meningitidis
MQYAKISGTGSYLPANRVSNDDLAQKVDTSDEWITARTGIKFRHIAAENEKTSDLAAEAAHRALDAAGLDSGEIDLIIVATATPDMQFPSTATIVQQKLGITNGCPAFDVQAVCAGFMYALTTANAYIKSGMAKNALVIGAETFSRIVDWNDRTTCVLFGDGAGAVVLSASDTPGIIHSKLKADGNYLKLLNVPGQIACGKVSGSPYISMDGPGVFKFAVKMLSKIADDVIEEAGYTAAQIDWIVPHQANRRIIESTAKHLGLSMDKVVLTVQDHGNTSAASIPLALDTGIRSGQIKRGQNLLLEGIGGGFAWGAVLLQY

SEQ ID NO: 8133 - protein, 135 aa, Neisseria meningitidis
MKRQAFFKLMACAAFLSAVSLRLPVLGACYAILSLYAFALYGIDKRCAIRGQRRIPEHRLLLPALLGGWVGAYFGSMTFKHKTAKKRFVVLFRLTVSGNVLATLILIYSGLNLNQYGVASPCRTICTVCGFVALS

SEQ ID NO: 8134 - protein, 308 aa, Neisseria meningitidis
MSFAFFFPGQGSQSLGMMNGFAEHAIVKNTFAEASAILGQDLWAMINGSDAEIIGQTVNTQPIMLAAGVAVYRAYLEAGGKTPAAVAGHSLGEYTALVAAGALNFADAVKLVRLRAELMQSAVPQGVGAMAAILGLEDEQVKAICAEAAQSEVVEAVNFNSPGQIVIAGNAAAVGRAMAAAKEAGAKRALPLPVSVPSHCSLMKPAADKLAEALKTVEIKQPQIRVIHNADVAAYDDADKIKDALVRQLYSPVRWTETVNALVSDGIAESAECGPGKVLAGLAKRINKAAACSALTDAGQVAAFIEAH

SEQ ID NO: 8135 - protein, 621 aa, Neisseria meningitidis
MIEKLTFGLFKKEDARSFMRLMAYVRPYKIRIVAALIAIFGVAATESYLAAFIAPLINHGFSAPAAPPELSAAAGIISTLQNWREQFTYMVWGTENKIWTVPLFLIILVVIRGICRFTSTYLMTWVSVMTISKIRKDMFAKMLTLSSRYHQETPSGTVLMNMLNLTEQSVSNASDIFTVLTRDTMIVTGLTIVLLYLNWQLSLIVVLMFPLLSLLSRYYRDRLKHVISDSQKSIGTMNNVIAETHQGHRVVKLFNGQAQAANRFDAVNRTIVRLSKKITQATAAHSPFSELIASIALAVVIFIALWQSQNGYTTIGEFMAFIVAMLQMYAPIKSLANISIPMQTMFLAADGVCAFLDTPPEQDKGTLAPQRVEGRISFRNVDVEYRSDGIKALDNFNLDIRQGERVALVGRSGSGKSTVVNLLPRFVEPSAGNICIDGIDIADIKLDCLRAQFALVSQDVFLFDDTLFENVRYSRPDAGEAEVLFALQTANLQSLIDSSPLGLHQPIGSNGSNLSGGQRQRVAIARAILKDAPILLLDEATSALDNESERLVQQALERLMENRTGIIVAHRLTTIEGADRIIVMDDGKIIEQGTHEQLMSQNGYYTMLRNISNKDAAVRTA

SEQ ID NO: 8136 - protein, 521 aa, Neisseria meningitidis
MTQDKILILDFGSQVTQLIARRVREAHVYCELHSFDMPLDEIKAFNPKGIILSGGPNSVYESDYQADTGIFDLGIPVLGICYGMQFMAHHLGGEVQPGNQREFGYAQVKTIDSELTRGIQDGEPNTLDVWMSHGDKVSKLPDGFAVIGNTPSCPIAMMENAEKQFYGIQFHPEVTHTKQGRALLNRFVLDICGAQPGWTMPNYIEEAVAKIREQVGSDEVILGLSGGVDSSVAAALIHRAIGDQLTCVFVDHGLLRLNESKMVMDMFARNLGVKVIHVDAEGQFMAKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVIALRAVITSDFMTAHWAELPYSLLGKVSNRIINEVKGINRVVYDVSGKPPATIEWE

SEQ ID NO: 8137 - protein, 248 aa, Neisseria meningitidis
MSTQDLNGKIALVTGASRGIGAAIADTLAAAGAKVIGTATSESGAAAISERLAQWGGEGRVLNSAEPETIESLIADIEKAFGKLDILVNNAGITRDNLLMRMKEEEWDDIMQVNLKSVFRASKAVLRGMMKQRSGRIINITSVVGVMGNAGQTNYAAAKAGLIGFSKSMAREVGSRGITVNCVAPGFIDTDMTRALPEETRQTFTAQTALGRFGDAQDIADAVLFLASDQAKYITGQTLHVNGGMLMP

SEQ ID NO: 8138 - protein, 52 aa, Neisseria meningitidis
MVEQSFGTLHHKFRYARAAYFGLIKVSAQSHLKAMCLNLLKAANRLSAPAAA

SEQ ID NO: 8139 - protein, 127 aa, Neisseria meningitidis
MYCLRLRRLVLIFVNPLYIIATTVPAQQAFLDAAELMQWSIETEGLGLNVISHKILGKDHAQVEFEAYFRDGQHRSAHHELSGFVNIGGQWYFIDPTVPHPAMKQPCICGSGKKFKACCGKYLKPVA

SEQ ID NO: 8140 - protein, 231 aa, Neisseria meningitidis
MLSEADIAAQTAFAAALPLLIDSPMLGEEMSRQEQSALWEQYSGEKGLWIVDPIDGTNNFVNGLPHFAVSVAFVRNGRAELGVIYNPVSGECFYAERGQGAFLNGTRLPLRLVDKKLNEAIAGVEIKYLRSGKLSSRMSTLAPFGTIRSMGSSTLDWCYLACGRYDVYVHGGQKLWDYAAGALIFEEAGGRLTTLEGDGFWSGEHVFKRSVVAALEPKLFERWVGWIRENQ

SEQ ID NO: 8141 - protein, 241 aa, Neisseria meningitidis
MPRFHLPENLSVGQTVALPDNIVRHLNVLRVRPNENITLFDGKGKAHAARLTVLEKRRAEAEILHEDTTDNESPLNITLIQSISSGDRMDFTLQKSVELGVTAIQPVISERCIVRLDGERAAKRLARWQEIVISACEQSGRNTVPPVLPIIGYREALDKMPSESTKLIMSINRARKLGDIRQPSGAIVFMVGPEGGWTEQEEQQAFEAGFQAVTLGKRILRTETAPLAALAAMQTLWGDFA

SEQ ID NO: 8142 - protein, 280 aa, Neisseria meningitidis
MQNHVISLASAAERRAHIAATFGVRGIPFQFFDALMPSEELNRMMAELVPGLAKQHLLSEVEKACFMSHAVLWKQALDEGLPYVAVFEDDVLLGKDAEKFLAEDTWLEERFDKDSAFIVRLETMFAKVIVRPDKVLNYENRSFPLLESEHWGTAGYIISREAMRFFLERFAVLPAEWIKAVDWMMFTYFFDKEGMPVYQVNPALCTQELHYAKFLSKNSMLGSDLEKDREQERRHRRSLKVMFDLKRALGKFGREKKKRMERQRQAELEKAYGRRVISFK

SEQ ID NO: 8143 - protein, 31 aa, Neisseria meningitidis
MDIVFAADGRMRRLFTLRQYFGILRRLLKNR

SEQ ID NO: 8144 - protein, 275 aa, Neisseria meningitidis
MQNHVISLASAAERRAHIADTFGRHGIPFQFFDALMPSERLEQAMAELVPGLSAHPYLSGVEKACFMSHAVLWKQALDEGLPYITVFEDDVLLGEGAEKFLAEDAWLQERFDPDTAFIVRLETMFMHVLTSPSGVADYCGRAFPLLESEHWGTAGYIISRKAMRFFLDRFAALPPEGLHPVDLMMFSDFFDREGMPVCQLNPALCAQELHYAKFHDQNSALGSLIEHDRLLNRKQQRRDSPANTFKHRLIRALTKISREREKRRQRREQFIVPFQ

SEQ ID NO: 8145 - protein, 349 aa, Neisseria meningitidis
MPSEAFRRHRAYRENKLQPLVSVLICAYNVEKYFAQSLAAVVNQTWRNLDILIVDDGSTDGTLAIAQRFQEQDGRIRILAQPRNSGLIPSLNIGLDELAKSGGGGEYIARTDADDIAAPDWIEKIVGEMEKDRSIIAMGAWLEVLSEEKDGNRLARHHEHGKIWKKPTRHEDIADFFPFGNPIHNNTMIMRRSVIDGGLRYNTERDWAEDYQFWYDVSKLGRLAYYPEALVKYRLHANQVSSKYSIRQHEIAQGIQKTARNDFLQSMGFKTRFDSLEYRQIKAVAYELLEKHLPEEDFERARRFLYQCFKRTDTLPAGAWLDFAADGRMRRLFTLRQYFGILHRLLKNR

SEQ ID NO: 8146 - protein, 687 aa, Neisseria meningitidis
MMTQTLLIELLTEELPPKALNNLGNHFAASVAEGLEKAQLVDGAAEFTAYASPRRLAVQVKNVKAVQADQKIVKKGPAVANAMKDGAPTKALEGFARGAGAKIEDLTIVHDGKQDVYAYEYVQIGKPLGGLLEDIINQAVKKLPIPKVMRWGSSTFTFVRPVHGLVVLHGGDIVNVSVLGLQSGNKTLGHRFLSDGEITIENADSYAAQMREQGKVVASFAERKAAIQTVLEGQARRLNATAAADEALLDEVTALVEWPVVLEAGFEEHFLAVPQECLILTMQQNQKYFPLLDQNGKLMNRFLLVSNLQTEDPSHIIQGNERVLRARLSDAEFFYKQDQKATLESRLPKLTNVVYHNKIGSQAERIERLQSIAAHIAKALGADAAAAERAARLAKADLVTEMVGEFPELQGTMGKYYARLDGETEEITEAVEQHYQPRFAGDNLPEGKIAAAVALADKLETLVGIWGIGLIPTGDKDPYALRRAALGILRMLMQYGLDVNELIQTAFNSFPQGLLNEKTPSETADFMQARLAVLLQNDYPQDIVAAVLAKQPRRLDDLTAKLQAVAAFKQLPEAAALAAANKRVQNLLKKADAELGAVNESLLQQDEEKALFAAAQGLQPKIAAAVAEGNFQTALSELASVKPQVDAFFDGVMVMAEDAAVKQNRLNLLNRLAEQMNAVADIALLGE

SEQ ID NO: 8147 - protein, 115 aa, Neisseria meningitidis
MPVYFRTPSRKRLHKMNRRQHKKLHLGEFQTLIFGVQGSLHQAEDDAEAFDRFMDELIAYLAANGFEMAGGRLRRFFVPVSKIRCPKLGRNREKSHYLLAGRPRRCCHFVRHPAG

SEQ ID NO: 8148 - protein, 301 aa, Neisseria meningitidis
MLTFQQIIFKLQTFWADKGCTVIQPFDMEVGAGTSHPATCLRALGPEPWFAAYVQPSRRPKDGRYGDNPNRLQHYYQFQVALKPAPANIQDLYLDSLRELGIDPKVHDIRFVEDDWENPTLGAWGLGWEVWLNGMEVTQFTYFQQVGGIDCTPVLGEITYGIERLAMYLQGVENVYDLVWAKTLDGNTVTYGDVYHQNEVEQSTYNFEYSDADWLLRQFNDYEAQAKRLLAEENAALALPAYELVLKAGHTFNLLDARGAISVTERATYIGRIRALSRAVAQKYVESREKLGFPLMKANAA

SEQ ID NO: 8149 - protein, 140 aa, Neisseria meningitidis
MSIMQVEVVSSEQKIYSGEATFIVVPTVQGELGIYPRHEPIMSLVRPGALRLTVPGEDKEVLVAVSGGVLEVQPDKVTVLADVAVRSAEMDRARAEEAKKAAEAGISQAKDDKALAEAHKVLAAAIAQLKTLDYIRSHKK

SEQ ID NO: 8150 - protein, 465 aa, Neisseria meningitidis
MSQGKIVQIIGAVVDVEFPRDMIPRVYDALKLDENGLTLEVQQLLGDGVVRAIAMGSSDGLKRGMTVSNTGAPITVPVGKGTLGRIVDVLGTPVDEAGPIDTDKSRAIHQAAPKFDELSSTTELLETGIKVIDLLCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDENGKGRDVLFFVDNIYRYTLAGTEVSALLGRMPSAVGYQPTLAEEMGRLQERITSTQTGSITSIQAVYVPADDLTDPSPATTFAHLDATVVLSRDIASLGIYPAVDPLDSTSRQLDPMVLGQEHYDVARGVQSTLQKYKELRDIIAILGMDELSDEDKLTVMRARKIQRFLSQPFHVAEVFTGSPGKYVALRDTIAGFKAILNGEYDHLPEQAFYMVGSIEEAVEKAKTLN

SEQ ID NO: 8151 - protein, 291 aa, Neisseria meningitidis
MAVGKEILTKIRSVQNTQKITKAMQMVSTSKMRKTQERMRLARPYAEKVRMVMSHLAQTNTDHGIPLLESHREIRRVGFILITSDKGLCGGLNANVLKKFLAQVQEYRNQGIEEEIVCFGSKGLMACQSIGLNVVASAVNLGDTPKMEMLLGPLTELFQRYEKHEIDRIHLVYSGFVNTMRQEPRMEVLLPIGENVIGDSAPKSPFSWEYRYEPTALAVLEYLVRRYLESVVYQALSDNMASEQAARMVAMKAATDNAGNAIKELRLVYNKSRQAAITTELSEIVAGAAAV

SEQ ID NO: 8152 - protein, 515 aa, Neisseria meningitidis
MQLNPAEISDLIKAKIENLSVNAEVRTCGTVISVTDGIVRIHGLSDAMQGEMLEFPGNTFGLAMNLERDSVGAVVLGEYEHIKEGDTVTCTGRILEVPVGRELVGRVVDALGRPIDGKGPINTTLTAPIEKIAPGVIARKSVDQPMQTGLKAIDSMVPVGRGQRELIIGDRQTGKTAVALDAIVNQKGTGVICIYVAIGQKASSIANVVRKLEEHGAMEHTIVVAATASEAAALQYIAPYSGCTMGEFFRDRGEDALIVYDDLSKQAVAYRQISLLLRRPPGREAYPGDVFYLHSRLLERAARVNEHEVEKLTNGEVKGKTGSLTALPIIETQAGDVSAFVPTNVISITDGQIFLETDLFNAGIRPAINAGISVSRVGGAAQTKVIKKLGGGIRLALAQYRELAAFSQFASDLDEATRKQLEHGEVVTELMKQKQFSTLNTAEMALTLWAINNGSYSDVPVAKALAFESEFLSFVRTQHPEVLEAVNASGAMSDESEKTLEAAMKSFKSSYAYQA

SEQ ID NO: 8153 - protein, 177 aa, Neisseria meningitidis
MAEFATIARPYAKALFGLAQEKNQIESWLGGLEKLAAVVQEGKVASLIDRPETNASEKADILIDLVGLKDKELKNFVIVLAGQKRLSILPEVYAQYQDLTLSFNHIKSAVIYSAYPLTDKQVGELVQMLNKRFDSELKISVEIEPELIGGIKVEVGDQVLDLSVQGKLSALYTTMTN

SEQ ID NO: 8154 - protein, 156 aa, Neisseria meningitidis
MNINATLFAQIIVFFGLVWFTMKFVWPPIAKALDERAAKVAEGLAAAERGKSDFEQAEKKVAELLAEGRNQVSEMVANAEKRAAKIVEEAKEQASSEAARIAAQAKADVEQELFRARESLREQVAVLAVKGAESILRSEVDASKHAKLLDTLKQEL

SEQ ID NO: 8155 - protein, 78 aa, Neisseria meningitidis
MGLIAIACGLIVALGALGASIGIAMVGSKYLESSARQPELIGPLQTKLFLIAGLIDAAFLIGVAIALLFAFVNPFAGA

SEQ ID NO: 8156 - protein, 288 aa, Neisseria meningitidis
MAGETITAADYIKHHLQSLTSLSDVTQGQGLKNIADFSFINLDAVFFAVLLGVIGSFLLWRGAKKATAGVPGRFQAAVEILFEFVDDMCKSIIHNEKSRKAVAPLGLTLFVWIFLMNAMDMLPVDLLPMVWQGITGNHHALLRVVPTADLNTTLALAVGVLLICIYYNIKIKGLGGWFHELFSAPFGAKLAPANFLLNLVEFLSKTVSHGMRLFGNMYAGELVFLLIALLGGAWAASGSVEVMDPILFVFHIIAGLAWAIFHILVITLQAFIFMALAFVYIGQAHDAH

SEQ ID NO: 8157 - protein, 117 aa, Neisseria meningitidis
MKQIIILQSAVLSICAAVAFAVWGFAGFLSAVGGGLSYLLPTFVAVLLLKLFRGNPFLQSRMFVFGEILKVVLSLLSMLAVFAIWHQSLVFAPFLMGLLGVSHLVFLVLLRVKDYGR

SEQ ID NO: 8158 - protein, 97 aa, Neisseria meningitidis
MQFVWEAERTKAKVNAMLCLKRQAVANPLFGKGRLKIFSDDLLFIEQIPQTADNPTDKLLQFRVDFLLFPRKANKSRKNIKNVKKLRTNSLISCNYM

SEQ ID NO: 8159 - protein, 57 aa, Neisseria meningitidis
MGNIILLTFFLLHVRIVFLFSFLIFEEIMNTRIIVSAAFVALALAGCGSINNVTVSD

SEQ ID NO: 8160 - protein, 286 aa, Neisseria meningitidis
MAKVKGGLGRGLDSLLANGADNSSGDRLTTVAVKDIRPGRYQARVQIDDEALQELADSIKAQGVIQPVIVREHGLSRYELIAGERRWRAAQIAGLTEIPAVIKTISDETALAMGLIENLQRENLNPIEEAQGLKRLADEFGLTHETIAQAVGKSRSAISNSLRLLSLPEPVQEMLYQRRLEMGHARALLTLPVVEQLELAQKAVKNGWSVREVERRSQAALQNKRPEPKKTAAADIGRLNDLLTEKLGVNAEVKTANHKKGRIVLYFDTPETFGHLLEQLGIDYRP

SEQ ID NO: 8161 - protein, 190 aa, Neisseria meningitidis
MMVRRLIIGISGASGFQYGVKALELLRAQDVETHLVVSKGAEMARASETAYARDEVYALADFVHPIGNIGACIASGTFKTDGMLVAPCSMRTLASVAHGFGDNLLTRAADVVLKERRRLVLMVRETPLNLAHLDNMKRVTEMGGVVFPPVPAMYRKPQTADDIVAHSVAHALSLFGIDTPDSAEWQGMAD

SEQ ID NO: 8162 - protein, 287 aa, Neisseria meningitidis; identical to SEQ ID NO: 218

SEQ ID NO: 8163 - protein, 228 aa, Neisseria meningitidis
MADLTFQQAVSTIVGMKDEIFRALGETFVMVGLSTTFAVIFGTLLGVLLFVTSSRQLHYNKLVNFLLDNLVNLMRAFPFVILMIAMIPATRAIVGSTIGPVAASLVLSVSGLFYFARLVEQNLREVPKGVIEAAAAMGAPPIAIVCKVLLNEARAGMVSSITVLAIGLLSYSAAAGMIGGGGLGDLAIRYGYYRYQTEVIIFIVALLVLLVILIQSTGNALARKLDKR

SEQ ID NO: 8164 - protein, 245 aa, Neisseria meningitidis
MIILDKVSKHYQTRDKTRFAAVEPTSLEIRDGEIFGLMGYSGAGKSTLLRLINLLERPDSGKVNVCGQELTALDAAALRQARQNIGMVFQQFNLLSNRTVADNVAFPLEIAGWPSEKIKARVKECLEIVGLTERAGHYPAQLSGGQKQRVGIARALAPKPQVILADEPTSALDPATTRSVLECLEDINKRFNVTIVIVTHEMSVIRRLCDRAALLDKGKVVEIVEVRGNQIHAQSDIGRELIRED

SEQ ID NO: 8165 - protein, 616 aa, Neisseria meningitidis
MYLPSMKHSLPLLAALVLAACSSTNTLPAGKTPADNIETADLSASVPTRPAEPERKTLADYGGYPSALDAVKQKNDAAVAAYLENAGDSAMAENVRNEWLKSLGARRQWTLFAQEYAKLEPAGRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYYGKVADRRQLTDDQIEWYARAALRARRWDELASVISHMPEKLQKSPTWLYWLARSRAATGNTQEAEKLYKQAAATGRNFYAVLAGEELGRKIDTRNNVPDAGKNSVRRMAEDGAVKRALVLFQNSQSAGDAKMRRQAQAEWRFATRGFDEDKLLTAAQTAFDHGFYDMAVNSAERTDRKLNYTLRYISPFKDTVIRHAQNVNVDPAWVYGLIRQESRFVIGAQSRVGAQGLMQVMPATAREIAGKIGMDAAQLYTADGNIRMGTWYMADTKRRLQNNEVLATAGYNAGPGRARRWQADTPLEGAVYAETIPFSETRDYVKKVMANAAYYAALFGAPHIPLKQRMGIVPAR

SEQ ID NO: 8166 - protein, 70 aa, Neisseria meningitidis
MPAIRVKENEPFEVAMRRFKRAVEKTGLLTELRAREAYEKPTTERKRKKAAAVKRLQKRLRSQQLPPKMY

SEQ ID NO: 8167 - protein, 180 aa, Neisseria meningitidis
MRTHRKTCSAVCFAFQTASKPAVSIRHPSEDIMSLKIRLTEDMKTAMRAKDQVSLGTIRLINAAVKQFEVDERTEADDAKITAILTKMVKQRKDSAKIYTEAGRQDLADKENAEIEVLHRYLPQMLSAGEIRTEVEAAVAETGAAGMADMGKVMGLLKTRLAGKADMGEVNKILKAVLTA

SEQ ID NO: 8168 - protein, 130 aa, Neisseria meningitidis
MPTSTKPYILRALCEWCSDNSLTPHILVWVNEHTRVPMQYVRDNEIMLNIGATATQNLQIDNDWISFSARFGGQAHDIWIPVGHVLSLFARETGEGMGFELEAYRPDTPPENTSAETAPRPAKKGLKLVK

SEQ ID NO: 8169 - protein, 201 aa, Neisseria meningitidis
MMTLYSGITCPFSHRCRFVLYEKGMDFEIKDVDIYNKPEDLAVMNPYNQVPVLVERDLVLHESNIINEYIDERFPHPQLMPGDPVMRGRGRLVLYRMEKELFNHVQVLENPAATNKEQAKAREAIGNGLTMLAPSFSKSKYILGEDFSMIDVALAPLLWRLDHYDVKLGKSAAPLLKYAERIFQREAFIEALTPAEKAMRK

SEQ ID NO: 8170 - protein, 553 aa, Neisseria meningitidis; identical to SEQ ID NO: 596

SEQ ID NO: 8171 - protein, 208 aa, Neisseria meningitidis
MRCFMIQNVVTSIILYSGTAVDLLIILMLFFAKRKSRKDIINIYLGQFLGSVSLILLSLLFAFVLDYIPSKEILGLLGLIPILLGIKVLLLGDSDGEAIAKEGLRKDNKNLIFLVAMITFASCGADNIGVFVPYFTTLNLANLIVALLTFLVMIYLLVFSAQKLAQVPSVGETLEKYSRWFVAVVYLGLGIYILVENNSFDMLWTVLG

SEQ ID NO: 8172 - protein, 71 aa, Neisseria meningitidis
MKQGIHPNYHEVNVTCSCGNKFATKSAMEKENFNIEVCSLCHPFYTGTQKIVDTTGRVDKFNNKFGNLFKR

SEQ ID NO: 8173 - protein, 127 aa, Neisseria meningitidis
MMGSKFFFLLLRFAGSGLPPSHMRGIGIVGRRVRGFLARRVSPHIGRGVNIERGAYVFPDTVLGDGSGIGANCEICRGLVVGKNVMMEPECLFYSNNHKFDRSKNALRATRKSVRLRWRTMSGRGTG

SEQ ID NO: 8174 - protein, 166 aa, Neisseria meningitidis
MKKILTAAVVALIGILLAIVLIPDSKTAPAFSLPDLHGKTVSNADLQGKVTLINFWFPSCPGCVSEMPKIIKTANDYKNKNFQVLAVAQPIDPIESVRQYVKDYGLPFTVMYDADKAVGQAFGTQVYPTSVLIGKKGEILKTYVGEPDFGKLYQEIDTAWRNSDAV

SEQ ID NO: 8175 - protein, 127 aa, Neisseria meningitidis
MKLTVRNYHLDGYGHVNNARYLEFFEEARWAFFEERGLLHELAGLILIVARIDIRYSRPAVEGDVLQFSCRLKTPGTRRIVLTQTITLPNGKTAAEADITLMPVHAATQRTVSLPATLARALEALSE

SEQ ID NO: 8176 - protein, 160 aa, Neisseria meningitidis
MPSENPCSDGIPFCRNGQSETTDWAIISFLRIPRDSKGKTMYEVNRSVFVLIPLEPFWNWLQTLPGNHLDGLTLEDIQADANSYLVRPCETADEVWDEIEARFEDIFAAELADWCEDEREWPALDADIFNEWFDIQLSTVITDLEHEPLAREAFQPINLN

SEQ ID NO: 8177 - protein, 275 aa, Neisseria meningitidis; identical to SEQ ID NO: 3750

SEQ ID NO: 8178 - protein, 92 aa, Neisseria meningitidis
MHTELKNGILHIGGDITVKTLTAAAFTRFRQQCRLKDTCAVDLSGVGRADSACVSLLLEVLRGCKGSVRLTGIPESVRALSELYEIKDWLKS

SEQ ID NO: 8179 - protein, 196 aa, Neisseria meningitidis; identical to SEQ ID NO: 348

SEQ ID NO: 8180 - protein, 164 aa, Neisseria meningitidis; identical to SEQ ID NO: 3738

SEQ ID NO: 8181 - protein, 258 aa, Neisseria meningitidis; identical to SEQ ID NO: 3488

SEQ ID NO: 8182 - protein, 266 aa, Neisseria meningitidis
MSPSPFIEMKDVAFAYGDRPILKNINFSIPQGNFAAVMGGSGSGKTTLMRLITGQIRPQSGQVLIEGRDLAGFSADELYEHRRRMGVLFQHGALFTDLSVFDNIAFPMRELTRLPEAVIRDLVLLKLNAVGLRGVENLMPSELSGGMSRRVALARTIALDPEIMLYDEPFTGLDPISLGVIAHLISRVNKALRSTSIMVTHDIEKSLEIVDQVIFLAHGEIMFSGSPQEMRELDSPWVRQFVGGLADGPVAYRYPAQTSLQQDLLG

SEQ ID NO: 8183 - protein, 305 aa, Neisseria meningitidis
MEKAEHLNSSRFVNLVKSGGGSYVEGSYRFDTLSNGISIHGGTVTARCDFCSSRLAEPYVSFVLLLEGSLDFGINRCRFQIDADGGKIVLIAVGEEVLFSRYLYRGGKTVKMTIKGMEQWLLRPEYARFAPLLYREPVRIWDLPPNLRGLAASCLKAVPKGHLGETLRREADVLRLLSDLWDTVSDGIGPAAGQTAEADAMPSEDFSRTLNAAFADGAHQVNRLTDALNISERTLQRRMRDHFGITASEWLHHKQMQHALYLLQNGGKSIGETAYLCGYRHVSSFTQAFRQYFGSTPAETKKENR

SEQ ID NO: 8184 - protein, 480 aa, Neisseria meningitidis
MKQLAMYINGRFENDFNGEWRDVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 8185 - protein, 1082 aa, Neisseria meningitidis
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPPNLHTGDFPNPNDAYKNLINLKPAIEAGYTGRGVEVGIVDTGESVGSISFPELYGRKEHGYNENYKNYTAYMRKEAPEDGGGKDIEASFDDEAVIETEAKPTDIRHVKEIGHIDLVSHIIGGRSVDGRPAGGIAPDATLHIMNTNDETKNEMMVAAIRNAWVKLGERGVRIVNNSFGTTSRAGTADLFQIANSEEQYRQALLDYSGGDKTDEGIRLMQQSDYGNLSYHIRNKNMLFIFSTGNDAQAQPNTYALLPFYEKDAQKGIITVAGVDRSGEKFKREMYGEPGTEPLEYGSNHCGITAMWCLSAPYEASVRFTRTNPIQIAGTSFSAPIVTGTAALLLQKYPWMSNDNLRTTLLTTAQDIGAVGVDSKFGWGLLDAGKAMNGPASFPFGDFTADTKGTSDIAYSFRNDISGTGGLIKKGGSQLQLHGNNTYTGKTIIEGGSLVLYGNNKSDMRVETKGALIYNGAASGGSLNSDGIVYLADTDQSGANETVHIKGSLQLDGKGTLYTRLGKLLKVDGTAIIGGKLYMSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 8186 - protein, 593 aa, Neisseria meningitidis
MPYFALFDDAVSGRAKRYQNHVESRFFRPEELDALDGALQSGWQKGLHSVLFADYGFGLPLTGVESERGGNLALHWFANCADIDAESWLARHSDGLPAGISTPQPSVSETDYLDRIRQIHEAIRRGDTYQINYTTRLHLQAYGNPVSLYRRLRQPVPYAVLSHLPDAEGQSAWTLCFSPELFLKIGSDGTISTEPMKGTAPILGDGQDERRAAELQADPKNRAENVMIVDLLRNDLGKIAQTGTVCVPEPFKVSRFGSVWQMTSTIQAQALPHTSFADILRAAFPCGSITGAPKKMSMQIIESLEAEARGLYTGSIGYLNPCSGGLGFEGTFNVVIRTLSLTPLSDGIYQGVYGVGSGIVIDSDPAAEYRECGWKARFLNELRPDFGIFETLRAENGRCTLLDRHLCRLKTSAQALNLPLPDGCENQIKQYIADLPDGAFRVKALLASDGISLSRAVLNRLTDKQRVIISPAVLPAQNYLRRFKTTCRALFDQAWQTAETQGAFDSLFFNSDGILLEGGRSNVFIKHRGQWLTPSLDLDILNGIMRQAVLDEPQKYLQTNQVIETHITQKTLQEAEEIRLSNALRGVFAAALA

SEQ ID NO: 8187 - protein, 505 aa, Neisseria meningitidis; identical to SEQ ID NO: 3854

SEQ ID NO: 8188 - protein, 544 aa, Neisseria meningitidis
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVDELKNIAKPCDTSKEIAQVGSISANSDEQVGAIIAEAMEKVGKEGVITVEDGKSLENELDVVEGMQFDRGYLSPYFINDAEKQIAALDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQAKRIEIGKENTTIIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIEMGVLDPAKVTRSALQHAASIAGLMLTTDCMIAEIPEDKPAVPDMGGMGGMGGMM

SEQ ID NO: 8189 - protein, 96 aa, Neisseria meningitidis
MTIRPLHDRVVVKRLEAEEKTASGIVLPGAAAEKPDMGEVIAVGAGKIGKDGSRRPLDVKVGDKIIFGKYSGQTVKADGEELLVMREEDIFGIVEK

SEQ ID NO: 8190 - skipped

SEQ ID NO: 8191 - protein, 511 aa, Neisseria meningitidis
MSDSKTKERATFGTRRAFMIAAIGSAVGLGNIWRFPYIAFENGGGAFILPYLVALLTAGIPLLLLDYAIGHRYRGSAPLAFRRLGRWFEPVGWWNVMTNIVICIYYAVIIGWAASYTYYSVNAAWGADPQGFFFKDFLQMAGPEALGLDFVGKVAGPLAGVWVFTAAIMALGVQKGVARASSFFMPLLLVMFLIMVGISLTLPGAAKGLDALFTPDWSKLADSKVWVAAYGQIFFSLSICFGIMVTYSSYLKKKTDLGGTGLVVGFANSSFELLAGIGVFAALGFMAQAGGKAVNEVASGGIGLAFIAFPTIINQAPMGWLIGILFFGSLVFAGVTSMISILEVIVAAIQDKLNIGRVNATLLVCIPMGIVSTLLFGTATGLPVLDVMDKFVNTYGIVAAGFVYVAAIIISGRLPELRKHLNALSSIRIGGLWTVCVVVTVVMLGYMLFKDTSGLMEKNYEGYPDGFLSIFGWGMSAALVVFGLLLSLLPWKHGQDFNVKDEHEHEQGEEK

SEQ ID NO: 8192 - protein, 414 aa, Neisseria meningitidis
MTLFCEQVPYPRLAEAFGTPLYVYSQSALTEAFEHYQTAFAALNPLVCYAVKANGNLSIIKHFASLGSGFDIVSGGELARVLAAGGDAAKTIFSGVGKSEAEIEFALNAGVKCFNMESIPEIDRIQKVAARLGKTAPVSLRINPDVDAKTHPYISTGLKANKFGIAYADALEAYHYAAQQPNLKIIGIDCHIGSQLTDLSPLVEACERILILVDALAAEGIVLEHLDLGGGVGIVYQDENVPDLGAYAQAVQKLIGTRRLKLILEPGRSLVGNAGSLLTRVEFVKYGEEKNFVMVDAAMNDLMRPALYDAYHHIEAVETKDIATLTANIVGPICETGDFLGKDRTIACEEGDLLLIRSAGAYGASMASNYNARNRAAEVLVDGNEYRLIRRRETLEQQMANELACLQAEHQNAV

SEQ ID NO: 8193 - protein, 56 aa, Neisseria meningitidis
MKYGVFFAAATALLLSACGYKGDLYLPKEGDKARFGVIQTGLQLQSKPQSAPQTQK

SEQ ID NO: 8194 - protein, 107 aa, Neisseria meningitidis
MMTESEFIRASEALFEHIEDQIDENGWDFDCRFAGNVLTIEAGDGAQIIVNRHTPNQELWIAAKSGGYHFAEQNGKWLATRDGRDFYDVLNEALSAASGEAVEIAEL

SEQ ID NO: 8195 - protein, 338 aa, Neisseria meningitidis
MNTRPFYFGLIFIAIIAILANYLGNTDFSHHYHISALIIAILLGMAIGNTIYPQFSTQVEKGVLFAKGALLRTGIVLYGFRLTFGDIADVGLNAVVTDAIMLISTFFFTALLGIRYLKMDKQLVYLTGAGCSICGAAAVMAAEPVTKAESHKVSVAIAVVVIFGTLAIFTYPLFYTWSQHLINAHQFGIYVGSSVHEVAQVYAIGENIDPIVANTAVISKMIRVMMLAPFLLMLSWLLTRSNGVSENTSHKITIPWFAVLFIGVAIFNSFDLLPKELVKLFVEIDSFLLISSMAALGLTTQASAIKKAGLKPFVLGILTYLWLVVGGFLVNYGISKLI

SEQ ID NO: 8196 - protein, 139 aa, Neisseria meningitidis
MAQLPLYLTSEIKDFTVGTPKVLESFSKHIPYGVVFEDDGDTGYFYAASQDGILDALHIYNVEDVSDKHIPNHVLILWDDACTIAALCINDYIHAVYDFVEQAGYCRNGFPEAGGEWVKVENRVLDDELLDKILSRKST

SEQ ID NO: 8197 - protein, 168 aa, Neisseria meningitidis
MPLLDSFKVDHTRMHAPAVRVAKTMTTPKGDTITVFDLRFCVPNKEILPGKGIHTLEHLFAGFMRDHLNGNGVEIIDISPMGCRTGFYMSLIGTPSEQQVADAWLASMQDVLNVKDQSKIPELNEYQCGTYQMHSLAEAQQIAQNVLARKVAVNKNEELTLDEGLLNA

SEQ ID NO: 8198 - protein, 938 aa, Neisseria meningitidis
MSNRPTLLLVDGSSYLYRAYHAMGQNLTAPDGAPTGALYGVLNMLRRLRSEYPHDYCAVVFDAKGKNFRHQMFEEYKATRPPMPDDLRPQAEALPDLVRLTGWPVLVIGQVEADDVIGTLAKQGAEHGLRVIVSTGDKDMAQLVDERVTLVNTMSSETLDIEGVKAKFGVRPDQIRDYLALMGDKVDNVPGVEKCGPKTAVKWLEAYGSLAGVMEHASEIKGKVGENLQAALPQLPLSYDLVTIKTDVDLHAELSDGIESLRRTTPKWAQLVVDFKRWGFRTWLKEAESNMNTGSTDDLFGSDSIGEQAALNAEMPFEKQAEKATAPEKLDYQAVTTEAQFAALLDKLSRADTIGIDTETTSLDAMNASLVGISIAFQAGEAVYIPVGHSLTAAPEQLDLQDVLGRLKPHLGNPALKKIGQNLKYDQHVFANYGIALNGIAGDAMLASYIIESHLGHGLDELSERWLGLETITYESLCGKGAKQIGFADVAIGQATEYAAQDADFALRLEAHLRAQMDEKQLEMYEKMELPVAQVLFEMERNGVQIDRAELARQSAELGAELMKLEQEAYAAAGQPFNLNSPKQLQEILFDKMGIPTKGLKKTAKGGISTNEAVLEQLAPDYPLPKIILQNRSLAKLKSTYTDKLPEMISPKDGRVHTTYAQAVAITGRLASNNPNLQNIPIRTEEGRKVRRAFTAPQGSVIVSADYSQIELRIMAHLSGDKTLIAAFQNGEDVHRRTAAEVFGTAPENVSSEQRRYAKSINFGLIYGMGQYGLAKSLGIDNLSAKNFIDRYFARYPGVAEYMQRTKEQAAAQGYVETLFGRRLYLPDIRNKNANARAGAERAAINAPMQGTASDLIKRAMIDVSRWLSECEASPWDELLQSKLIMQVHDELVLEVVETELDFVKEKLPQIMAKVDGGLLDVPLVAEVGVGENWEEAH

SEQ ID NO: 8199 - protein, 223 aa, Neisseria meningitidis
MFPDKYKLSLKENIFLAKKVLVAQIHNLSRFENCQTTLLQTEQIIHGKNVASASLEDIQTILNLKRAYQYVISHISNGEPVDISLLKKINNIVAKDDSLAPGDFRTGSVGVTLLDGSRHAPNPVKEIEVARVLQNIGLQSGSTTEAAVRFMLYCMRQQVFWDGNKRTATLFANGLMMAGGCGILEISEMQMPQFNEKLSAFYRSGDDTDISKFVYQNCISGID

SEQ ID NO: 8200 - skipped

SEQ ID NO: 8201 - protein, 1457 aa, Neisseria meningitidis; identical to SEQ ID NO: 650

SEQ ID NO: 8202 - protein, 143 aa, Neisseria meningitidis
MTENAQDKARQAVETVVKSPELVEQILSDEYVQIMIARCFHSGPLPPPSDLAQYNDIISNGADRIMAMAEKEQAVRHETIRQDQTFNRRGQLYGFISAILILLFAVFLVWSGYPATAASLAGGTVFALAGAFVIGRSRDQGKN

SEQ ID NO: 8203 - protein, 448 aa, Neisseria meningitidis
MSDNVPTIAAVATAPGRGGVGVIRISGKNLLPMAQALCGKTPKPRTATYADFTDTDGQAIDSGLLLFFAAPASFTGEDVIELQGHGGPVVMDMLLNRCLELGARLAEPGEFTKRAFLNDKLDLAQAEGVADLIDASSRSAARLALRSLKGDFSRRIHGLVEDLITLRMLVEATLDFPEEDIDFLEAADARGKLDGLRRAVDDVLANAQQGAILREGLNVVLVGAPNVGKSSLLNALAGDEVAIVTDIAGTTRDAVRERILIDGVPVHIVDTAGLRETDDVVERIGIERSRKAVSEADVALVLVDPREGLNEKTRAILDALPPELKRIEIHSKSDLHAHAAGGFGTGAETVIALSAKTGDGLDALKRTLLREAGWQGESEGLFLARTRHVNALKAAQEELSLAALCGNHQIELFAEHLRLAQVACGEITGEFTADDLLGVIFSRFCIGK

SEQ ID NO: 8204 - protein, 714 aa, Neisseria meningitidis
MNTPLFRLSLLSLTLAAGFAHAAENNAKVVLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIITKTVDAQDLLKGLDKNWGVRLNSGFASNEGVSYGASVFGKEGNFDGLFSYNRNNEKDYEAGKGFRNNFNGGKTVPYSALDKRSYLAKIGTSFGDGDHRIVLSHMKDQHRGIRTVREEFTVGGDKERISMERQAPAYRETTQSNTNLAYTGKNLGFVEKLDANAYVLEKERYSADDSGTGYAGNVKGPNHTQITTRGMNFNFDSRLAEQTLLKYGINYRHQEIKPQAFLNSQFKIEDKEKATDEEKNKNRENEKIAKAYRLTNPTKTDTGAYIEAIHEIDGFTLTGGLRYDRFKVKTHDGKTVSSNNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHSQRWTNTLPGVGRDVRLGVNYKF

SEQ ID NO: 8205 - protein, 321 aa, Neisseria meningitidis; identical to SEQ ID NO: 902

SEQ ID NO: 8206 - protein, 322 aa, Neisseria meningitidis; identical to SEQ ID NO: 3006

SEQ ID NO: 8207 - protein, 324 aa, Neisseria meningitidis; identical to SEQ ID NO: 2964

SEQ ID NO: 8208 - protein, 208 aa, Neisseria meningitidis
MTQEHFPSFFNQAPTITVQDALAEFLGAAENGILTYRYADAVRLCGHSCPTVAGAYLMVIKGLKALYGEELPERGGIEAFMQGARDEGTVGVTASVVQLLTGAAPETGFGGIGMQGRFARRHLLSFGVGEINGTLTLRRKDNGKTVAVGLNAALQPFAPEMRDIMPKAVSGSASAEELERFGQLWQARVKAFLTESADDPQFVIVREV

SEQ ID NO: 8209 - protein, 252 aa, Neisseria meningitidis
MITIRNVSYRIGTRPILDNVSLDIPEGGITALVGPNGAGKSTLFSFMARLRPLESGSIAYRGKNLADTPTAELAKTLSILTQENSIMSRITVRDLLMFGRYPYHQGRPTAECRRIVNGAIEEFHLQDLSDRYLTELSGGQRQRAMIAMVFCQSTDYVLLDEPLNNLDMYHARSLMQILRRLTDEHKRTTVVVLHDINQAAAYADHVVAMKNGQVAMQGKPNDIFTAANIKTLFDMDVDVLDYEGKKLVIHHI

SEQ ID NO: 8210 - protein, 364 aa, Neisseria meningitidis
MSMKHFPSKVLTTAILATFCSGALAATSDDDVKKAATVAIVAAYNNGQEINGFKAGETIYDIGEDGTITQKDATAADVEADDFKGLGLKKVVTNLTKTVNENKQNVDAKVKAAESEIEKLTTKLADTDAALADTDAALDETTNALNKLGENITTFAEETKTNIVKIDEKLEAVADTVDKHAEAFNDIADSLDETNTKADEAVKTANEAKQTAEETKQNVDAKVKAAETAAGKAEAAAGTANTAADKAEAVAAKVTDIKADIATNKADIAKNSARIDSLDKNVANLRKETRQGLAEQAALSGLFQPYNVGRFNVTAAVGGYKSESAVAIGTGFRFTENFAAKAGVAVGTSSGSSAAYHVGVNYEW

SEQ ID NO: 8211 - protein, 112 aa, Neisseria meningitidis
MKKIEAIVKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 8212 - protein, 1320 aa, Neisseria meningitidis
MSVVLPLRGVTALSDFRVEKLLQKAAALGLPEVKLSSEFWYFVGSEKALDAATVEKLQALLAAQSVEQTPKAREGLHLFLVTPRLGTISPWASKATNIAENCGLAGIERIERGMAVWLEGRLNDEQKQQWAALLHDRMTESVLPDFQTASKLFHHLESETFSGVDVLGGGKEALVKANTEMGLALSADEIDYLVENYQALQRNPSDVELMMFAQANSEHCRHKIFNADFILNGEKQPKSLFGMIRDTHNAHPEGTVVAYKDNSSVIEGAKIERFYPNAAENQGYRFHEEDTHIIMKVETHNHPTAIAPFAGAATGAGGEIRDEGATGKGSRPKAGLTGFTVSNLNIPDLKQPWEQDYGKPEHISSPLDIMIEGPIGGAAFNNEFGRPNLLGYFRTFEEKFDGQVRGYHKPIMIAGGLGSIQAQQTHKDEIPEGALLIQLGGPGMLIGLGGGAASSMDTGTNDASLDFNSVQRGNPEIERRAQEVIDRCWQLGGKNPIISIHDVGAGGLSNAFPELVNDARRGAVFKLREVPLEEHGLNPLQIWCNESQERYVLSILEKDLDAFRAICERERCPFAVVGTATDDGHLKVRDDLFANNPVDLPLNVLLGKLPKTTRTDKTVAPSKKPFHAGDIDITEAAYRVLRLPAVAAKNFLITIGDRSVGGLTHRDQMVGKYQTPVADCAVTMMGFNTYRGEAMSMGEKPTVALFDAPASGRMCVGEAITNIAAVNIGDIGNIKLSANWMAACGNEGEDEKLYRTVEAVSKACQALDLSIPVGKDSLSMKTVWQDGEEKKSVVSPLSLIISAFAPVKDVRKTVTPELKNVEDSVLLFVDLGFGKARMGGSAFGQVYNNMSGDAPDLDDTGRLKAFYSVIQQLVAENKLLAYHDRSDGGLFAVLVEMAFAGRCGLDIDLNLLLAQTFITNHTALSQSLRTEEVKALAEWQETIARTLFNEELGAVIQVRKQDVADIINLFYQQQLHHNVFEIGTLTDENTLIIRDGQTHLISDNLIKLQQTWQETSHQIQRLRDNPACADSEFALIGDNERSALFADVKFDVNEDIAAPFINSGAKPKIAILREQGVNGQIEMAAAFTRAGFDAYDVHMSDLMAGRIHLADFKMLAACGGFSYGDVLGAGEGWAKSILFHPALRDQFAAFFADPDTLTLGVCNGCQMVSNLAEIIPGTAGWPKFKRNLSEQFEARLSMVHVPKSASLILNEMQGSSLPVVVSHGEGRADFALHGGNISADLGIALQYIDGQNQVTQTYPLNPNGSPQGIAGVTNADGRITIMMPHPERVYRAAQMSWKPEGWTELSGWYRLFAGARKALG

SEQ ID NO: 8213 - protein, 252 aa, Neisseria meningitidis
MKITPVKALTDNYIWMIQHGNHAVCVDPSEPSPVLEFLVRNRLMLAQTWVTHPHPDHEGGAAALWRGYMESPVYGESDIEAATHTVTAGTQFTFGDGQVTVWATPGHTDRHTSYLLETSDGIHVFCGDTLFSAGCGRVFTGTIEQLYDSFQRFNRLPENTLFYPAHEYTAANLRFAAHIEPDNADIQTALKAAAHTPTLPVTLAHERRVNPFLRVDLPHVRDRAEALSGKTLNSSLDTFVALRELKNQYRTK

SEQ ID NO: 8214 - protein, 1431 aa, Neisseria meningitidis; identical to SEQ ID NO: 3584

SEQ ID NO: 8215 - protein, 484 aa, Neisseria meningitidis
MSIEPTPPNLENDGIENDVERVSADFDRVHSLCEILEPAFEQIENGTPLEDAPLRDKLTELTVLLSELHPADVAAVLESLPPRERNIVWILVKPEDDGEVLLEVSDAVRETLIESMDKDELLAAVDDLDADELAELADDLPHQVVYEALQTRDEEERAQVKAAMSYEDNQVGAIMDFELVSIRADVACEVVLRYLRRFDSLPDHTDKIFVVDENDVLQGVLPIRKLLVADPEDLVENVMAKDVVRFRAEDDVEEAAQAFERYDLVTAPVVDENKKLIGRITIDEMVDVIREESEADMLNMAGLQEEEDLFAPVWDSVKNRWMWLAVNLCTAFLASRVIGAFEGSIEKIVALAALMPIVAGIGGNSGNQTITMIVRAMAMGQLTDMQAGRLLKKEVGVALVNGIIWGTVMGAVSWLLYGSLGIGLVMIAAMTLNLLLAATVGVLIPVVMEKFGRDPALGSSVLITAVTDSGGFLIFLGLATLFLL

SEQ ID NO: 8216 - protein, 302 aa, Neisseria meningitidis
MNQTAINRADVRTRFIFDDMPVRGLHVRLENVWQHIVKQKNYPAAIRRALGELLAAGVLLSGNLKNEGTLIVQVQGRGRLKMLVAEAASDRTVRATARWDETAEIADDESLGDLLGEGGVFVLTLQPKDGEPWQGVVPLEGGGIAQMLVNYMKRSEQLDTHIVLSASDEAAGGLLVQRLPEEVLDEEAWEHVSTLARTLTAEELAGLDAQHVLYRLFHETPPRVFEPETFEFSCTCSRGKVSDMLLMLGGEEVGGVVVEQGSIEVDCDFCHSKYVFDETDVNALFGEDVVGVAKGLPRHTVQ

SEQ ID NO: 8217 - protein, 251 aa, Neisseria meningitidis; identical to SEQ ID NO: 1784

SEQ ID NO: 8218 - protein, 72 aa, Neisseria meningitidis
MSMPEMPKWYDDDGQIVSCTEKVKVMSENMAELYQTAQDAFEDALLMGCGERQLRDYLLALIEGLENPYRKV

SEQ ID NO: 8219 - protein, 115 aa, Neisseria meningitidis
MNIIRALLIILGCLATGETAVFLAGIKLPGSIVGMGVLFALLQAGWVKTSWLQQLTDALMSNLTLFLVPPCVAVISYLDLIADDWFSILVSASASTLCVLLVTGKVHRWIRGIIR

SEQ ID NO: 8220 - protein, 230 aa, Neisseria meningitidis; identical to SEQ ID NO: 1790

SEQ ID NO: 8221 - protein, 406 aa, Neisseria meningitidis
MAVNLTEKTAEQLPDIDGIALYTAQAGVKKPGHTDLTLIAVAAGSTVGAVFTTNRFCAAPVHIAKSHLFDEDGVRALVINTGNANAGTGAQGRIDALAVCAAAARQIGCKPNQVLPFSTGVILEPLPADKIIAALPKMQPAFWNEAARAIMTTDTVPKAASREGKVGDKHTVRATGIAKGSGMIHPNMATMLGFIATDAKVSQPVLQLMTQEIADETFNTITVDGDTSTNDSFVIIATGKNSQSEIDNIADPRYAQLKELLCSLALELAQAIVRDGEGATKFITVRVENAKTRDEARQAAYAVARSPLVKTAFFASDPNLGRLLAAIGYAGVADLDTDLVEMYLDDILVAEHGGRAASYTEAQGQAVMSKAEITVRIKLHRGQAAATVYTCDLSHGYVSINADYRS

SEQ ID NO: 8222 - protein, 469 aa, Neisseria meningitidis
MTSTFPRRLARKIRQTRRLSRKSIAFLFLLAGSALVALTALFFAHLADFALELNAKLVQQYPWFAWVALPLGLPLIAWLTRKFAPFTAGSGIPQVIASLSLPYGAQKTRLIRLGQTLLKIPLTFLGMLFGASIGREGPSVQVGAAVMGAWGAWCKKHGLAFKGMQENDLMAAGAAGGLAAAFNAPLAGVIFAIEELGRGIMLRWERQILLGVLASGFIQVAIQGNNPYFSGFNGGVLEHIFLWVALSGLVCGAAGGLFGRLLYRGAAAFAPRKIRGFIRNRPLLLAALMGLLLALLGTFYQGKTYGTGYHEAAQALHGIYEAPFGLAAAKWLATVFSYWAGVPGGIFTPSLTIGAVLGEHIAAIADISQGANIIVLICMAAFLAGATQSPITSAVVVMEMTGGQSLLFWMLIACIFASQVSRQFSPRPFYHASGMRFRQRVLQETAAQTGNAPARPQTANSKTGMPSEN

SEQ ID NO: 8223 - protein, 463 aa, Neisseria meningitidis
MFPDFSQTLSKDRHFLRSAFKNPNKYGGLSKIEEKYRKSHEIFLKRLAALPKPEFDNTLPVHEKLEEIKKAIAKNQVTIICGETGSGKTTQLPKICLELGRGAAGLIGHTQPRRLAARSVAERIAEELKSEIGSAVGYKVRFTDHTSRDACVKLMTDGILLAETQTDRYLAAYDTIIIDEAHERSLNIDFLLGYLKQLLPRRPDLKVIITSATIDAERFSRHFNGAPVLEVSGRTYPVEILYRPLTGKDEDDAEVELTDAIVDAADELARHGEGDILVFLPGEREIRETAEALRKSTLRRNDEILPLFARLSHAEQHKIFHPSGAKRRIVLATNVAETSLTVPGIKYVIDTGLARVKRYSARAKVEQLHIEKISQAAARQRSGRCGRVSAGVCIRLFSEEDFNSRPEFTDPEIVRSNLAAVILRMAALKLGDVAAFPFLEMPDSRYINDGFQVLLELGAVEAV

SEQ ID NO: 8224 - protein, 547 aa, Neisseria meningitidis
MDEIQIPKKVELQTKLENEKIVLSKGSTTIIVGANGTGKTRLAVYIEEQLKEKAHRISAHRALKLNPNVNKIPEKSAKTYLSYGQNWDGIDVSNRKNYRWDNNSYTHLLNDFDWLLQYLFAQQNNIAVANNQKLNRNEKVTNSKTKLDILQEAWETLLPHRKLHITADDIQVSAVDNEELYSASNMSDGERALFYILGQVLSVDDGSVLIFDEPELHIHKSIISNLWDKIEELRPDCSFLIITHDIEFAATRVAKKYVIRNYYPTPAWDISEVPESNFDEETITMILGSRKPILFVEGNNNSLDIATYRYCYPDWTIIPKGACKDVIQSVSSLKKLSNEMPLLNLKCSGIVDLDSRDEREIEQLNNLGIYILPVSEIENLFSLTDVAKEILKLNQYSDEELLNKLNGFKSELIKYIDNELKDDKLDEFVVKQVRRKIDNYLKNIDLSSKITSTDMKKSLLNEISTLTEQKIETWISEIKNEIQRCIEQQDLDKLLTIYDNKGLLAKSACVLKGMRNKHEFESWIMRTLKGRNKDFIDAIRQKLPILD

SEQ ID NO: 8225 - protein, 60 aa, Neisseria meningitidis
MKNHQTTLSFPTSSSLKPCADKQGLSEDRSQYRLTKLGEQMAHLPIDPKIARILLVLFRF

SEQ ID NO: 8226 - protein, 525 aa, Neisseria meningitidis
MMKKSFLTLVLYSSLLTASEIAYRFVFGIETLPAAKIAETFALTFVIAALYLFARYKVTRLLIAVFFAFSIIANNVHYAVYQSWMTGINYWLMLKEVTEVGSAGASMLDKLWLPVLWGVLEVMLFCSLAKFRRKTHFSADILFAFLMLMIFVRSFDTKQEHGISPKPTYSRIKANYFSFGYFVGRVLPYQLFDLSRIPAFKQPAPSKIGQGSVQNIVLIMGESESAAHLKLFGYGRETSPFLTRLSQADFKPIVKQSYSAGFMTAVSLPSFFNAIPHANGLEQISGGDTNMFRLAKEQGYETYFYSAQAENEMAILNLIGKKWIDHLIQPTQLGYGNGDNMPDEKLLPLFDKINLQQGKHFIVLHQRGSHAPYGALLQPQDKVFGEADIVDKYDNTIHKTDQMIQTVFEQLQKQPDGNWLFAYTSDHGQYVRQDIYNQGTVQPDSYLVPLVLYSPDKAVQQAANQAFAPCEIAFHQQLSTFLIHTLGYDMPVSGCREGSVTGNLITGDAGSLNIRDGKAEYVYPQ

SEQ ID NO: 8227 - protein, 1139 aa, Neisseria meningitidis
MQNMKNQVRGSGMDARSNPANVSDGLQNSSGHIGTNTRYRLTKLGEQIARLPIDPKIARILLAAKKHDCMAEILVIASALSIQDPRERPLEARDASAKAHERFTDKQSDFLAYLNIWDSFQRERDKGLSNKQLVQWCRQYFLSHLRMREWRELHHQLAQTAIEMGLTTKEAAFRRPPEVRQLTSSENAGDQDLSAKLKQKQLDKKQHRAQIRAAKEAGYEQIHRALLTGLIANVGMKSPDGNDYTGARGSRFHLFPASALFKAKPKWVMAAELVETTRLYARDVAVIQPEWIEQEAPHLVRYHYFEPHWEQKRGEVVASERVTLYGLTVLPRRPVSYGKVAPEEAREIFIRSALVAQECDLKADFFVHNKKLIKEITELEHKSRKQDVLVDDEALFAFYNERLPEMAWKDAQGSVWGSEDSVRIIESDKAERSSENERNEFRKNKRNGSRQNENHGNTVGWVENPTSAATAKTVGFDNPTYAAQQTTPSPVGEGRGEGKTVAAQTNFSATAANPLPNPLPQEREQSAAASTISDDLRPANLQQTAPSPVGEGWGEGKTVATQTNFSATSTNPLPQEREQSASASTFSDDLRPANLQQPSPSPVGEGWGEGKTVATQTNFSATSTLSDDSKPKKQPAPQKNRLKPLPLADIRTFQAWLKTAERDNPRLLFLSRDDLMQHAAAHITEEQFPKFWQTADGKFKLSYRFEPHHPLDGVTMTVPLTVLNRLHAPSLEWLVPGMIREKIQLQIKALPKQIRRICVPVPEFITQFLSQNPDRNAPILPQLAQAIAKTAGDIRIFEQINQDEWAAFRLPEHCYFNLRIIDDGGQELAGGRKLHELQQQLGQAAAVTFRDNTQEFERDNVTAWDIGTLPESIKFARGKQQLTGYLGLQKEKDGRIALRLFDTTEAAEQAHRQGVIELMKLQLKEQVKDLNKGIQGFTQAAMLLKHINADTLRDDLTQAVCDRAFIGEDELPRNEKAFKEQIKRARSRLPAVKEALSRYLQETAAVYAELNSKLGKHPLTHLLRLRLQTLLAAGFATRTPWAQWPRLPIYLKAMTLRLEKYSSNPARDAAREADIQELEQMWQEKTDSLIKQGLPISDGLAAFKWMIEELRVSLFAQELKTPYPVSVKRLLKEWEKIEK

SEQ ID NO: 8228 - protein, 363 aa, Neisseria meningitidis
MQTFNRERLEFALDKRGCTQTKLAELLGITARQVRNYVKDEQIPDLNELANLLEFPVHFFTNDERLPELKSQAVSFRARSRTSKRLEKQALNHSITAFLLNDWLETEFTLSQAVLPDFSDISPEEAAQELRLEWGLGNEPIPNMITLLEVKGVRVFSLSLDTKDIDAFCTWYENHPFVFLNTQKSAERSRFDAAHELGHLIRDKYSMEHSKNSEITEDEPRDIIEKEANAFASAFLMPEAALRLYRHVPITIENLLKIKRRFGVSLVALAYRMHKLGMITDRMYIHNLCPLFAKKKYRTIEPEPMEREISSALRKMLTILKNDGIGIEQIAENLNVSPKDVADLTFGLVERDLNRYRKLRLVK

SEQ ID NO: 8229 - protein, 214 aa, Neisseria meningitidis
MVEFALSEPFPFEVGEIVEQQNSDIALSEISKYLSQEMLKEIVLTAHNNIQDKAALSDRNTLGMYRQAEITFALRVYLSKDGWTLEPWSGGAFLCLSPCRTKSIIVATATSDVGRHHGMPMTTARKGKGFEEAIRNSKLDLPDTVQFWVLLFHWKYNKVQLELSLPSGFVSHQITGYKQRIILADVDLTKFDELERKQPVEEYEPLVERKQKAG

SEQ ID NO: 8230 - protein, 82 aa, Neisseria meningitidis
MRSLLVRAMFGERMVGRFVLQSGKRSSENRVQTTFWFSWEGLWFKKTACVCTAHTLHTDSKFCVICRSGVPKDKDTVGQATY

SEQ ID NO: 8231 - protein, 89 aa, Neisseria meningitidis
MSNVHPYTIFATMPHKSTAKDILIMSYDLSKRLVIGLASSALFDLSESDNIFRMEGAETYRQYQREKQNHPLKKALSFHLLKNFCQSMK

SEQ ID NO: 8232 - protein, 149 aa, Neisseria meningitidis; identical to SEQ ID NO: 822

SEQ ID NO: 8233 - protein, 148 aa, Neisseria meningitidis
MSVMAGRHPYGVRSGLRRNGLKLWDIHFRMTRFIVARCGLLFATLKGKTMKKMFVLFCMLFSCAFSLAAVNINAASQQELEALPGIGPAKAKAIAEYRAQNGAFKSVDDLTKVKGIGPAVLAKLKDQASVGAPAPKGPAKPAIPAAKK

SEQ ID NO: 8234 - protein, 220 aa, Neisseria meningitidis
MDMLEILFRHQDFVAINKPGGISVHQDSGETGLARTLAIQLGVERVWLLHRLDKQTSGILLFALNKESASALSGQFAGKSIKKTYLALSDRKPSKKQGWIKGGMEKSRCGMWKLTRNTENIAVTRFHSISIAEKLRLFILEPHTGKTHQLRVAMKSLGSPILGDSLYGGTESETMFLYAWKIQFDYQNRQIEIVAPLKNEWQTENIHRALEEFCMENKID

SEQ ID NO: 8235 - protein, 170 aa, Neisseria meningitidis
MLPNTPRRAVYAGSFDPPTLGHLWMIRQAQSMFDELIVAIGINPDKRSTYTVAERQDMLCDITKMFPNVRTDVFENRFLVHYAREVDAGFIVRGIRSASDYEYERSMRHINSDLAPEISTVFLMPPREIAEVSSTMVKGLVGPEGWTETIHRYVPQAVYEKILAEHQHEN

SEQ ID NO: 8236 - protein, 227 aa, Neisseria meningitidis
MQHDVYDYTAHTVSKNTVLQKTYRLLGFSFIPASAGAALAANAGFNFYAAFGSRWIGFAVVLAFFYGMIHFIEKNRYSNTGVTLLMVFTFGMGVLIGPVLQYALHIADGAKIVGIAAAMTAAVFLTMSALARRTRLDMNALGRFLTVGAVILMVAVVANLFLGIPALALTISAGFVLFSSLMIMWQVRTVIDGGEDSHISAALTLFISLYNIFSSLLNILLSLNGED

SEQ ID NO: 8237 - protein, 88 aa, Neisseria meningitidis
MARMVFCVKLNKEAEGMKFPPLPNELGKRIFENVSQEAWAAWTRHQTMLINENRLSLADPRAREYLAQQMEQYFFGDGADAVQGYVPQ

SEQ ID NO: 8238 - protein, 156 aa, Neisseria meningitidis
MNITVLAVGTKMPRWVDEAVAEYAKRFGRDVAYALKEIKPEKRGAGVNAAQGMAAEEKRILEAIPQGAFLVVLDERGKAPTSVELAEHLKSWRQNGEHVCFVIGGADGMTDRLKQQARMMMRLSSLTLPHGMVRVFLTEQLYRAVSILHNHPYHRE

SEQ ID NO: 8239 - protein, 128 aa, Neisseria meningitidis
MNEQELQDLQKMVGVAVNALGDIKAKDISVLETQDKTSLFARMIIASGDSTRQVKALANNVAVDLKEAGFEILSTEGDSGEWTLVDAGDLVVHVMLPAVRDFYDIDTLWGGEKPSFHAGMQKPWHAAD

SEQ ID NO: 8240 - protein, 201 aa, Neisseria meningitidis
MKKIGLFGGTFDPIHNGHLHIARAFADEIGLDAVVFLPTGGPYHKDAASASAADRLAMVELATAEDARFAVSDCDIVREGATYTFDTVQIFRQQFPSAQLWWLMGSDSLMKLHTWKKWQMLVRETNIAVAMRQGDSLHQTPRELHAWLGKSLQDGSVRILSAPMHNVSSTEIRRNLAGQGVSDGIPPAAARYIREHGLYEK

SEQ ID NO: 8241 - protein, 199 aa, Neisseria meningitidis
MSELDNILAHNRQFVESGEYEKYFTDKYPERGLAVLSCMDARIIGLLPDALGLKNGDAKLIKNAGALVTHPWGSVMRSLLVAVFELKVREIMVIAHHDCGMQGLNAEEFLGRVRESRIPEDRIETLRYAGIDLDGWLTGFDNVEDSVRHTVDLIRNHPLMPRHIAVHGLVIHPVTGKLTLVVDGSVSDGMDLSEGMETS

SEQ ID NO: 8242 - protein, 531 aa, Neisseria meningitidis
MWGLLGTIATSVFQVGKAMDGRRWVVWGAFALLPSAFLAVMVVAPLWAVAAYDGLAWRAVLSDAYMLKRLAWTVFQAAATCVLVLPLGVPVAWVLARLAFPGRALVLRLLMLPFVMPTLVAGVGVLALFGADGLLWRGRQDTPYLLLYGNVFFNLPVLVRAAYQGFVQVPAARLQTARTLGAGAWRRFWDIEMPVLRPWLAGGVCLVFLYCFSGFGLALLLGGSRYATVEVEIYQLVMFELDMAVASVLVWLVLGVTAAAGLLYAWFGRRAVSDKAVSPVMPSPPQSVGEYVLLAFAAAVLSVCCLFPLLAIVVKAWSAGESWRVLMESETWQAVWNTLRFSAAAVYAAAVLGVVYAAAARRSAWMRGLMFLPFMVSPVCVSAGVLLLYPQWTASLPLLLAMYALLAYPFVAKDVLSAWDALPPDYGRAAAGLGANGFQTACRITFPLLKPALRRGLTLAAATCVGEFAATLFLSRPEWQTLTTLIYAYLGRAGEDNYARAMVLTLLLAAFALGIFLLLDGGEGGKQTETL

SEQ ID NO: 8243 - protein, 461 aa, Neisseria meningitidis; identical to SEQ ID NO: 586

SEQ ID NO: 8244 - protein, 172 aa, Neisseria meningitidis
MTTHFVVMGVCGCGKTTAALSLQKHLGQCPYAEGDEFHTQANRDKMGAGIPLTDEDRYPWLGNLRDWMTQQAQNGANHTIVTCSALKRGYRDILRGAEGKAAFIHLSPPQDINLERMMSRKGHYMKAGMLDSQLEILEELGEGEYGVKIANPGTPEAVEADILNWVASENLL

SEQ ID NO: 8245 - protein, 305 aa, Neisseria meningitidis
MSVYTSVSDDEMRGFLSGYDLGEFVSLQGIAQGITNSNYFLTTTSGRYVLTVFEVLKQEELPFFLELNRHLSMKGVAVAAPVARKDGRLDSVLAGKPACLVACLKGSDTALPTAEQCFHTGAMLAKMHLAAADFPLEMENPRYNAWWTEACARLLPVLSQDDAALLCSEIDALKDNLGNHLPSGIIHADLFKDNVLLDGGQVSGFIDFYYACRGNFMYDLAIAVNDWARTADNKLDEALKKAFIGGYEGVRPLSAEEKAYFPTAQRAGCIRFWVSRLLDFHFPQAGEMTFIKDPNAFRNLLLSLG

SEQ ID NO: 8246 - protein, 242 aa, Neisseria meningitidis
MGGKMSDKKYNVDEGEIAKFSRIADKWWDKSGEFKTLHDINPLRLDYIDGHADLCGKRVLDVGCGGGILAESMARRGAAFVKGIDMAEQSLETARLHAALNNVADIEYECIRVEDLAEAEPHSFDVVTCMEMMEHVPDPAAIVRACANLVKPDGMVFFSTINKNPKSYLHLIVAAEYLLKFVPKGTHDWKKFIAPAELARMCRQAGLDVADTKGMTYHVLSQTYALCDSTDVNYMFACRPAF

SEQ ID NO: 8247 - protein, 413 aa, Neisseria meningitidis; identical to SEQ ID NO: 1342

SEQ ID NO: 8248 - skipped

SEQ ID NO: 8249 - protein, 187 aa, Neisseria meningitidis
MKLIILDRDGVINQDRDDFVKSVDEWIPVEGSMDAVAFLTQAGYTVAVATNQSGIGRKYFTVQNLTEMHAKMHRLVRQAGGEINGIWFCPHTDADNCNCRKPKPGMIEDIIGRFNAQASETWLVGDSLRDLQAIDAVGGKPALVLTGKGKKTLSQHGHELPEHTQVFDTLLDFSQYIMQENTAPQAD

SEQ ID NO: 8250 - protein, 247 aa, Neisseria meningitidis; identical to SEQ ID NO: 2634

SEQ ID NO: 8251 - protein, 230 aa, Neisseria meningitidis
MTAFVHTLSDGMELTVEIKRRAKKNLIIRPAGTHTVRISVPPCFSVSALNRWLYENEAVLRQTLAKTPPPQTAENRLPESILFHGRQLALTAHQDTQILLMPSEIRVPEGAPEKQLALLRDFLERQAHSYLIPRLERHARTTQLFPASSSLTSAKTFWGVCRKTTGIRFNWRLVGAPEYVADYVCIHELCHLAHPDHSPAFWELTRRFAPYTPKAKQWLKIHGRELFALG

SEQ ID NO: 8252 - protein, 265 aa, Neisseria meningitidis
MDTAQKQRWAITLSYDGSRFYGWQKQADGVPTVQAALETALAQIAGEAVSTTVAGRTDTGVHATAQVVHFDTTAARPQQAWVRGVNAHLPEGIAVLHARQVAPEFHARFDAYGRHYRYLLESAPVRSPLLKNRAGWTHLKLDIGQMRQAAALLVGEQDFSSFRAAECQAKSPVKTIYRADLTQSSGLVRLDLHGNAFLHHMVRNIMGALVYVGSGRLSVEGFAALIQERSRLKAPPTFMPDGLYLTGVDYPEAYGIIRPQIPEWL

SEQ ID NO: 8253 - protein, 79 aa, Neisseria meningitidis
MILNIRKMGNSQGVILPKSLLGQIGAVDSLAVTVEKGNIILSCPTVRRGWAEAAAMLVETEQEHFFSEIENEADKEWIW

SEQ ID NO: 8254 - protein, 107 aa, Neisseria meningitidis
MDMVVRGGIYLVSLDPTVGSEIKKTRPCVVVSPPEIHNYLKTVLIVPMTSGSRPAPFRVNVRFQDKDGLLLPEQIRAVDKAGLVKHLGNLDNSTAEKLFAVLQEMFA

SEQ ID NO: 8255 - protein, 331 aa, Neisseria meningitidis
MKKSLIALTLAALPVAAMADVTLYGTIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLRHKF

SEQ ID NO: 8256 - protein, 633 aa, Neisseria meningitidis
MTTPKKTAKTSGNEARELADLSEDIGICFKYPNSERVYLQGSRDDIRVPLREIRQDDTYTAQGTEANPPIPVYDTSGVYGDPAAHIDLKQGLPHIRTAWLDERGDTEILPKLSSEYGIERAHDPKTAHLRFNQITRPRRAKSGSNVTQLHYARQGIITPEMEFVAIRERLKLDELSQKPEYAKLLEQHAGQSFGANIPTHPDQITPEFVRQEIAAGRAIIPANINHPELEPMIIGRNFRVKINGNLGNSAVTSSLTEEVEKMVWSLRWGADTIMDLSTGAHIHETREWIIRNAPVPIGTVPIYQALEKTGGIAEDLTWDLFRDTLIEQAEQGVDYFTIHAGVLLRYVPMTANRLTGIVSRGGSIMAKWCLAHHRENFLYTHFDEICEIMKAYDVSFSLGDGLRPGCIADANDESQFAELHTLGELTDKAWKHDVQVMIEGPGHVPLQRVKENMTEELQHCFEAPFYTLGPLVTDIAPGYDHITSGIGAANIGWYGTAMLCYVTPKEHLGLPDKEDVRTGIITYKLAAHAADLAKGWPGAQLRDNALSKARFEFRWRDQFRLSLDPERAESFHDETLPAEGAKIAHFCSMCGPKFCSMKITQEVRDYADKQKAQRQGMEEKAVEFVKKGAKIYS

SEQ ID NO: 8257 - protein, 291 aa, Neisseria meningitidis; identical to SEQ ID NO: 412

SEQ ID NO: 8258 - protein, 312 aa, Neisseria meningitidis; identical to SEQ ID NO: 2838

SEQ ID NO: 8259 - skipped

SEQ ID NO: 8260 - protein, 591 aa, Neisseria meningitidis
MSIVLHGVAAGKGIAVGCAHLIARGTEEVPQYDVAEADTDAEAERFDAAVKATRKELEQLRSAIPENAPTELGAFISLHLMLLTDVTLSREPVDILREQKINAEWALKQQSDKLAAQFDNMDDAYLRERKQDMLQVVRRIHNNLIGQGNELEVADNLFDETVLIANDLSPADTVLFKEQRIAAFVTDAGGPTGHTAILGRSLDIPSVVGLHNARKLITEGETVIVDGINGVLIIAPDESVLNEYRRRAREYRSHKRDLNKLKKTAAATADGVCIELVGNIESAEDVKPLHNLGADGIGLFRSEFLYLNRDTMPSEDEQYEVYSAIVKKMKGKSVTIRTVDLGVDKNPRWFGKNSTPNGSLNPALGMTGIRLCLAEPVMFRTQMRAILRAAVHGPVRMMWPMITSVSEVRQCLIHLDTAQRQLAERGDAFGKVGIGCMIEIPSAALTVGSILKLVDFISVGTNDLIQYILSVDRGDDSVSHLYQPGHPAVLKMLQHVIRTANRMDKDVSVCGEMAGDTAFTRVLLGMGLRRFSMNPNNILPVKNIILHSNVGQLESDIVKVIRCEDEEKSEKLIKQMNSVSVEEEADFKGRK

SEQ ID NO: 8261 - protein, 89 aa, Neisseria meningitidis
MLKQSIEIINKLGLHARASNKFTQTASQFKSEVWVTKNDSRVNGKSIMGLMMLAAAKGTVIELETDGADEAEAMRALTDLINGYFGEGE

SEQ ID NO: 8262 - protein, 152 aa, Neisseria meningitidis
MRNRTHNMIGLLIITHETIGEAYRKLAHHFFPGGLPENVRILGVQPTEDQDDINNNAIAALQEFPDNDGVLIMTDIFGATPCNAARRLVRENKSAILTGLNAPMMVKAVQYSPAAEDLAAFTECVREAAVKGIFAITSAPEDLVCRRSGDAV

SEQ ID NO: 8263 - protein, 187 aa, Neisseria meningitidis
MTDLETKRLETQAMLENADLLFDQGQCRAALQKVADEITRDLGGKYPLLLPVMGGAVVFTGQLLPLLRFPLDFDYVHVSRYGDKLEGGAFNWKRMPDAEQIRGRHVVVLDDILDEGHTMSAIQAKLLEMGAASCRAAVFANKLIDKPKPIRADYVGLDVPNRYVFGYGMDAAGCWRNLGEIYALGGK

SEQ ID NO: 8264 - protein, 274 aa, Neisseria meningitidis
MIKKTIGGIIPIFTAVFIPASAGAADLMLAQEYKGQDIAGWAMSEKLDGVRAYWDGKHLMSRQGYAFAPPKGFTAQFPPYPLDGELYSGRGQFEQISATVRSVSSDWRGIRLHVFDVPKAQGNLYQRLAVATQWLKTHPNAPITIIPQIKVRDRQHAMDFLKQIEAQGGEGVMLRQPESRYSGGRSSQLLKLKSQYDDECTVTRHYEGKGRNAGRLGAVGCKNRHGEFRIGSGFKDKDRDNPPKIGTLITYRYRGFTRKGTPKFATFVRVRTDR

SEQ ID NO: 8265 - protein, 210 aa, Neisseria meningitidis
MTLRYEIFPVTPFRQNCTLIWDDESGEAVLTDVGGDVPFLLQALANRKLTLTAIWLTHGHLDHAGGVVEMLKTHKVPVLGPHPDDEFLLQSLPQTTAQYGFPVSPAFAPNRWLEEGETLTVGRYAFQVLHIPGHTPGHIVFYCAEAELLIAGDVLFYETIGRTDFPRGNHADLINNIRNKLFTLPETVQVVAGHGRMTSIGHEKRHNPFF

SEQ ID NO: 8266 - protein, 594 aa, Neisseria meningitidis
MELMTVLLPLAALVSGVLFTWLLMKGRFQGEFAGLNAHLAEKAARCDFVEQAHGKTVSELAVLDGKYRHLQDENYALGNRFSAAEKQIAHLQEKEAESARLKQSYIELQEKAQGLAVENERLATQLGQERKAFADQYALERQIRQRIETDLEESRQTVRDVQNDLSDVGNRFAAAEKQIAHLQEKEAEAERLRQSHTELQEKAQGLAVENERLATQIEQERLASEEKLSLLGEARKSLSDQFQNLANTILEEKSRRFTEQNREQLHQVLNPLNERIHGFGELVKQTYDKESRERLTLENELKRLQGLNAQLHSEAKALTNALTGTQNKVQGNWGEMILETVLENSGLQKGREYVVQAASVRKEEDGGTRRLQPDVLVNLPDNKQIVIDSKVSLTAYVRYTQAADADTAARELAAHVASIRAHMKGLSLKDYTDLEGVNTLDFVFMFIPVEPAYLLALQNDAGLFQECFDKRIMLVGPSTLLATLRTVANIWRNEQQNQNALAIADEGGKLYDKFVGFVQTLESVGKGIDQAQSSFQTAFKQLAEGRGNLVGRAEKLRLLGVKAGKQLQRDLVERSNETTALSESLEYAAEDEAV

SEQ ID NO: 8267 - protein, 266 aa, Neisseria meningitidis
MRAAKMKQTLKNWFAALLLAVPMSAAVASGGGHYEKVDIDLRDQVSLQHGAQIFTNYCLSCHSASGMRFNRLKDIGLTDEEIKKNLMFTTDNVGDVMHSAMNPKDAAKWFGAAPPDLTLIARSKGADYLYAYMRGFYKDPTRPSGWNNTVFDKVGMPHPLWEQQGVQAVELDAKGQPVMVKDEHGEMKPKLYWESTGLHSRRLPNGKVIQKEYDAYVRDLVNYLVYMGEPAQLQRKRIGYVVMIFLFAVMLPLAYFLNKEYWKDVH

SEQ ID NO: 8268 - protein, 449 aa, Neisseria meningitidis
MANQTNSKAKALLGWVDARFPLSKMWKEHLSEYYAPKNFNFWYFFGSLSMLVLVIQIVSGIFLTMNYKPDGNLNAYHLPAAFTAVEYIMRDVSGGWIIRYMHSTGASFFFIVVYLHMFRGLIYGSYKKPRELVWIFGSLIFLALMAEAFMGYLLPWGQMSFWGAQVIINLFSAIPVIGPDLSTWIRGDFNVSDVTLNRFFALHVIAVPLVLLGLVVAHIIALHEVGSNNPDGVEIKKLKDENGVPLDGIPFFPYYVVHDILAVTIFLIVFCAVMFFAPEGGGYFLEAPNFDAANALKTPPHIAPVWYFTPFYAILRAIPSFAGTQVWGVIGMGAAVVLIALLPWLDKGEVKSVRYRGPIFKTALVLFIIAFIGLGILGAMVATDTRTLVARILSFVYFAFFLGMPFYTKLDTNKPVPERVTMSTTKQKIMFFVYVGITVVGAYLFATNI

SEQ ID NO: 8269 - protein, 193 aa, Neisseria meningitidis
MDNQEINNGRRRFLTLATCGAGGVAALGVATPFVASFFPSEKAKAAGAAVEVDVSKIEAGQLLTAEWQGKPIWVLNRTDQQLKDLKGLNGELTDPNSDAEQQPEYAKNETRSIKPNILVAIGICTHLGCSPTFRPDIAPADLGADWKGGFFCPCHGSKFDLAGRVYKGVPAPTNLVVPPYKYLSDTTILVGED

SEQ ID NO: 8270 - protein, 249 aa, Neisseria meningitidis
MVLCRDFLTWCNETLQTALFKDYAPNGLQVEGREYIGKIVTSVTASRAAIDFAVEQKADLLLVHHGMFWKNELPTVTGWKKERIAALLRHDINMAGYHLPLDAHPTLGNNAQLADRLGFATEKRFGEQNLLNSGSLKQAKTLGALAAHIETVLQRKPVVIGNPEREIRRVAWCSGGAQGFFQTAIDEGVDLYLTGEISEAQYHLANETGTAFISAGHHATERYGVRALAESAAEVFGLEVCHFDENNPA

SEQ ID NO: 8271 - protein, 309 aa, Neisseria meningitidis
MDSIIELRHLKTLLALEETGSVSLAAKRVFLTQSALSHQIRMLENHYGTPLFERKSTPLRFTPVGERLLRLAHELIPQVAVAEWDLARITEGEAGELRIAVECHTCFDWLMPAMGEFRPMWPQVELDIVSGFQADPVGLLLQHRADLAIVSEAEKQNGISFQPLFAYEMVGICAPDHPLAAKNVWTAEDFIGETLITYPVPDEMLDLPKKILIPKNINPPRRHSELTIAIIQLVASRRGIAALPYWTVMPYLEKGYVVHRQITADGLQSKLYAAIRTEDTDKSYLNNFCQIIRERGFADLPGLSELEPV

SEQ ID NO: 8272 - protein, 130 aa, Neisseria meningitidis
MNGKYYYGTGRRKSSVARVFLIKGTGQIIVNGRPVDEFFARETSRMVVRQPLVLTENAESFDIKVNVVGGGETGQSGAIRHGITRALIDFDAALKPALSQAGFVTRDAREVERKKPGLRKARRAKQFSKR

SEQ ID NO: 8273 - protein, 143 aa, Neisseria meningitidis
MKTFSAKPHEVKREWFVIDAQDKVLGRVAAEVASRLRGKHKPEYTPHVDTGDYIIVINADKLRVTGAKFEDKKYFRHSGFPGGIYERTFREMQEQFPGRALEQAVKGMLPKGPLGYAMIKKLKVYAGAEHAHAAQQPKVLELK

SEQ ID NO: 8274 - protein, 101 aa, Neisseria meningitidis
MNIEQVHIEVMHARLTVNTPAEEKDTLLQAVGMLNGKAEAIREGGRVADSEKIVIMAALNVVHDLLKTSLNGGDLAIGDFARKIADMDNACQKALSRLAQE

SEQ ID NO: 8275 - protein, 109 aa, Neisseria meningitidis
MKQNIEKLESSVYTLVQKFETLVSENRRLKETVAELKRAHERQKLEHETAVDELSEALLVQVGKLKEDLQNKIDSLTEENTRYRSLLEQSREKISALAARLPQWQETQQ

SEQ ID NO: 8276 - protein, 329 aa, Neisseria meningitidis
MKITVIGAGSWGTALALHFSQHGNRVSLWTRNADQVRQMQEARENKRGLPGFSFPETLEVCADLADALKDSGLVLIVTSVAGLRSSAELLKQYGAGHLPVLAACKGFEQDTGLLTFQVLKEVLPDNKKIGVLSGPSFAQELAKQLPCAVVLASENQEWIEELVPQLNTTVMRLYGSTDVIGVAVGGAVKNVMAIATGLSDGLEYGLNARAALVTRGLAEITRLASAMGAQPKTMMGLAGIGDLILTCTGALSRNRRVGLGLAEGKELHQVLVEIGHVSEGVSTIEEVFNTACKYQIDMPITQTLLQLIRKEMTPQQVVERLMERSARFE

SEQ ID NO: 8277 - protein, 900 aa, Neisseria meningitidis
MQLHILNNPKDAALAADAEFLKQSLFNLLHEEASPLVVETVKLLSTSDDSAALIEKVLPQLDEQQTHDLTLACGLFAQILNIAEDVHHERRRQIHEEAGRGGAEGSLTETVRRLKAGKADGKSVQRQLDNTSVTAVLTAHPTEVQRQTVLSFNRRIRALLPQRERCTNADALARLRREIDTILLGLWQTSETRRHKLSVNDEINNGVSIFPMSFFEALPKLYRKMEHDFQTAYPGVRVPDILKIGGWIGGDRDGNPFVSAETLRFAFRRHADAVFRFYRGELDKLYRELPLSIRRVKVNGDVTALSDKSPDEEIARAEEPYRRAIAYIMARAMGKARALGLGMGCKFGFLEPYASAQEFLDDLKKLQRSLIDNGSRLLAEGRLADLIRSVSVFGFHMMPLDLRQHAGKHADVVAELFQHAGLEDYNRLNEEQKQTALLRELSHQRPLYSPFITYSDHTRHELAIFNEARKIKDEFGEDAVTQSIISNCEQPSDLLALALLLKETGLLAVENGKPHSRINIVPLFETIEALENACPVMETMFRLDWYDALLESRGNIQEIMLGYSDSNKDGGYVTSSWCLYQAELGLVELFKKYDVRMRLFHGRGGSVGRGGGPSYQAILAQPAGSVAGQIRITEQGEVITAKYADPGNAQRNLETLVAATLEASILPDKKDPDAKLMQALSDVSFKYYRELITHPDFIDYFLQTSPIQEIATLNLGSRPASRKTLARIQDLRAIPWVFSWMQNRLMLPAWYGFGSAVETLCEDKPETLAALREHAQSNPFFQAMLSNMEQVMAKTDITLAENYAGLSESPDKAKIIFGMIKEEYRRSRKALLDLLQTEELLRDNRSLARSLALRIPYLNALNGLQVAMLKRLRKEPDNPHALLMVHLTINGVAQGLRNTG

SEQ ID NO: 8278 - protein, 256 aa, Neisseria meningitidis
MTTTEHDNDDAFLLRYSRHILLDEIGIEGQQKLSAAHILVVGCGGLGAAALPYLAASGVGTLTIADSDTVELHNLQRQVAFDEGDVGKLKTEALAGRLKRINHTVNVRAVNEKLDGCRLTGLVQAADIVLDCCDNYATRQAVNRACVQTKTPLVSGAAVRFEGQLAVYRPDLPDSPCYACLFDGGSASDGICSLFGVFSPLVGIIGSTQAAEALKILLDAGEPSHGRLAVYRALEGGWQYFDLPRNPECPVCGTAR

SEQ ID NO: 8279 - protein, 74 aa, Neisseria meningitidis
MDAVQELERRIVELEIQSALQEDVIAGLNAMVAELRQTLDLQQAQLRLLYQKMQDRNPDAQEPYSLRDEIPPHY

SEQ ID NO: 8280 - protein, 462 aa, Neisseria meningitidis
MNAVVVAVIVMLVLSLSRVHVVLSLTVGAFVGGAVAGMPLQNIADAAGQVSQAGIIPVFNKGLEGGAKIALSYAMLGAFAMAITHSGLPQQLAGAVVRKLNRGGMPDSVRSGEGAVKWLLLSIILVMGMMSQNIIPIHIAFIPMIVPPLLLVFNRLKIDRRLIACVITFGLVTTYMFLPYGFGAIFLNEILLGNIHSAAPQLDVKNINVMAAMAIPALGMLAGLLLAFVHYRKPRLYQSNNADTAGNADAANRPQPSAYRSLAAAVAIAVCFAIQLMYEDSLVLGAMLGFAVFMMLGVINRDKANDVFGEGIKMMAMVGFIMIAAQGFAAVMNATGHIQPLVESSMAIFGNSKGMAALAMLVVGLLVTMGIGSSFSTLPIIAAIYVPLCVGLGFSPLATVAIVGTAGALGDAGSPASDSTLGPTMGLNADGQHDHIRDSVIPTFIHYNIPLLIAGWIAAMVL

SEQ ID NO: 8281 - protein, 423 aa, Neisseria meningitidis
MQEQNRKPSFPIVMLLVSVALWIASLSNVAFYLGNHGSMEGLTVLILGSIFASLDIRYCAVYANYVWLAAIVLLALRKKVVPVHAALWGLALVAFSVKAVYVDEAGNTSDIVRYGAGFYLWYAAFAVATIGTFAGKNKERKAASAADGIKMTFDKWLGLSKLPKNEARMLLQYVSEYTRVQLLTRGGEEMPDEVRQRADRLAQRRLNGEPVAYILGVREFYGRRFTVNPSVLIPRPETEHLVEAVLARLPENGRVWDLGTGSGAVAVTVALERPDAFVRASDISPPALETARKNAADLGARVEFAHGSWFDTDMPSEGKWDIIVSNPPYIENGDKHLLQGDLRFEPQIALTDFSDGLSCIRTLAQGAPDRLAEGGFLLLEHGFDQGAAVRGVLAENGFSGVETLPDLAGLDRVTLGKYMKHLK

SEQ ID NO: 8282 - protein, 480 aa, Neisseria meningitidis
MHPTYSAVQARLLEANRLSPELLAKSLCIIGAHHVDYADIYCQRTAYESWHLEEGIVKSGSFQINQGVGVRAVSGDKTAFAYADSLCIDSINRSARAVRAIGAAGGKVSAKMPSETRGKPVCSASDPIAGLDSAAKVALLNKVEAIAKAADPRIVQVMAGLTCEYDMVYLARLDGKHAADIRPMVRLNVTVIAKQGERREQGSAGGGGRYDLAYFDENLVHRFVDAAVKQALTNLESRPAPAGEMTVVLGNGWPGVLLHEAVGHGLEGDFNRKGTSVFSGRIGERVAAKGVTVVDQGDIAGRRGSLNIDDEGNETRRTVLIEDGILVGYMQDETNARLTGTQSTGNGRRESYASAPMPRMTNTFMENGSYEPEEIIASIDKGIYAVNFGGGQVDITSGKFVFSASEAWWVEGGRLQYPVKGATIIGNGPEVLKHVSMIGNDTALDSGVGVCGKEGQSVPVGVGQPTLRIDAGLTVGGSAI

SEQ ID NO: 8283 - protein, 407 aa, Neisseria meningitidis; identical to SEQ ID NO: 802

SEQ ID NO: 8284 - protein, 366 aa, Neisseria meningitidis; identical to SEQ ID NO: 812

SEQ ID NO: 8285 - protein, 205 aa, Neisseria meningitidis
MTFPPLKSPLKFYAVVPTADWVGRMVKAGADTVQLRCKALHGDELKREIARCAAACQGSRTQLFINDHWREAIEAGAYGVHLGQEDMDTADLAAIAAAGLRLGLSTHSVAELDRALSVHPSYIASGAIFPTTTKQMPTAPQGLDKLREYVKQAGGTPVVAIGGIDLNNARAVLATGVSSLAAVRAVTEAANPEAVVKAFQALWDG

SEQ ID NO: 8286 - protein, 64 aa, Neisseria meningitidis
MNIILNGGPAELHGTTVADLIAQTAPQKPFAVAVNTVFVPKGAYAETVLNENDKIDIVRPVVGG

SEQ ID NO: 8287 - protein, 262 aa, Neisseria meningitidis; identical to SEQ ID NO: 1454

SEQ ID NO: 8288 - protein, 47 aa, Neisseria meningitidis
MEKPAGKPCRPSRCRNQRNTRPPRCAGCRASPKYGNRRSVLLLFEYT

SEQ ID NO: 8289 - protein, 67 aa, Neisseria meningitidis
MTTLSAPNRTDVQTRATLFPSGTKPSAMPADPDLSDTMKVCRPESQTSADRLICLFFIVLQKICIYF

SEQ ID NO: 8290 - protein, 288 aa, Neisseria meningitidis
MKWLFILLVAINIAVFGGTVGYKLTLKQAGRIPEAQNAANNLQVQPVAPTMPVVRNIPASGPVVQAASESDTGALLKQGDILSEEQAEQLRLKKEAEQKKLKEKKQREEKARREKLAAEKAQAERENGAADALCAAQASLTMDEDDYHRIKGLLGKWSHVASRSVEKRTAQAKPADKTYRVVLPVSADAENQAAELSAKGFNPIPFDGALSLGVGNSRENAQALQNRLAGAGFGGAHIVEHFAEADRQDDSLSVSRMTVLFTGVNAADADEIRKITSLYGKLNLKSCK

SEQ ID NO: 8291 - protein, 592 aa, Neisseria meningitidis; identical to SEQ ID NO: 234

SEQ ID NO: 8292 - protein, 168 aa, Neisseria meningitidis
MVDAWSVPDFESKICPPEALAARLALLPRPLVFTNGCFDILHRGHVTYLAQARSMGDALVLALNTDASVRRLGKGGDRPVNPLENRAAVAAALESVDLVTWFDGDTPAALIEAVKPEILVKGGDWAADKIVGAAETLARGGQVFSIPFLHQTSTTKTLAKIRAAEGGK

SEQ ID NO: 8293 - skipped

SEQ ID NO: 8294 - protein, 193 aa, Neisseria meningitidis
MEEKNDYTDAASDNRNGQEIEVGIAGAGDRILAALLNQLFTFLVLLVPFAGLIAFAIKNEGRIGSGEEIFGLLLGMTSFWVGLAGILAYTVIQIYYMSRDGQSLGKKIMRIRVLKTDGRNPGFVGTVLVREIAWSVLVAIIAAVIGLAVGDNGENAINLLAFLANFVLLFMVKRDRRTLYDILADTVVVKLPK

SEQ ID NO: 8295 - protein, 371 aa, Neisseria meningitidis
MKVGFVGWRGMVGSVLMQRMKEENDFAHIPEAFFFTTSNVGGAAPDFGQAAKTLLDANNVAELAKMDIIVTCQGGDYTKSVFQALRDSGWNGYWIDAASSLRMKDDAIIVLDPVNRDVLDNGLKNGVKNYIGGNCTVSLMLMALGGLFQNDLVEWATSMTYQAASGAGAKNMRELISGMGAVHAQVADALADPAGSILDIDRKVSDFLRSEDYPKANFGVPLAGSLIPWIDVDLGNGQSKEEWKGGVETNKILGRSDNPTVIDGLCVRVGAMRCHSQAITLKLKKDLPVSEIETILAGANDWVKVIPNEKEASIHELTPAKVTGTLSVPVGRIRKLGMGGEYISAFTVGDQLLWGAAEPLRRVLRIVLGSL

SEQ ID NO: 8296 - protein, 176 aa, Neisseria meningitidis
MQGFELEDLTLWLIRDAGEDQMWIDRWAISYPVVQMSEASAGQSIGEWQAGLQTAFERIRGKYVAVVAHGAGAAAFLAWLYQADILTRKKIANIILVPQRPDIFPDDAEHAFQRVRCPCRAALVVPEHGGVPHGWAQKQADLWNARLLVSPHSGSLNGMLGGWQWGMKLMQEMLLA

SEQ ID NO: 8297 - protein, 114 aa, Neisseria meningitidis
MLPNKVLGKYDWNVDGKTGIGAAWVVAAFILPMLVWAIFMLSRMQGWLAPTKANPIWALVWLLICLPCLLIASKCLGWKGWRRVVNIFACLTVCAILSVPASLLIAFTLRDLLK

SEQ ID NO: 8298 - protein, 259 aa, Neisseria meningitidis
MLKIISANVNGIRSAYKKGFYEYIAASGADIVCVQELKAQEADLSADMKNPHGMHGHWHCAEKRGYSGVAVYSKRKPDNVQIGMGIEEFDREGRFVRCDFGRLSVISLYLPSGSSAEERQQVKYRFLDAFYPMLEAMKNEGRDIVVCGDWNIAHQNIDLKNWKGNQKNSGFLPEEREWIGKVIHKLGWTDMWRTLYPDVPGYTWWSNRGQAYAKDVGWRIDYQMVTPELAAKAVSAHVYKDEKFSDHAPLVVEYDYAAE

SEQ ID NO: 8299 - protein, 473 aa, Neisseria meningitidis
MTTIYNTLTRQKEPFSPIDPENVRMYVCGMTVYDYCHLGHARVMVVFDMIARWLRECGYPLTYVRNITDIDDKIIARAAENGETIGKLTARFIQAMHEDADALGVLRPDIEPKATENIPQMIAMIETLIQNGKAYPAANGDVYYAVREFAAYGQLSGKSLDDLRAGERVEVDGFKRDPLDFVLWKAAKAGEPAWESPWGNGRPGWHIECSAMSENLFGDTFDIHGGGADLQFPHHENEIAQSVGATGHTCGHHHAQTHHGQSIASHVKYWLHNGFIRVDGEKMSKSLGNFFTIREVLKQYDPEVVRFFILRAHYRSPLNYSDAHLDDAKGALTRLYTTLKNTPPADPMPSEAGDDYTRRFYVAMNDDFDTVKAVAVLFELAGEVNKTNDAQLAGRLKALGGIIGLLQRDPTEFLQGGAASDGLSNEEIEDLIARRKQARADKNWAESDRIRDLLNEHKIILEDNAGGTTWRRG

SEQ ID NO: 8300 - skipped

SEQ ID NO: 8301 - protein, 349 aa, Neisseria meningitidis
MSSNQYIQSLELTNFTVLPNDTFEFSENLNVIVAENGCGKTHLLKILYSLLEVTSNTKNRLLKTELQKSFADKLLNVFRPDSLGRLSKRLQGRGRTEIVLKLQNGTTHSSLNFSSNSSSQVNVQSIGLKENEYTPTPIFLPSRELITLCPWFTSLYQNQSIPFEETWFDTCMQLNHPLAKGPRETKIRELLEPIENAMGGKVSEEQGRFYLSLTNTGGKIEAPLVAEGLRKFVMIARLIATGALLDKGYLFWDEPEANLNPKLIKVAARIIWSLSQQGIQVFIATHSLFLLRELELLKLENNTDLPVRFFSLIASDDGTKVEQGNSINDLNTLILLDENIMQADRYLNI

SEQ ID NO: 8302 - protein, 384 aa, Neisseria meningitidis
MKFIDEAKIEVAAGKGGNGATSFRREKFVPRGGPDGGDGGKGGSVWAEADENTNTLVEYRFVKRYQAKNGEKGHGSDRYGAGADDIVLKMPVGTLIRDLDTGETVADLTYHGQRVCLAKGGKGGLGNIHFKSSVNRAPKQSTPGEEGEARSLQLELKVLADVGLLGMPNAGKSTLITAVSAARPKIANYPFTTLHPNLGVVRIDENHSFVMADIPGLIEGAAEGAGLGHRFLKHLSRTGLLLHVVDLAPFDETVNPAEEALAIINELRKYDEELYGKPRWLVLNKLDMLDEEEAQTRTAAFLEAVGWDYPKPDDRFQFDMETPRLFQISALTHQGTQELVHQINQYLTEKKRIEAEKAEAEKAAANVEIIEQQPKTDTGVFKPE

SEQ ID NO: 8303 - protein, 120 aa, Neisseria meningitidis
MATCPATAANSSKPKLPWNVLPKFAIHSIFSGEPLHHFNAEHFQRAAAAAVLADHADNGNSKHEQIQNAVACRRSLAVALRTLGAVGNRPHDAQCNHRQRKETERFVQAEQAAHPFRLFV

SEQ ID NO: 8304 - protein, 291 aa, Neisseria meningitidis; identical to SEQ ID NO: 288

SEQ ID NO: 8305 - protein, 115 aa, Neisseria meningitidis
MRLNHKQGEAGEDAALAFLQSQGCTLLARNWHCAYGEIDLIVKNGGMILFVEVKYRKNRQFGGVAYSISPSKLLKLQRSVEYYLQQNRLTNVPCRLDAVLIEGSRPPEWIQNITG

SEQ ID NO: 8306 - protein, 197 aa, Neisseria meningitidis
MTTLQERVAAHFAESIRAKQEAGKVLVEPTVQAAELMLQCLMNDGKILACGNGGSAADAQHFAAEMTGRFEKERMELAAVALTTDTSALTAIGNDYGFDHVFSKQVRALGRAGDVLVGISTSGNSANVIEAVKAAHERDMHVIALTGRDGGKIAAILKDTDVLLNVPHPRTARIQENHILLIHAMCDCIDSVLLEGM

SEQ ID NO: 8307 - protein, 202 aa, Neisseria meningitidis; identical to SEQ ID NO: 3866

SEQ ID NO: 8308 - protein, 210 aa, Neisseria meningitidis
MPSEPPSDGIARHPKSTIKMAKKPNKPFRLTPKLLIRAVLLICIAAIGALAIGIVSTFNPNGDKTLQAEPQHTDSPRETEFWLPNGVVGQDAAQPEHHHAASSEPAQPDGTDESGSGLPSPAAPKKNRVKPQPADTAQTDRQPDDAGTQAENTLKETPVLPTNVPRPEPRKETPEKQAQPKETPKENHTKPDTPKNTPPKPHKEILDNLF

SEQ ID NO: 8309 - protein, 259 aa, Neisseria meningitidis
MNGIIIKTPEEIEKMRELGKLVAEALDYIGQFVKPGVTTDEIDKLVYDYHVNVQGGYPAPLHYGNPPYPKSCCTSVNHVICHGIPDDKPLKEGDIINIDLTIKKDGFHGDSSRMFTVGKVSPIAQRLIDVTHASMMAGIEAVKPGATLGDVGYACQQVAENAGYSVVQEFCGHGIGRGFHEAPQVLHYGKKGQGPVLKPGMIFTVEPMINQGKRHLRILNDGWTVVTKDRSLSAQWEHEVLVTETGYEILTVSPASGKP

SEQ ID NO: 8310 - protein, 99 aa, Neisseria meningitidis
MKIFENIEDVKAIRKKTGLNQIDFWGKVGVTQSGGSRYETGRKMPKPVRELLRLVHIECIDLAKVNKKDMEIAALLKKHHPDLYAELSKQTKSERKKQS

SEQ ID NO: 8311 - protein, 124 aa, Neisseria meningitidis; identical to SEQ ID NO: 906

SEQ ID NO: 8312 - protein, 488 aa, Neisseria meningitidis; identical to SEQ ID NO: 1676

SEQ ID NO: 8313 - protein, 29 aa, Neisseria meningitidis
MLATHSNPETAYSDTHHCRFSLLLRFRRL

SEQ ID NO: 8314 - protein, 196 aa, Neisseria meningitidis
MSEKIILPVLSLGGVRLEPLDVHHETGLREAVCDGEVWKLGVTSAPHPDRVADYIGTALATRLAFAVVDEEAGRVVGTTAYYHFEPQIPRLDIGFTWYAASARRTRINTCCKIMLLDSAFDVLACRCVGWRTDILNLASQRAIERLGAEKDGVLRMHMLRKDGSVRDTVVYSMLREDWCKNREILTGRLAGYGVQV

SEQ ID NO: 8315 - protein, 193 aa, Neisseria meningitidis; identical to SEQ ID NO: 1634

SEQ ID NO: 8316 - protein, 77 aa, Neisseria meningitidis
MWHIVAIGYLFVAVMYSAAQPSIARALIYLVFWAVLPTVFTVFTITVRRRNHLMRQQEQAESEQQRAQRQKDSGTKP

SEQ ID NO: 8317 - protein, 242 aa, Neisseria meningitidis
MSQITMRQMIEAGVHFGHQTRFWNPKMAQYIFGARNKIHIVNLEKTLPMFQDAQEAVRRLVANKGTVLFVGTKRQARDIIREEATRAGMPFVDYRWLGGMLTNYKTVKQSIKRLEEKTAALENAAESGFSKKEILEMQRDVEKLERSLGGIKNMKGLPDAIFVIDTGYQKGTLVEAEKLGIPVIAVVDTNNSPDGVKYVIPGNDDSAKAIRLYCRGIADAVLEGKNQALQETVAAAQEAAAE

SEQ ID NO: 8318 - protein, 284 aa, Neisseria meningitidis
MAEITAKMVADLRAATGLGMMECKKALVEAEGNFDKAEEILRIKSGAKAGKLAGRTAAEGVLAYAINGNVGALVEVNCETDFVAKDAGFVEFANFVAKTAAEKKPASVEELSELVEAERKAIIAKLGENMSVRRFQVIDTANQLVAYIHGALATEGVLVEYKGSEDVARKIGMHIVAAKPQCVSEAEVDAETVEKERHIYTEQAIASGKPADIAAKMVEGRIRKFLAEITLNGQAFVMNPDQTVAQFSKENGTEVISFVRYKVGDGIEKKAVDYAAEVAAAAKV

SEQ ID NO: 8319 - protein, 239 aa, Neisseria meningitidis
MTQQIKYKRVLLKLSGESLMGSDPFGINHDTIVQTVGEIAEVVKMGVQVGIVVGGGNIFRGVSAQAGSMDRATADYMGMMATVMNALALKDAFETLGIKARVQSALSMQQIAETYARPKAIQYLEEGKVVIFAAGTGNPFFTTDTAAALRGAEMNCDVMLKATNVDGVYTADPKKDPSATRYETITFDEALLKNLKVMDATAFALCRERKLNIVVFGIAKEGSLKRVITGEDEGTLVHC

SEQ ID NO: 8320 - skipped

SEQ ID NO: 8321 - protein, 483 aa, Neisseria meningitidis; identical to SEQ ID NO: 166

SEQ ID NO: 8322 - protein, 118 aa, Neisseria meningitidis
MNEHNLLIFCLKDNVSISEYTEMVDWAYENIQSETVVEITENQIIEYQNRGLWGLVSEITDNWLFGPSEGDWLIDKESILAVKEKLQNSDFSTEPLVKNIIHVLEYAIKNEKTVIFHF

SEQ ID NO: 8323 - protein, 254 aa, Neisseria meningitidis
VGFSNPIFSNSGISETIDASNIFVGYKYPTYISAQQTLQDINELGNLSPEAQLAAASLLQDSAFAVKDGINSARQWADAHPNITATAQTALAVAEAATTVWGGKKVELNPTKWDWVKNTGYKTPAVRTMHTLDGEMAGGNRPPKSITSNSKADASTQPSLQAQLIGEQISSGHAYNKHVIRQQEFTDLNINSPADFARHIENIVSHPTNMKELPRGRTAYWDDKTGTIVIRDKNSDDGGTAFRPTSGKKYYDDL

SEQ ID NO: 8324 - protein, 68 aa, Neisseria meningitidis
MNILSINNQNSTISLTQDEVFVLRAILNEIYAGVCVDSREFENVSGVRKHEVDNLQQQFAGIYKKMTT

SEQ ID NO: 8325 - protein, 83 aa, Neisseria meningitidis
MDNTRIMAAREAGVKVEANVHNFNDRLSSKERIRFKHDGIEPQTWGEAIQLRIRKQETQKGVPEGWSKRFPNGSIYDVKVLRK

SEQ ID NO: 8326 - protein, 123 aa, Neisseria meningitidis
MIKQNSFVPYPEAMLPKGFKYPQSYLKLAQSTHAINYDEQYSFPWWFENAESNISEVIDIYFEITGIPNLLPFARNQEWAACFDISDKSGNPKIIVVNLDNTKYYETFENFDTWLKEAENDGW

SEQ ID NO: 8327 - protein, 281 aa, Neisseria meningitidis
VGFSNPTFFNSGISETIDASNIFVGYKYPTYISAQQTLQDINELGNLSPEAQLAAASLLQDSAFAVKDGINSARQWADAHPNITATAQTALSVAEAATTVWGGKKVNLNPTKWDWVKNTGYKTPAARPMQTLDGEMAGGNKPPKPSTQQHPTHSDNNIGLPASYVKPDTSISPTGTIQDRIRWTKSKFPTEKSLNGHFKAHGKEFGDITIEDYQKMASDLLSKQTSDKILGYQTEHRRVRYDINNNIYVLANPKTFKIKTMFKPNLGKKYYDGEFKKDMGN

SEQ ID NO: 8328 - protein, 89 aa, Neisseria meningitidis
MMTESHGYLSNNLPVKIINDIIYATQLVEDLVLGKIKIVDFLKSYNNFYCWLGFDELPQSEKIKFLSYLNILSIHKEIQDETVNRVYTD

SEQ ID NO: 8329 - protein, 100 aa, Neisseria meningitidis
MLNEIFEIYSRQGESLIGIGIREAALPVPIAIDILNLFINERILVLGGDIYIKKDNYFYQTYDNWYYEGSNLFNSIDKAMHYLSQIKLENAYVSFVLKFI

SEQ ID NO: 8330 - protein, 212 aa, Neisseria meningitidis
KCWVLIQPTLTGSDTAAQQTLQGINDLGNLSPEAQLAAASLLQDSAFAVKNGINSARQWADAHPNITATAQTALSVAEAAGTVWRGKKVELNPTKWDWVKNTGYKKPAARPMQTVDGEMAGGNKSLKIGTQSVEKSTGRTIPNNLKEQLAMEEVKANPQGKTPARIPPMSDTKNGWLAKDGWVKRVQNVNKIEIHYIENSRTGEKTDFKFKD

SEQ ID NO: 8331 - protein, 114 aa, Neisseria meningitidis
MFLDDVNVFLDDLNVFLDDLNTNPITDEWYMSNFADKHIKILESYEAFDILKQFVDYMIEEYDEKSEYEIMEILRQLKYQADTNEKFYTNTQKQKIVELYKQEISQDILNEIFR

SEQ ID NO: 8332 - protein, 114 aa, Neisseria meningitidis
MIIEHNGNIHKIARMTGNKNNFLEIILSDIHENIKIKPLTIKVKGENVINILPEEVSFYVKQGVDLIYEKYKRKFFISEISFCQSDSRPSSIYAFLTFHLLEDIIKNESPSNYT

SEQ ID NO: 8333 - skipped

SEQ ID NO: 8334 - protein, 105 aa, Neisseria meningitidis
MKKNIFHNVSLYEIIFSDNGNTLTLSFTDTIEGNYFGYIKCSNILNFKLDTNNFVDYEDKEDSLFPLFIPEIELYKYQFYSEIIIDVGIIIKISAETINFEPLGK

SEQ ID NO: 8335 - protein, 252 aa, Neisseria meningitidis
KYSCYISAQQTLQGINNSGKLSPEAQLAAASILQDSAFAVKDGINSARQWADAHPNITATAQTALAVAEAAGTVWRGKKVELNPTKWDWVKNTGYKKPAVRHMQTKALGTVDEIGDTVQQVGKQASGQKTSGGNPAIDSDPYSPSSVAARIEAGKARSDLQIKDILSNTTQRSKTKGPAVQYDKVGDYNDALNDFNSLNVRNVQTRPNGTITGNLPDGRAVNARNDSSGGEPTLEITISNNRKIKIRYGNTR

SEQ ID NO: 8336 - protein, 133 aa, Neisseria meningitidis
MKLKSLDFPTGYFYFDNAAINSDKVEVIAVGYRNTDKTIKIFIEDVIHFRVVDESYFIDTFMDLISEDADRALLHENGGQSFFELLDECYAEWILKESYFPLNREFFKYYIFMFEQTFIEIIGSSATYSIIEG

SEQ ID NO: 8337 - protein, 114 aa, Neisseria meningitidis
MNLENYENILIKLLFYHNNLVNEYSYFIENKNLFKIVSRTKTSKGFFFTIEKPLNFLSKKTYFEFNFKYLHSGKERFGSFMCWINTNLMEFEGVFFNDLLPDNMIINNFFEIND

SEQ ID NO: 8338 - protein, 34 aa, Neisseria meningitidis
MDDIRGIIQGAVNPLIYKVSKQKIIYNNKLISGT

SEQ ID NO: 8339 - protein, 118 aa, Neisseria meningitidis
MNEHNLLIFCLKDNVSISEYTEMIDWAYKNIQSETVVEITENQIIEYQNRGLWRLVSEITDNWLFGPSEGDWLIDKESILAVKEKLQNSDFSTEPLVKNIIHVLEYAIKNEKTVIFHF

SEQ ID NO: 8340 - protein, 42 aa, Neisseria meningitidis
MPQTWGEAIQFRIKKQIENELAPPNWSTQFPNGSIYDPKVTK

SEQ ID NO: 8341 - protein, 124 aa, Neisseria meningitidis
MIIQNEFNLYPSNMLPERFCYPEKYVRISNDTSLIPYIQPHNFHWWFENYGTEGAEVAYIFRNSILPDLNLIPFASNGEWEAYFDGNDVTGNSRVIVINLDNIENHEFFNSFEDWLELAIKDTW

SEQ ID NO: 8342 - skipped

SEQ ID NO: 8343 - protein, 328 aa, Neisseria meningitidis
MQYRIRRENEAPEAKNAGETLWERDIMREVLLSAYQDRRRERMWKNIWRAVSTLILVALIAGIFRKDEAALQLAGNTPHTAVVNLYGEIGNGVEDQVKKLKDGMEAAYKNPQAKAIVIRANSPGGSPVVSNTAFEEIRRLKAQHPGIPVYLVAEDMCASGCYYIAAAADKIYADPSSIVGSIGVIGSSFDATGLMEKIGVKRRVKIAGSNKGMGDPFSPETPEQSKIWEEMLTGIHGEFIKAVKTGRGGRLKFRQYPDVFSGRVYTGADALKVGLVDGLGNIYSVARDVVKAPDVVDYTPKDDFGRILGRRFGAELKASVREALQAVR

SEQ ID NO: 8344 - protein, 266 aa, Neisseria meningitidis
MNAFNLIIIGDEILHGSSQDKHFAFFKSLLESKGLKLNQVQYLPDEPDLLVRQLRRSFSDGMPTFVTGGIGATPDDHTRQAAAAALDLPVVRHSEAAKFIEGITQKRGEPLDSPEHAQRLKMADFPEGAELVPNPFNNIAGFSIREHYFFPGFPVMAHPMAEWVLETYYADRFNQTERGSRSVYVFEQPESRITPLMEHIEQTYPGVRSYSLPSVGWTHSDGTQVKPHIEFGIKAEGEAVNLLDAAWAEVLHSLDGLGAELKNRVN

SEQ ID NO: 8345 - protein, 447 aa, Neisseria meningitidis
MSQNHTILQSLPVGQKVGIAFSGGLDTSAALLWMKLKGALPYAYTANLGQPDEDDYNAIPKKAMEYGAENARLIDCRAQLAHEGIAAIQCGAFHVSTGGIAYFNTTPLGRAVTGTMLVSAMKEDDVNIWGDGSTYKGNDIERFYRYGLLTNPALKIYKPWLDQQFIDELGGRHEMSEFLIANGFNYKMSVEKAYSTDSNMLGATHEAKDLEFLNSGIKIVKPIMGVAFWDENVEVSPEEVSVRFEEGVPVALNGKEYADPVELFLEANRIGGRHGLGMSDQIENRIIEAKSRGIYEAPGMALFHIAYERLVTGIHNEDTIEQYRINGLRLGRLLYQGRWFDSQALMLRETAQRWVAKAVTGEVTLELRRGNDYSILNTESPNLTYQPERLSMEKVEDAAFTPLDRIGQLTMRNLDITDTRVKLGIYSQSGLLSLGEGSVLPQLGNKQ

SEQ ID NO: 8346 - protein, 80 aa, Neisseria meningitidis
MIPYVKRNPMKEYKVIIYQESLLSSLFFGAAKVNPIKFSEFLNKQTPEGWRVVTMEKDLRRMLLFFKREAYVVILERDRV

SEQ ID NO: 8347 - protein, 71 aa, Neisseria meningitidis
MFKLGVYTCLGLFAGWVLLLIVQLWFSFLEAELFFKITLTMAGLFVIILAALLVCGQYFSEKKMKDDGFIN

SEQ ID NO: 8348 - protein, 488 aa, Neisseria meningitidis; identical to SEQ ID NO: 2184

SEQ ID NO: 8349 - protein, 409 aa, Neisseria meningitidis
MAFGKSLFHAIGRVSLVRQIAAGLALGIVIGSVSPQLGLAAGLFGSLFVGALKAVAPVLVFILVAATIAQHQKGNKAHIRPIIVLYLIGTFSAALTAVIAGMVFPTHIVLAGAGDVSAAPPSGIVEVLKSLLMNLVANPINAIANANYIGILAWALVLGAALRNHGSDVTRQVVADLAEAVSTVVKWIIRFAPLGIFGLVSSTIAETGFGALAGYAKLLAVLLGCMAFIALAVNPAIVWWKIRRNPFPLVFTCLRESGVYAFFTRSSAANIPVNMALAKKLGLHEDTYSISIPLGATINMAGAAITITVLAMAAAHTQGITVDFATALLLSLVATVSACGASGVAGGSLLLIPLACSLFGIDNDVAMQVVAVGFIIGVIQDSAETALNSSTDVLFTAAADLGRQRNRAE

SEQ ID NO: 8350 - protein, 635 aa, Neisseria meningitidis
MPSEASRPVRTVLKSKAATPMHDTRTMMIKPTALLLPALFFFPHAYAPAADLSENKAAGFALFKNKSPDTESVKLKPKFPVLIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKAYPLAKLGNTQAAVNPDTATADLNVVVDSGRPIAFGDFEITGTQRYPEQIVSGLARFQPGMPYDLDLLLDFQQALEQNGHYSGASVQADFDRLQGDRVPVKVSVTEVKRHKLETGIRLDSEYGLGGKIAYDYYNLFNKGYIGSVVWDMDKYETTLAAGISQPRNYRGNYWTSNVSYNRSTTQNLEKRAFSGGVWYVRDRAGIDARLGAEFLAEGRKIPGSAVDLGNSHATMLTASWKRQLLNNVLHPENGHYLDGKIGTTLGTFLSSTALIRTSARAGYFFTPENKKLGTFIIRGQAGYTVARDNADVPSGLMFRSGGASSVRGYELDSIGLAGPNGSVLPERALLVGSLEYQLPFTRTLSGAVFHDMGDAAANFKRMKLKHGSGLGVRWFSPLAPFSFDIAYGHSDKKIRWHISLGTRF

SEQ ID NO: 8351 - protein, 1405 aa, Neisseria meningitidis
MATSDGIAANHFETDIMTDTAPTDTDPTENGTRKMPSEHRPTPPAKKRRPLLKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGAASVGLKKPFALDTAIYTKGGLEGKTIHSTARLSGSLKDVRAELAIDGGNIRLSGKSVIHPFAESLDKTLEEVLVKGFNINPAAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAAVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLGIANAFGGNMANAPLGGRITASLPDLGALKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNGKGK

SEQ ID NO: 8352 - protein, 485 aa, Neisseria meningitidis
MSRHPAPTGEKTFFGHPFQLSTLFHIELWERFSFYGMQGILLIYLYYTADKGGLGIDKTLAGGIVGAYSGSVYLSTILGAWFADRVWGAEKTLFLSGIVVMLGHIVLAAAPGLYGLLIGLIFIALGSGGVKSTASSMVGALYEQDEMRPLRDAGFSIFYIAINIGGFLGPLLTGLLQENIGFHYGFGAAAVGMAFGLWRYSLGRKNLPHPTVPHPLSKGQGKTAAAVGIALIAALATAIKTGLVNLDNFSGILLSTVILAVIAYFARLLTNPRVSSDNKRHIIAYIPLFLTICMFWAVWFQIYTVATVYFDETVNRTIGSFTVPVAWKDSMQSLWVILFSGLMAAMWTKMGRKQPKTPLKFAMAVFVTGASFLGFVPFISSGTPMPIAVFALIVLAITIGELMISPIALSISTKIAPPLFKTQMVALNFLAFSLGFTLGGVLFEKGYQAGDEIGFYRLLFYIGAATGFLLLLLVPKLNKMLEGTD

SEQ ID NO: 8353 - protein, 70 aa, Neisseria meningitidis
MLKQPTRTLGGQRHCVLFGLAPNGVWPAAYCYQMRGAPLPHLFTLTCAAKAAIGGFAFCSTFRRVTAPGR

SEQ ID NO: 8354 - protein, 367 aa, Neisseria meningitidis
MEAEVINQLNNTLNDLEKRSEDIRVYMDYQGKKDRLEEVIGLSEDPELWNDPKRAQEIGKERKILEGIVLTLDNIASGIEDNRMLIEMTVEENDEEGFAAVQEDVAGLEKQMADLEFKRMFNQPADPNNCFIDITAGAGGTEAEDWAGMLFRMYSRYAERKGFRIEILEEDDGEIAGINRATIRVEGEYAYGLLRTETGVHRLVRYSPFDSNNKRHTSFASVFVYPEIDDSIEIEINPADLRIDTYRASGAGGQHINKTDSAVRITHEPTGIVVQCQNDRSQHANKAAAMEMLKSKLYELEMRKRNEEKQALEEGKSDVGWGSQIRSYVLDSSRIKDLRTGYEVGNTKAVLDGDLDGFIEASLKQGV

SEQ ID NO: 8355 - protein, 297 aa, Neisseria meningitidis
MVTFSKIRPLLAIAAAALLAACGTAGNNAVRKPVQTAKPAAVVGLALGGGASKGFAHVGIIKVLKENGIPVKVVTGTSAGSIVGSLFASGMSPDRLELEAEILGKTDLVDLTLSTSGFIKGEKLQNYINRKVGGRQIQQFPIKFAAVATDFETGKAVAFNQGNAGQAVRASAAIPNVFQPVIIGRHTYVDGGLSQPVPVSAARRQGANFVIAVDISARPGKNISQGFFSYLDQTLNVMSVSALQNELGQADVVIKPQVLDLGAVGGFDQKKRAIRLGEEAARAALPEIKRKLAAYRY

SEQ ID NO: 8356 - protein, 149 aa, Neisseria meningitidis
MKIGTTWQTASAMLVLRLFAAYEFLESGLQKWNGENWFSEINDQFPFPFNLLPDALNWNLAMYAELLLPVLLLLGLATRLSALGLMVVTAVAWAAVHAGSGYNVCDNGYKMALIYIVVLIPLLFQGAGGWSLDTLLKKRFCPRCRLKQD

SEQ ID NO: 8357 - protein, 102 aa, Neisseria meningitidis; identical to SEQ ID NO: 3392

SEQ ID NO: 8358 - protein, 288 aa, Neisseria meningitidis
MPSEPGKNMIQHAGLGYRRDLAEDFLSLSENSPICFIEAAPENWLKMGGWARKQFDRVAERLPLALHGLSMSLGGQAPLDTDLIDGIKEMMRRYDCTFFSDHLSYCHDGGHLYDLLPLPFTEEMVHHTARRIREVQDRLGCRIAVENTSYYLHSPLAEMNEVEFLNAVAREADCGIHLDVNNIYVNAVNHGLLSPEAFLENVDAERVCYIHIAGHDVETPELLIDTHGAAVLPTVWDLLELAYAKLPTIPPTLLERDFNFPPFSELEAEVAKIADYQTRAGKECRRAA

SEQ ID NO: 8359 - protein, 248 aa, Neisseria meningitidis
MQPETSAQYQHRFAQAIRGGEAADGLPQDRLNVYIRLIRNNIYSFIDRCYTETLQYFDREEWGRLKEGFVRDACAQTPYFQEIPGEFLQYCQSLPLLDGILALMDFEYTQLLAEVAQIPDIPDIHYSNDSKYTPSPAAFIRQYRYDVTDDLHEAETALLIWRNAEDDVMYQTLDGFDMMLLEIMGFSALSFDTLAQTLVEFMPEDDNWKNILLGKWSGWTEQRIIIPSLSAISENMEDNSPGQNHLSA

SEQ ID NO: 8360 - protein, 195 aa, Neisseria meningitidis
MPLPDLTDAELIESRKLLLHFARLQLPDHPDLAEDLVQETLLSAYSAGDSFQGRALVNSWLFAILKNKIIDALRQIGRQRKVFTTLDDELLDEAFESHFSQNGHWTQEGQPQHWNTPEKSLNNNEFQKILQSCLYNLPENTARVFTLKEILGFSSDEIQQMCGISTSNYHTIMHRARESLRQCLQIKWFNQENPK

SEQ ID NO: 8361 - protein, 59 aa, Neisseria meningitidis
MKKCRDIALLLSKHQDRETTPGEKISIYTHLLFCPYCREYKRQLQTIKRSLAKTTRTSK

SEQ ID NO: 8362 - protein, 36 aa, Neisseria meningitidis
MYKYAKYEGCINLPYLLYLPYFTDGATPPAQPVLSE

SEQ ID NO: 8363 - protein, 140 aa, Neisseria meningitidis
MRPIFLSFVLFPILITACSTPDKSARWENIGTISNGNIHTYINKDSVRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 8364 - protein, 321 aa, Neisseria meningitidis; identical to SEQ ID NO: 6441

SEQ ID NO: 8365 - protein, 86 aa, Neisseria meningitidis
MRQISLTDYFCKGLYLFDIFEDIVFLGKRLFTVRKFLDFSELLEMVNTQGYFLEFLYLYSGLNLNQYGVASPCRTICTVCGFVALS

SEQ ID NO: 8366 - protein, 189 aa, Neisseria meningitidis
MLFPRIIAASAQRKLSVYLKKGGLVAYPTESCYGLGCLPTLAKALGKLAHLKKRPQHKGMIVIGNQFEQLQPLLQMPSENLQDMLRKEWPAPKTFLLSAKSCVLPELRGKQRSKLAVRVPAHVGARRLCQALQTPLVSTSCNRAGKRACRTEREVRRQFGRDVWIVGGRIGRQKSPSQIIDGETGKRLR

SEQ ID NO: 8367 - protein, 423 aa, Neisseria meningitidis
MKLLVIGNGGREHALAWKLAQSPKVETVFVAPGNAGTAIEPKLQNIDLTAHQDLIEFCRKENIVFTVVGPEAPLAAGIVDDFRAAGLKIFGPTQYAAQLESSKDFAKAFMAKYNIPTAQYQTFENADAAHDYVNQKGAPIVIKADGLAAGKGVIVAMTLDEAHAAIDDMLLDNKMGNAGARVVIEDFLQGEEASFIVMVDGNNVLPMATSQDHKRLLDGDKGLNTGGMGAYSPAPVVTPVVYERAMNEIILPTVAGMKAEGHEFTGFLYAGLMIDQSGAPYTIEFNCRFGDPETQPIMSRLNSDLSDLVEAAIDGKLDSVTAEWSPQTAVGVVLAAQNYPETPKKGDIISGLDAANQIGKVFHAGTTANEKGDVLTNGGRVLCVVGLGDNVAQAKAKAYGALEKISFDGMQYRKDIADKAINR

SEQ ID NO: 8368 - protein, 105 aa, Neisseria meningitidis
MQKRIDEIQSKYREWCHLLPQLEEDIRRWKHVVTLIRDMDNFYTHEYQACHQAIEDGVELDLSTEGEYSIMSEDALWNALGEFHQLAWLYLRSSVDALDKYTQED

SEQ ID NO: 8369 - protein, 203 aa, Neisseria meningitidis
MITTYKTITSLTQAEFKDKGSRFIAFAYPIRTLADVKKYLDPLKEEHHKARHWCYAYRLGVDGVQFRANDDGEPSGSAGRPILGQIDSVGITDVLVVVVRYFGGTLLGVPGLIHAYKEATAQALAVAEVVEKNIEKTVWLKCEYPFLNEAIRIAKQYQADILERDLQLDCRLTVSLSLVNYEACVAAWKNTRQIEVNTEKPFE

SEQ ID NO: 8370 - protein, 311 aa, Neisseria meningitidis
MSVLIIVEHDNKQLNPTTLHAVTAAAKLGKVDLLVAGNGASAVVEFAKQVAGVKKVLVADAAHYAEGLAEELAPLVVKLAADYRYVAATATTFGKNLLPRVAALLDVPQISDLTEIVDNTTFVRPIYAGNAFETVQADSEKLVLTFRATVFDAVAAQGGNAEVINVEATPAQNLSRFVNRQLSHSDRPELTQAKVIVSGGRALGSAEKFNEVLTPLADVLGAAIGASRAAVDAEYAPNDAQVGQTGKVVAPQLYFAIGISGAIQHVAGMQDSKVIVAINKDADAPIFNVADYGLVGDLFEIVPQLTEVLKN

SEQ ID NO: 8371 - protein, 249 aa, Neisseria meningitidis
MKALVAVKRVVDYNVKVRVKADGSDVDIGNVKMSMNPFDEIAVEEAVRLKEAGKVSEIVAVSLGEKKCEETLRTALAMGADRAIHVETDTKLESLAVAKLLKAVADKENPQIFFLGKQAIDDDANQVAQMLAALLNAAQGTFASKVQIEGDEVQIVREIDGGEETIALKLPAVISADLRLNEPRFVKLPNIMAAKKKPLEKLTPDDLVADISPRLKTVKFAEPKARQAGVKVASVAELVEKLKNEAKVI

SEQ ID NO: 8372 - protein, 322 aa, Neisseria meningitidis
MKILLVRLSSMGDLIHTLPAIEDLARQCPDVELHWLCEAGFADIARLHPFVKKIHVMKWRQWRKHLFRAETWREMGHLKQTLRQEVFDFVLDSQGLIKSACFAKMAKSPICGLDKNSAREGWAALAYVKTYAVPKGKNAVWRNRELFAQVFGYVMPETQVFGLTVPEAGRLKNLAQPYYAALHATSRDSKLWPVENWRSLLQKLNEEQQCNIYLPWGNEDEKTRAKQIADGLPFAIVCDKINLLQAAYLLKYAVGIVGVDTGLLHLANALEKPVVGIYTDTDPIKTGVQVSPIAKNLGNIGQIPTADLVYQALMDCVAADKG

SEQ ID NO: 8373 - protein, 211 aa, Neisseria meningitidis
MIVSIDVDAQKTFTPLCPDELPVNEGHLIVEELNAQAALADLRVMTKDAHHMVAKWLVDNPVDMLKPTGLPDADLTWVAHAMVGTRGYELLDGLPSAKEYDYCVWKGVDPELHPYGACFHDIEEKLSTGLIEWLRCQNTDTVIIGGLATDYCVKTTVLQLLKGGRWQVVVNEAACRGIAPETIETAWQEMHSAGAIILKNADEINKYINNQ

SEQ ID NO: 8374 - protein, 226 aa, Neisseria meningitidis
MTYTITPIGTARSPYKQKFGIARQPGLVSAAKACIELNPKFTADSVRGLEDFDYVWISFIFHGVLDEGWAQMVRPPRLGGKQKMGVFATRSPHRPNHLGLSLLKLERIETGKPVRLYCSGADLLDGTPIVDIKPYIPFVESKPDAASGFVSGKPVELEVVWQENIGAENLSANTKNLISQSIAQDPRPAYQNIPERIYVMNIADYEVRFQIEENRATVIDLSPTPL

SEQ ID NO: 8375 - protein, 334 aa, Neisseria meningitidis
MSIKVAINGFGRIGRLALRQIEKAHDIEVVAVNDLTPAEMLLHLFKYDSTQGRFQGTAELKDDAIVVNGKEIKVFANPNPEELPWGELGVDVILECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVASGSLTELVSILERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 8376 - protein, 864 aa, Neisseria meningitidis
MSKSAVSPMMQQYLGIKAQHTDKLVFYRMGDFYEMFFDDAVEAAKLLDITLTTRGQVDGEPVKMAGVPFHAAEQYLARLVKLGKSVAICEQVGEVGAGKGPVERKVVRIVTPGTLTDSALLEDKETNRIVAVSPDKKYIGLAWASLQSGEFKTKLTTVDKLDDELARLQAAEILLPDSKNAPQLQTASGVTRLNAWQFAADAGEKLLTEYFGCQDLRGFGLDGKEHAVAIGAAGALLNYIRLTQNLMPQHLDGLSLETDSQYIGMDAATRRNLEITQTLSGKKSPTLMSTLDLCATHMGSRLLALWLHHPLRNRAHIRARQEAVAALESQYKPLQCRLKSIADIERIAARIAVGNARPRDLAALRDSLFALSEIELSAECSSLLGTLKAVFPENLSTAEQLRQAILPEPSVWLKDGNVINHGFHPELDELRRIQNHGDEFLLDLEAKERERTGLSTLKVEFNRVHGFYIELSKTQAEQAPADYQRRQTLKNAERFITPELKAFEDKVLTAQEQALALEKQLFDGVLKNLQTALPQLQKAAKAAAALDVLSTFSALAKERNFVRPEFADYPVIHIENGRHPVVEQQVRHFTANHTDLDHKHRLMLLTGPNMGGKSTYMRQVALIVLLAHTGCFVPADAATIGPIDQIFTRIGASDDLASNRSTFMVEMSETAYILHHATEQSLVLMDEVGRGTSTFDGLALAHAVAEHLLQKNKSFSLFATHYFELTYLPEAHTAAVNMHLSALEQGQDIVFLHQIQPGPAGKSYGIAVAKLAGLPVRALKSAQKHLNGLENQAAANRPQLDIFSTMPSEKGDEPNVGNFVDKAEEKHFEGILAAALEKLDPDSLTPREALSELYRLKDLCKSVS

SEQ ID NO: 8377 - DNA, 33 bp, Neisseria meningitidis
cgcggatcccatatgtttatgaacaaattttcc

SEQ ID NO: 8378 - DNA, 29 bp, Neisseria meningitidis
cccgctcgagtttgctttcgatagaacgg

SEQ ID NO: 8379 - DNA, 30 bp, Neisseria meningitidis
cgcggatcccatatggccggcgtgctgatg

SEQ ID NO: 8380 - DNA, 29 bp, Neisseria meningitidis
cccgctcgagttcatctttttcatgttcg

SEQ ID NO: 8381 - DNA, 28 bp, Neisseria meningitidis
cgcggatcccatatgccgaccgtccgtt

SEQ ID NO: 8382 - DNA, 28 bp, Neisseria meningitidis
cccgctcgagtaaacgaatgccgtccag

SEQ ID NO: 8383 - DNA, 31 bp, Neisseria meningitidis
cgcggatcccatatggaatcaacactttcac

SEQ ID NO: 8384 - DNA, 27 bp, Neisseria meningitidis
cccgctcgagcacgcggttgctgtaac

SEQ ID NO: 8385 - DNA, 35 bp, Neisseria meningitidis
ccggaattctacatatgtttcagaaacatttgcag

SEQ ID NO: 8386 - DNA, 30 bp, Neisseria meningitidis
cccgctcgagtttgtttttccaagacagag

SEQ ID NO: 8387 - DNA, 32 bp, Neisseria meningitidis
cgcggatccgctagcggacacacttatttcgg

SEQ ID NO: 8388 - DNA, 26 bp, Neisseria meningitidis
cccgctcgagcagcgcgtcaaggctt

SEQ ID NO: 8389 - DNA, 32 bp, Neisseria meningitidis
cgcggatccgctagcgagttccgcctgcataa

SEQ ID NO: 8390 - DNA, 27 bp, Neisseria meningitidis
cccgctcgagccagcggtagcctaatt

SEQ ID NO: 8391 - DNA, 30 bp, Neisseria meningitidis
cgcggatccgctagcaggggcgacgacgtg

SEQ ID NO: 8392 - DNA, 28 bp, Neisseria meningitidis
cccgctcgagaaacagccatttgagcga

SEQ ID NO: 8393 - DNA, 34 bp, Neisseria meningitidis
cgcggatcccatatgtatttgaaacagctccaag

SEQ ID NO: 8394 - DNA, 26 bp, Neisseria meningitidis
cccgctcgagttctgggtgaatgtta

SEQ ID NO: 8395 - DNA, 34 bp, Neisseria meningitidis
cgcggatcccatatgtcagatttggcaaacgatc

SEQ ID NO: 8396 - DNA, 29 bp, Neisseria meningitidis
cccgctcgagcgtatcatatttcacgtgc

SEQ ID NO: 8397 - DNA, 34 bp, Neisseria meningitidis
cgcggatccgctagcacggttttgaagctttcgc

SEQ ID NO: 8398 - DNA, 27 bp, Neisseria meningitidis
cccgctcgagaatgacgaggttgtccg

SEQ ID NO: 8399 - DNA, 31 bp, Neisseria meningitidis
cgcggatcccatatgtgcggcacactgaccg

SEQ ID NO: 8400 - DNA, 24 bp, Neisseria meningitidis
cccgctcgaggccgcctttgcggc

SEQ ID NO: 8401 - DNA, 32 bp, Neisseria meningitidis
cgcggatcccatatgtcgggcatttacaccgg

SEQ ID NO: 8402 - DNA, 28 bp, Neisseria meningitidis
cccgctcgagttcgtcgaaaacctttgc

SEQ ID NO: 8403 - DNA, 35 bp, Neisseria meningitidis
cgcggatcccatatgaataaaggtttacatcgcat

SEQ ID NO: 8404 - DNA, 26 bp, Neisseria meningitidis
cccgctcgagaatcgctgcaccggct

SEQ ID NO: 8405 - DNA, 30 bp, Neisseria meningitidis
cgcggatcccatatgactgccttttcgaca

SEQ ID NO: 8406 - DNA, 26 bp, Neisseria meningitidis
cccgctcgaggcgtgaagcgtcagga

SEQ ID NO: 8407 - DNA, 29 bp, Neisseria meningitidis
cgcggatcccatatgtgccggctggcggg

SEQ ID NO: 8408 - DNA, 25 bp, Neisseria meningitidis
cccgctcgagccagcggacgcgttc

SEQ ID NO: 8409 - DNA, 31 bp, Neisseria meningitidis
cgcggatccgctagcgacggcgcacaaccga

SEQ ID NO: 8410 - DNA, 26 bp, Neisseria meningitidis
cccgctcgagtgtttggcggatgggg

SEQ ID NO: 8411 - DNA, 34 bp, Neisseria meningitidis
cgcggatcccatatgattaaaatcaaaaaaggtc

SEQ ID NO: 8412 - DNA, 27 bp, Neisseria meningitidis
cccgctcgaggccttccttctcaatgg

SEQ ID NO: 8413 - DNA, 33 bp, Neisseria meningitidis
cgcggatcccatatgaaagaagcggggtttgaa

SEQ ID NO: 8414 - DNA, 28 bp, Neisseria meningitidis
cccgctcgagtctcaaagcttccagcag

SEQ ID NO: 8415 - DNA, 33 bp, Neisseria meningitidis
cgcggatcccatatgaaaaccttcttcaaaacc

SEQ ID NO: 8416 - DNA, 28 bp, Neisseria meningitidis
cccgctcgagttatttggctgcgccttc

SEQ ID NO: 8417 - protein, 9 aa, Neisseria meningitidis
SSSLGSAKG

SEQ ID NO: 8418 - protein, 12 aa, Neisseria meningitidis
NYKAPSTDFKLY

SEQ ID NO: 8419 - protein, 16 aa, Neisseria meningitidis
NRASVDLGGSDSFSQT

SEQ ID NO: 8420 - protein, 15 aa, Neisseria meningitidis
NYIGKVNTVKNVRSG

SEQ ID NO: 8421 - protein, 174 aa, Neisseria meningitidis; identical to SEQ ID NO: 4009

SEQ ID NO: 8422 - protein, 174 aa, Neisseria meningitidis
MKKALATLIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSIGLGVLTGVSYAVTPNVDLDAGYRYNYIGKVNTVKNVRSGELSVAVRVKF

SEQ ID NO: 8423 - protein, 174 aa, Neisseria meningitidis
MKKALAALIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSITLGVLTAVSYAVTPNVDLDAGYRYNYIGKVNTVKNVRSGELSVGVRVKF

SEQ ID NO: 8424 - protein, 174 aa, Neisseria meningitidis
MKKALATLIALAIPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSITLGVLTGVSYAVTPNVDLDAGYRYNYIGKVNTVKNVRSGELSVAVRVKF

SEQ ID NO: 8425 - protein, 174 aa, Neisseria meningitidis
MKKALATLIALAIPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSITLGVLTAVSYAVTPNVDLDAGYRYNYIGKVNTVKNVRSGELSVGVRVKF

SEQ ID NO: 8426 - protein, 174 aa, Neisseria meningitidis
MKKALATLIALAIPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSITLGVLTAVSYAVTPNVDLDAGYRYNYIGKVNTVKNVRSGELSVAVRVKF

SEQ ID NO: 8427 - protein, 173 aa, Neisseria meningitidis
MKKALAALIALALPAAALAEGASGFYVQADAAHAKASSLGSAKGFSPRISAGYRINDLRFAVDYTRYKNYKQPSTDFKLYSIGASAVYDFDTQSPVKPYLFARLSLNRASVAHGGSDSFSQKSIALGVLTAVSYAVTPNVDLDAGYRYNYIVKVNTVKNVRSGELSVAVRVKF

SEQ ID NO: 8428 - protein, 174 aa, Neisseria meningitidis
MKKALAALIALALPAAALAEGASGFYVQADAAHAKASSSLGSAKGFSPRISAGYRINDLRFAVDYTRYKNYKAPSTDFKLYSIGASAVYDFDTQSPVKPYLFARLSLNRASVAHGGSDSFSQKSIALGVLTAVSYAVTPNVDLDAGYRYNYIVKVNTVKNVRSGELSVAVRVKF
